United States Patent 11,931,406 (FLAVIVIRUS VACCINE) - sequence listing, part 36

SEQ ID NO: 14023 - RNA, 9879 nt, Artificial Sequence
  derived and/or modified CDS sequence (opt3) from DENV-1__EU482479__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacauuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauauguaccgggagcuucaaacuggagaaggaagucgccgagacgcagcacgguacagugcuuguucagaucaaguacgagggcaccgacgcuccuugcaaaauuccauucucgacucaagaugaaaagggggugacacagaacggacgcuugaucaccgcgaaucccauaguaacugacaaagagaagccugucaacauugaagcagagccacccuuuggcgagucuuauaucaucauuggugccggggaaaaagcucugaagcucuccugguucaagaaaggcucaaguaucggaaagauguuugaggccaccgcaagaggcgccaggcggauggcuauucugggggauacagccugggacuucggaagcauagguggcguguuuacguccguugggaaacuugugcaucagaucuucggaaccgcauacggcguccuguuuucuggugugagcuggacuaugaagauugggaucggcguauugcucacauggcugggauuaaauucacgaaguaccucccugagcaugacauguaucgcggugggccuaguuacucucuaccugggggucauggugcaggcugauucuggaugcgugauuaacuggaaaggccgcgaacuuaagugugguucagggauauucgucaccaaugagguucacacguggacagaacaauauaaguuucaggccgacaguccgaaaagauugagcgcagccaucggaaaggcuugggaggagggcgugugcgguauuagguccgccacccggcuggaaaacaucauguggaaacagauuucuaacgagcucaaucauauccuguuagaaaacgacaugaaguucacugugguagucggcgauguggcagggauacuggcucagggcaaaaagaugauccgcccucaacccauggaguacaaauauucguggaaaagcuggggcaaggccaaaauuaucggggcggacguucagaauaccacauuuauuaucgauggaccaaacacuccugaaugucccgacgaucagagagccuggaauauaugggagguggaggacuacggcuucgguauuuuuaccacaaacaucuggcuuaaguugagggauucccacacgcaggucugcgaccaccgucucaugucagcugcaauuaaagauaguaaggccgugcaugcugacaugggguauuggaucgaaucugagaaaaaugaaaccuggaagcuggcccgggcauccuucauagagguuaagacuuguaucuggccaaaaucccacacacuauggucaaacggagugcuggaaagcgagaugauuauccccaagauuuacggcgguccuaucucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagauaauucaugaaugguguugccgcaguuguaccuuaccuccacuccgguucagaggugaggacgggugcugguacggaauggagaucaggcccgucaaagaaaaggaggaaaaucugguuaagagcauggugucugccggcuccggugagguagacucauuuagucuuggccuguuguguaucagcauuaugaucgaagaggugaugcgcucgcgauggucccggaaaaugcucaugacugggacacuggcugucuucuuucuacugauuaugggacagcucaccuggaacgaucugauacgucuuugcaucauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaauuggucucucacuggucgccaguguggaauugccaaacucccuggaggaauuaggggauggacucgcuaugggcaucaugauucugaaacuucugaccgacuuucaaucucaccaguugugggcgacucuccugagccuaaccuucaucaagacaacuuuuucccugcauuacgccuggaaaaccauggcaaugguucuuucaauagugagccucuucccccuguguuugaguacgacaucucagaagaccacuuggcugccggucuuacucggcucccuggggugcaagccucuuacaauguuucugaucgcugagaauaaaauuuggggaaggcgaagcuggccauugaacgaagguaucauggccguaggcauugugucgauccuccugucaucucuacugaagaacgauguuccccuugccgggccucucauagcuggaggcaugcugauugcauguuaugugaucagugguuccagcgccgacuugucuuuagagaaagcggcugaggucagcugggaagaggaagccgagcacuccggggcaucacauaauauccugguggaaguacaggaugacggaaccaugaagauuaaagaugaggagcgcgacgauacucucacaauacugcuuaaggccacccuguuggcugugaguggcgucuacccccuaagcaucccagcaacgcuguucguuugguauuucuggcagaaaaagaagcagcggucuggcgugcucugggacacuccuucacccccagaaguggagagagccguccuggaugacgggauuuacaggaucaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuuuaagacccccgaaggugaggucggcgccauagcucucgauuucaagccugggacgucgggaagcccaaucgugaaccgagaaggcaaaauuguuggucuguacgggaauggaguggucacaacuucaggcaccuauguguccgccaucgcacaggcuaaggccagucaggagggcccccuuccugagauugaagacgagguuuuucggaaacgcaaccugacaaucauggauuugcauccggggucuggaaagaccagaagguaccuaccagcgauagugcgggaagccauuaaacgaaagcugagaacucucaucuuagcacccacccgcgucguggcuagcgagauggccgaagcucugaaggguaugccuaucagguaucaaacaacggcaguaaaauccgagcacacuggcaaggagauuguggaccuuaugugccaugccaccuucacaaugcgucugcucucaccaguucggguccccaauuacaacaugaucauaauggaugaagcccacuuuaccgacccuucuagcauugcugcgagaggguauaucaguacuagggugggaaugggcgaggcagccgcuauuuucaugacagccaccccgcccgguuccguggaagcauuuccacagagcaaugccgucauccaggaugaggaacgcgacauaccugagcgaucuuggaacucaggguacgaguggauuacggauuuccccggaaaaacuguaugguuugugccauccaucaagaguggcaaugacaucgcuaacuguuugaggaaaaauggcaagcggguuauucagcugagcaggaagacauucgauaccgaauaucagaaaaccaagaacaacgacugggacuacguggucacuacagauaucucggagaugggggcgaauuuccgcgccgaccgugugauugauccuagacggugccucaaacccguuauacugaaggacggaccagaaagggugauccuugcagguccgaugccugucaccguggcuucugccgcacagcgccgaggcagaauugggcggaaccauaauaaagagggagaucaguacaucuauaugggccagccccuaaacaaugacgaggaucacgcccacuggacagaagcuaagaugcuguuggacaacaucaauacuccagaggguauuauacccgccuuauuugaaccugagagggaaaaguccgcggcaaucgauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagauuuggaccaaagagggagaaaggaagaaacuccggccccgcugguuggacgccagaacauauucugacccucuggcucuaagggaguuuaaggaguucgcagccggucggcgauccgugagcggcgaucugauccucgagauugggaaacuuccgcagcaucugacucagagagcucaaaaugccuuagacaacuuggucaugcugcacaauucagaacagggaggccgcgcauacaggcaugcgauggaggagcucccagauaccaucgaaacacugaugcuucuggcccucauagcuguuuugaccgguggggugacucuguuuuucuuaaguggccggggacuaggcaagacgagcaucgggcugcucuguguaguggccuccucuguccuucuguggauggcaagcguggagccccacuggauugcugccuccaucauuuuggaauuuuuccugaugguucuccugaucccugagcccgaccgucagagaaccccacaggauaaccaacuugcauauguggucauaggacuccuguuuaugauuuugacaguagccgcuaaugagaugggucuguuagaaacuaccaagaaagaccuaggcaucgggcacguggcgguugagaaccaucaccaugccgcaaugcuggauguggaccuccacccugcuucagccuggacacuuuacgccgucgcaaccacuauuaucacacccaugaugaggcauacgauagaaaacaccacugcuaauaucucucugacagccauugcgaaccaggcugccaucuugaugggacuggauaagggcuggccaauuaguaaaauggacaucggugugccucuccuggcacuugggugcuacucgcaggucaauccguuaacccugaccgccgcugugcucauguugguugcacacuaugccauaauuggccccggacugcaagcgaaggcuacacgcgaggcccagaaacggacugcagccggcaucaugaagaacccaacgguggaugggaucguagcuauugaccuagauccuguggucuacgacgccaaguucgaaaaacagcugggacagaucaugcuccuuauacuguguaccagccaaauuuugcugaugcgaacaacuugggcacucugcgaguccaucacccuggcuacaggccccuuaaccacucuuugggaggguucuccagggaaguuuuggaauacgacaauugccguuucaauggcgaacaucuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguauaauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugugggagaggaggcuggagcuauuacugcgccgggcucaagaaaguuacagaagugaagggauauacgaaaggcggucccgggcaugaggaaccgauuccaauggcgaccuacggauggaacuuagucaagcugcacucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguacaugcccagcguuguagagacucuggagcagaugcagagaaagcaugguggcaugcucgugaggaacccacuuucgcgaaauucuacacacgaaauguauugggucaguugcgggaccggaaacauaguguccgcuguuaauaugacgagccggaugcuguuaaaccguuucaccauggcacacagaaaaccuacauacgagaaggauguggaccugggcgccgguacucgccaugucgcuguggaacccgagguagccaacuuggauauuaucgggcagaggaucgaaaauauuaaacacgagcauaagucaaccuggcacuaugacgaggauaacccuuacaaaacaugggcauaucauggauccuacgaagugaagccaucuggcagcgccaguuccaugguuaauggcgucgugaagcuccugacuaaacccugggacgugauaccuauggucacccaaaucgcuaugacagauaccacuccauuugggcagcagcggguuuucaaggagaaaguggacacgagaacacccaaggcgaaacgcggaaccgcccaaauuauggaaguaacugcaaaguggcuaugggguuuucuuagcaggaacaagaaaccgcgaaucuguacccgggaggaguucacaagaaaggugaggucuaaugcugccauuggcgcagucuuuguggacgagaaccaguggaacucagccaaagaggcuguugaagaugagcgcuucugggaccuggugcaccgugaacgggagcuccacaagcaggggaaaugcgccacgugcgucuauaacaugaugggaaagagagaaaagaaacugggcgaguuugguaaggcgaaagggaguagggcaaucugguacaugugguugggagcccgcuuccuggaguucgaagcucucggcuuuaugaaugaggaucauugguucucccgagaaaacagccuuucuggcguggagggggagggacugcacaaguuagguuacauacugcgggacaucucgaaaauuccuggcgggaauauguaugccgaugacaccgcaggaugggauacuagaaucacagaagacgauuugcagaacgaggcuaggauuaccgacaucauggaaccagagcaugcccuccuggcuaagucaauauuuaaacuaacuuaccaaaauaagguaguucgcgugcagagacccgccaagaacggcacagucauggaugugauuagccggagggaccagcgugguuccggacaggugggaaccuauggccuuaauacauucacuaacauggaagcacaacugauccgacagauggagagugagggcaucuuuucuccuagcgaacucgagaccccaaaccuggcggaacgcgucuuggauuggcuaaagaaguacgggguugagagacugaaacggauggccauuuccggagacgacugugugguaaagcccauagaugacagguucgcuacggcccucaccgcacuuaaugauauggguaaagugcgcaaggacaucccgcagugggaaccuucaaagggcuggaacgauuggcagcaaguccccuuuugcagucaccacuuccaucagcugauuaugaaagacgggagagagaucgugguuccaugucggaaucaggaugagcuagugggaagggcucgagucucucagggcgccgguuggagccugcgugaaacagcaugccucgggaaguccuaugcccaaauguggcaguugauguacuuucacagacgcgaccugcggcuugcggcuaacgccauuuguucagcagugccuguagauuggauccccacuagcaggaccacauggucuauacaugcccaccaucaguggaugacuaccgaggacaugcuguccguuuggaauagaguguggaucgaagagaacccauggauggaagauaaaacgcacauuaguagcuggggagacguccccuaucucggcaagcgcgaggaccaauggugcggcucguuaaucgggcugacagcucgggccaccugggcaacuaauauucagguggcuaucaaccagguuaggcgauugauuggaaaugagaacuaccuggauuacaugacauccaugaaaagauucaagaaugaaggugacccugagggcgcccucugguga

SEQ ID NO: 14024 - RNA, 9879 nt, Artificial Sequence
  derived and/or modified CDS sequence (opt3) from DENV-1__EU482480__SS-prME
agcgugaccaugcugcucaugcuuaugcccacugcacuggcuuuccacuugacuacgagaggaggggaaccucauaugaucgucuccaagcaggaaagagggaaaucuuuacuguuuaagaccucagccgguguuaauaugugcacccugauugccauggaccucggagaguucugugaagauacuaugaccuacaaaugcccacggauuaccgaagcggaaccggacgauguggacuguuggugcaaugcuaccgauacuuggguaacauaugggaccuguacgcaaaucggagagcaccgccgagacaagcguaguguggcccuggcaccccaugucggccuuggucuggagacuagaaccgaaacauggaugagcuccgagggggccuggaaacagauucagaggguggaaacuugggcuuugcggcacccuggauuuaccguuaucgcacucuuccuggcccaugcuauuggcacaucuaucacccagaagggcauaaucuuuauucugcucauguuagccacgccaucgauggcgaugcgcugcguggggaucggaucaagagauuucgucgagggucugagcggcgcaacuuggguggacguaguucuugagcacgggaguugugugacaaccauggccaaggauaaacccacuuuggacauugaacugcuaaagacagaggucaccaacccugcugugcucaggaaacugugcaucgaagccaagauauccaauacgaccacagauucucgguguccaacucaaggagaggcaacccuuguggaagaacaagacgcuaacuuugucugccgccgaacauucguugauagaggcugggguaauggguguggacuguuuggcaaaggcagcuugauuacuugcgccaaguucaagugcgugaccaaacucgaggggaagaucguacaguacgaaaaccugaaauauuccgugauugucacagugcacaccggagaccagcaucaaguugguaaugagucaacugaacacggcacgaucgcgacaaucacaccccaggccccuaguacugagauucaguuaaccgacuacggggcacugacacucgauuguagcccaaggaccggacuugacuuuaacgaaauggugcuguugacuaugaaggagaaaucuuggcuaguccauaagcagugguuccuggaucucccgcugcccuggacauccggcgcuucaacgagccaagagaccuggaaucggcaggaccuucuggugacuuuuaaaacagcccacgcuaagaagcaggaaguaguuguguuggguagucaagagggggccaugcacaccgcacucacaggcgccacugaaauacagaccucuggaacgaccacaaucuucgcuggccaucugaaaugccguuuaaagauggauaaacugacucuaaaggggauguccuaugucauguguaccggcucguucaaacucgagaaggaaguggcggagacacagcacgguacuguccuggugcagauuaaguacgagggcaccgacgcaccuugcaaaaucccauuuucgacgcaagaugaaaaggggguuacacagaacggacgccuuauaaccgccaaucccauugugacugacaaagagaagccuguaaacaucgaagcugagccacccuucggcgagucuuauaucgucauuggugccggggaaaaagcauugaagcuguccugguuuaagaaaggcucaaguaucggaaagauguucgaggccacagcuagaggcgccaggcggauggcaauucucggggauaccgcgugggacuuuggaagcauagguggcguguucacuuccguugggaaacuggugcaucagaucuuuggaaccgcuuacggcguccuuuucucuggugugagcuggacaaugaagauugggaucggcguacuguugacguggcucggacuaaauucacgaaguaccuccuuaagcaugacuuguaucgccgugggccugguuacacuauaccucggggucauggugcaggcagauucuggaugcgugauuaacuggaaaggccgcgaacugaagugugguucagggauauuugucaccaaugagguucacacauggacugaacaauauaaguuccaggccgacaguccgaaaagacuuagcgcugccaucggaaaggcaugggaggagggcgugugcgguauuagguccgcuacccgguuggaaaacaucauguggaaacagauuucuaacgagcugaaucauauccuccuggaaaacgacaugaaguuaacggugguagucggcgauguggccgggauacuggcgcagggcaagaagaugauccgcccucaacccauggaguacaaauauucguggaagauuuggggcaaggccaaaaucauuggggcugacguucagaauacaaccuuuaucauagauggaccaaacacuccugaaugucccgacgaucagagagcauggaauauuugggagguggaggacuacggcuucgguaucuuuaccacaaacauuuggcuuaaguugagggauagcuauacucaggucugcgaccaccgucucauguccgccgcuaucaaagauucaaaggccgugcacgcagacaugggguacuggauagaaagugagaaaaaugaaaccuggaagcuggcgcgggccucuuucaucgagguuaagacauguauuuggccaaaaagccauacgcuaugguccaacggagugcuggaaucagagaugaucauucccaagaucuauggcgguccuauaagccaacacaauuaccgaccaggcuacuucacccagacugcugggccguggcaucucggaaaacuggagcuugauuuugacuugugcgaaggcacaaccguagucguggaugagcacugcgggaacagaggacccucucugaggacuacaaccgugacgggcaagauuauccacgaaugguguugccgcuccuguacuuuaccuccacuccgguucaaaggugaggacgggugcugguauggaauggagaucagacccgucaaggaaaaggaggaaaaucugguuaaaaguauggugagcgccggcucuggugagguagacuccuuuucacuuggccuguuguguauuaguaucaugauugaagaggugaugaggagccgcuggucgcgaaagaugcucaugaccgggacacuggcagucuucuuucuacugauaaugggacagcucaccuggaacgaucugauccggcuuugcauuauggugggcgcuaaugccuccgaccguauggggaugggaacuacauacuuggcacugauggccaccuucaaaaugagaccuauguuugcuguuggcuuacucuucaggcgccugacaucucgggaggugcuucugcuaacuaucggucucagccuggucgcgucaguggaauugccaaacagucuggaggaauuaggggauggacucgccaugggcauuaugauccugaaacuucugaccgacuuucaaucccaucaguugugggcaacgcuccugucucuaacauucauaagaaccacuuuuagccugcacuaugcuuggaaaaccauggccaugguucuuuccaucgugucacucuucccccuguguuugagcacaacaagucagaagaccacguggcugccggucuuacucggcucucuggggugcaagccucuuacaauguuucugauugccgagaauaaaaucuggggaaggaaguccuggccauugaacgaagguauuauggcuguaggcaucgugagcauacuccugucgucacuacugaaaaacgauguuccccuugcagggccucucauugccggaggcaugcugaucgcguguuacgugaucucugguaguuccgcugacuugagcuuagagaaggccgcagaggucucuugggaagaggaagccgagcauagcggggcuucccacaauauucugguggaaguacaggaugacggaaccaugaaaauaaaggaugaggagcgagacgauacucucacaauccugcuuaaagcaacccuguuggccgugucaggcgucuauccccuaaguauuccagcgacucuguucguuugguacuucuggcaaaagaagaaacagcgcagcggcgugcucugggacacaccuucucccccagaaguggagcgggcuguccuggaugacgggaucuauagaauuaugcagaggggacuuuuaggucguucccaggugggcguugggguauuucaagaaaacguguuccauaccauguggcacgucacgcgcggagccgugcugauguaccagggcaagcggcucgagccgucaugggcaaguguuaaaaaggacuugaucagcuacggugggggauggagacugcagggcuccuggaauacuggcgaggaagugcaggucauagccguggagccugggaaaaaccccaagaauguacaaaccgcuccaggaacauuuaagaccucugaaggugaggucggcgccaucgcacucgauuucaaacccgggacaucgggaagcccuauugugaacagggaaggcaagaucguuggucuguaugggaauggaguggucacuaccucaggcacguacguguccgcuauugcccaggcgaaagccagucaggagggcccacuucccgagaucgaagacgagguuuuucgaaagcggaaccugacaauaauggauuugcacccugggucuggaaaaacucgcagauaucuaccggcaauugugagggaagcuaucaagcggcgacugagaacccucaucuuagccccaacacgcgucguggcuagcgagauggcagaagcccugaaggguaugcccauuagguaccaaaccacugccguaaaauccgagcauaccggcaaggagaucguggaccuuaugugccacgcuacauucacgaugcgucugcucucaccuguucgggucccaaauuauaacaugauaauuauggaugaagcgcauuuuacugaccccucuagcaucgcagccagaggguacauuaguaccagggugggaaugggcgaggcugccgcaaucuucaugacagccaccccuccggguuccguggaggcuuuuccccagagcaaugcggucauacaggaugaggaacgcgacauuccagagcgaucuuggaacucaggguaugaguggaucacugauuucccuggaaaaacaguaugguuugugcccuccaucaagaguggcaaugacauugccaacuguuugaggaaaaauggcaagcggguuauccagcugagcaggaagaccuucgauacggaauaccagaaaacuaagaacaacgacugggacuacguggucacaaccgauauuucggagaugggggcaaauuuccgcgcugaccgugugauagauccaagacggugccucaaaccuguuauccugaaggacggacccgaaagggugauucuugccgguccaaugccggucaccguggcaucugccgcucagcgccgaggcagaaucgggcggaaccacaauaaagagggagaucaguauaucuacaugggccagccucuaaacaaugacgaggaucaugcccacuggacugaagcgaagaugcuguuggacaacauuaauacacccgaggguauaaucccagcauuauuugaacccgagagggaaaaguccgccgcuauugauggggaguaucgccugagaggcgaggccaggaaaaccuucguagaacucaugcggcguggagaccugccuguguggcuuagcuacaagguugcuucagagggcuuucaauauagugaucgccgauggugcuucgacggggaaagaaacaaucagguccuggaggaaaacauggauguggagaucuggacaaaagagggagaaaggaagaaacuccggccacgcugguuggacgcaagaacuuacucugacccccuggcccuaagggaguuuaaggaguucgcugccggucggcgauccgugagcggcgaucugauucucgagaucgggaaacuuccucagcaccugacgcagagagcacaaaaugcguuagacaacuuggucaugcugcauaauucagaacagggaggccgcgccuauaggcacgcuauggaggagcucccggauaccauagaaacacugaugcuucuggcccucaucgcaguuuugacugguggggugacccuguuuuucuuaaguggccggggacuaggcaagacaagcauugggcugcucuguguaauggcuuccucugugcuucuguggauggccagcgucgagccacauuggaucgcagccuccauuaucuuggaauuuuuccugauggugcuccugauacccgagccugaccgucagagaacaccccaggauaaccaacuugcuuacguugugauuggacuccuguuuaugaucuugacugucgcggccaaugagaugggucuguuagaaacgaccaagaaagaccuaggcauugggcacguagcaguggagaaccaccaucacgcugccaugcuggauguugaccuccauccagccucagcauggacacuuuacgcuguggccacuaccaucauaacaccuaugaugaggcacaccaucgaaaacacuacagcgaauauuucucugacggcuaucgccaaccaggcagccauuuugaugggacuggauaagggcuggcccaucaguaaaauggacauaggugucccacuccuggcucuugggugcuauagccaggugaauccuuuaacccugacugcagccguccucauguugguggcgcauuacgcuauuaucggcccgggacugcaagccaaggcaacacgcgaggcccagaaacggaccgcugccggcaucaugaagaaccccaccguugaugggauuguggcaaucgaccuagauccaguaguguaugacgcuaaguucgaaaaacagcugggacagauaaugcuccuuauucuguguacaagccaaaucuugcugaugcgaacuacgugggcccucugcgaguccauuacccuggcgacaggcccuuuaacuacccuuugggaggguucucccgggaaguuuuggaauacaaccaucgccgucucaauggcaaacauauucagaggaagcuaccuggcuggcgccggucucgcauucucccuaaugaaaagucugggcgggggaaggcgcggcacuggggcucagggagaaacguugggcgagaaguggaaacggcagcugaaucagcucucuaagagcgaauuuaacacauauaagagaucagguaucauggagguugaccguuccgaagccaaagaggggcuuaagaggggagagaccacuaaacacgccgugagucggggcaccgcgaagcugcgcugguucgucgaacgaaauuuggugaaaccagaggguaagguaauugaucugggcugugggagaggaggcuggagcuacuauugcgcugggcucaagaaagugacagaaguuaagggauacacuaaaggcgguccugggcacgaggaacccaucccgauggcaaccuacggauggaacuuagugaagcugcauucuggcaaagacgucuuuuucauuccaccugagaagugugauacacuucugugcgacaucggcgaguccucacccaauccaacgauugaagaggggaggacccuacgggugcucaaaauggucgaacccuggcugcgcggaaaccaauuuuguaucaagauauugaauccuuauaugccgagcgugguugagacucuggagcagaugcagagaaagcacgguggcaugcucguaaggaacccccuuucgcgaaauucuacacaugaaauguacugggugaguugcgggaccggaaacauugucuccgccgugaauaugacuagccggaugcuguuaaaccguuucacaauggcucacagaaaaccaaccuaugagcgcgauguugaccugggcgccgguacgaggcacguggcagucgaaccugagguggccaacuuggauaucaucgggcagcggauugaaaauauaaagcaugagcacaaaucaaccuggcauuacgacgaggauaaccccuauaagacaugggcuuaccacggauccuaugaaguaaaaccuucuggcagcgcgaguuccauggugaauggcguugucaagcuccugacuaagccaugggacgugauccccauggugacccaaauugccaugacagauacuaccccuuuugggcagcagagagucuucaaagagaagguugacacacgcaccccaaaagcaaagaggggaacugcucaaaucauggaagugacggccaaauggcuaugggguuuucuuagccgaaacaagaagccccggauuuguacaagagaggaguucaccaggaaaguacgcucuaaugcagccaucggcgcuguguuugucgacgagaaccaguggaacucagccaaggaggcgguggaagaugagcguuucugggaccugguucaucgggaaagagagcuccacaaacaggggaagugcgcaacuugcguguacaacaugaugggaaaaagggaaaagaagcugggcgaguuugguaaagccaaggggagucgcgcuauaugguacaugugguugggagcccgauuccuggaguucgaagcacucggcuuuaugaaugaggaucacugguucucccgggaaaacagccuuucuggcgucgagggggagggacugcauaaauuagguuauauccugagagacauuucgaagaucccgggcgggaauauguacgcugaugacaccgccggaugggauacaaggauuacggaagacgauuugcagaacgaggcuaaaaucaccgacauaauggaaccugagcacgcccuccuggcaaagucaauuuuuaaacuaacuuaucaaaauaaggugguacgcguucagagaccagcgaagaacggcacagugauggaugucaucagccggagggaccagcgugguuccggacaggugggaaccuacggccuuaauacuuucacaaacauggaagcccaacugauccgacagauggagagugagggcauauuuucucccagcgaacucgagaccccuaaccuggcugggcgcguguuggauugguuagaaaaacauggagucgagagacugaagcggauggccauauccggugacgacuguguugugaaaccaaucgaugacagguucgcaacagcucucacugcccuuaaugauaugggcaagguacgcaaagacauuccccagugggaaccgucaaagggguggaacgauuggcagcaagugccuuuuugcagucaccacuuccaucagcugaucaugaaggacggaagagagauugucgugcccugucggaaucaggaugagcuaguuggcagggcacgagugucucagggugccggguggagccugcgugaaaccgcgugccucggaaaauccuaugcucaaauguggcaguugauguacuuucacagacgcgaccugcggcuugccgcaaacgccaucuguucagcugucccaguggauuggguaccuacgagcaggaccacauggucuauacaugcccaccaucaguggaugacuaccgaggacaugcuguccguuuggaauagaguguggaucgaagagaaccccuggauggaagauaagacacacgucaguagcuggggcgacgugccauaucucggcaaacgcgaggaccaauggugcgggucguuaauuggacugacugcacgggcuaccugggccacgaauauccagguugcgauuaaccaggugaggcgauugcuggguaaugagaacuaccucgauuacaugacauccaugaagagauucaaaaaugaaucugaccccgagggcgcucuuugguga

SEQ ID NO: 14025 - RNA, 9879 nt, Artificial Sequence
  derived and/or modified CDS sequence (opt3) from DENV-1__EU482481__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaacaugugcacuuuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaaaaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaaucaccgaccaggcuauuucacacagaccgcggggccguggcaccucggaaaacuggagcuugauuuugacuugugcgaaggcacuacagugguggucgaugagcauugcgggaacagaggacccucccugaggaccacgacuguuaccggcaagaucauucacgaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaccuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaucagcucugggcgacccugcuaagccugacuuuuauuaaaaccacacuuucccuccacuaugccuggaagacuauggcaaugguccugucaaucgucagcuuguucccccuguguuuaaguaccacgucucagaagacaaccuggcucccggugcugcuuggcucccuggggugcaaaccuuugacuauguuucucauuacagagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuacguaauuagugguuccagcgcagaccugucucucgagaaagccgcggaggugagcugggaagaggaagcugagcauuccggggccucacacaauauccuggucgaaguucaggaugacggaaccaugaagauaaaagaugaggagagggacgauacucuuacaauucuguugaaggcaacccuacuggccgugaguggcguguauccccucagcaucccagcuacgcuguucgucugguacuuuuggcaaaagaaaaagcagcgaucuggcgugcuuugggacacuccuucacccccagaaguugagcgcgcaguauuagaugacgggaucuaucggauuaugcagagaggacugcucgguaggagccaggugggcgucgggguguuccaagaaaacguuuuccacaccauguggcaugugacacguggagccgucuugauguaccagggcaaacgccuggagccgaguugggcgagcgugaagaaagaccucauauccuauggugggggauggcggcugcagggcucuuggaauaccggcgaggaaguacaggucaucgcuguggagccugggaagaaccccaagaauguucaaacagccccaggaacuuuuaaaacccccgaaggugaggugggcgcaauugcccuugauuucaagccugggacgucgggaagcccaaucgucaacagagaaggcaaaauugugggucuguacgggaauggaguugugacaacuucaggcaccuacgucuccgcuaucgcccaggcaaaggcuagucaggagggccccuugccugagauagaagacgagguguuuaggaaacgaaaccuaacaaucauggaucugcacccggggucuggaaagacccggcgcuaucucccagccauuguaagagaagcgaucaagaggaaauuacggacucugauucuugcccccacccgagugguugcaagcgagauggcugaagcccugaaggguaugccuaucagauaccaaacaacggcugucaaauccgagcauacuggcaaggagauaguggaccucaugugccacgcaaccuucacaaugcgcuugcugucaccagugaggguccccaauuauaacaugauuaucauggaugaagcccauuuuaccgacccuucuagcaucgccgcucguggguacauuaguacucggguaggaaugggcgaggcggcagccaucuucaugacagcuaccccgcccgguuccguggaagccuuuccacagagcaaugcaguuauacaggaugaggaaagagacauuccugagaggucuuggaacucaggguaugaguggaucacggauuuccccggaaaaacugugugguuugucccauccauuaagaguggcaaugacaucgccaacugucuccgcaagaauggcaaacgagugauacagcugagcagaaagacauucgauaccgaauaccagaaaaccaagaacaacgacugggacuauguugugacuacagauauuucggagaugggggcuaauuuucgggcggacagggucaucgauccucgccguugccuuaaacccgugauccuaaaggacggaccagaaagaguaauucuggccgguccgaugccugugaccguugcaucugcugcccagcggaggggccgcaucgggcgaaaccacaauaaggagggagaucaguacauuuacaugggccagcccuugaacaaugacgaggaucacgcacauuggacagaagccaaaauguuacuggacaacauaaauacuccagaggguaucauucccgcucucuucgaaccugagagagaaaaguccgccgcgaucgauggggaguaucggcugaggggcgaggcacgcaaaacguucgucgaacuuaugagaaggggagaccugccaguguggcucagcuacaagguggccucagagggcuuucaauauagugaucggcguuggugcuucgacggggaacgcaacaaucaggucuuggaggaaaacauggauguugagaucuggaccaaagagggagaacgaaagaaacugagacccagguggcuagacgcucggacauacucugacccucuggcccuccgcgaguuuaaggaguucgcugcagguagaagguccgugagcggcgaucuuauuucagagauagggaagcugccgcagcacuuaacucagcgggcccaaaaugcuuuggacaaccugguaaugcuccauaauagugaacagggaggccgagccuauagacacgcaauggaggagcugccagauaccaucgaaacacuuaugcugcucgcguugauugccgugcugaccgguggggucacuuuauuuuuccuaagcggccgcggacugggcaaaacguccaucgggcuccuuugugugauggcuucuagcguucuguuguggauggccuccguggagccccacuggauugcagcuucaaucauacuggaauuuuuccucaugguccugcuuaucccugagcccgacaggcagcggaccccacaggauaaccaacucgccuacguagugauuggacuguuguuuaugauccugacaguugcagccaaugagauggguuuacuagaaacuaccaagaaagaccugggcauugggcauguggcugucgagaaccaccaucacgcgacaaugcucgauguggaccuucauccugccucugcauggacccuguaugcugucgccacuacaaucauaacgcccaugaugcgucacaccauugaaaacacuacagccaauaucaguuugaccgcaauugcuaaccaggccgcgauccugaugggacucgauaagggcuggccaauaucgaaaauggacaucggugugccucugcuugcuuuagggugcuacagccagguuaauccgcugacccucacagccgcaguguugaugcugguagcccacuacgcuauuaucggccccggacuacaagcaaaggccacuagagaggcgcagaagaggacggcugccggcauuaugaaaaacccaaccguggaugggaucauagcaauugaccuggauccugucguuuaugacgccaaguucgaaaaacagcucggacagaucaugcuucugaucuuguguacaucccaaauucugcucaugcgcacuaccugggcucugugcgagucuaucacauuagccaccggcccccuuacuacgcugugggaggguucaccagggaaguuuuggaauacaaccauagcagugagcauggcuaacauuuuccggggauccuaccucgccggcgcgggucuagccuuuagucugaugaaaucuuugggcgggggacgaagaggcacuggggcacagggagaaacccugggcgagaaguggaagaggcagcucaaucagcuuagcaaaucagaguucaacaucuauaagcgcuccgguauuauggaggucgaccggagugaagcuaaagaggggcugaagagaggagagacaacucgucaugccgugagcaggggcaccgcaaaauugcggugguucguagaacgcaaucuggugaagccugaggguaagguuaucgaucucggcugugggcgaggaggcuggucuuacuauugcgcugggcuaaagaaggugacagaagucaaaggauacacgaagggcggucccgggcacgaggaaccgauaccaauggccaccuauggauggaaccuggugaaacuucauuccggcaaggacgucuuuuucacuccucccgagaaaugugauacacugcuaugcgacaucggcgagucaagcccaaaucccaccauugaagaggggagaacucucagggugcugaagaugguugaaccuugguugcggggaaaccaauuuuguaucaagauucugaauccguacaugcccucgguaguggagacacucgagcagaugcagcgcaaacacgguggcaugcuugucagaaacccacugucuaggaauaguacccacgaaauguacuggguguccugcgggacgggaaacaucguuagcgccgugaauaugaccucacgaauguuacugaaccgguucacaauggcgcaucguaagccuacuuaugagagagaugucgacuugggcgcugguacccgccacguggcaguagaacccgagguggccaaccucgauauuaucgggcagaggauagaaaauauuaaacaugagcacaaguccacauggcauuacgacgaggauaacccuuauaaaacuugggcuuaccacggaucuuaugaaguuaagccaagcggcagugccuccagcauggucaauggcguggugaagcugcuaaccaaacccugggacgucaucccuaugguuacacaaaucgcaaugaccgauacuacgccauuugggcagcagcggguguucaaggagaaaguagacacaagaacccccaaggccaaacgcggaacugcucaaauuauggaagugaccgcgagguggcuuugggguuuucugucucgaaacaagaagccgcggauauguacaagagaggaguucacgaggaaaguccgcucaaaugccgcaaucggcgcuguguuuguugacgagaaccaguggaauagugccaaggaggcaguggaagaugagcguuucugggaccucguccagaaagaacgggagcugcacaagcaggggaaaugcgcaaccugcguguacaacaugaugggaaagagagaaaagaaauugggcgaguuugguaaggcuaaaggguccagggccauuugguauauguggcugggagcgcgcuuccucgaguuugaagcacuuggcuucaugaaugaggaucauugguucagccgagaaaacucucugucgggcguagagggggagggauuacacaagcuggguuacaucuugcgggacauuucaaaaaucccuggcgggaauauguacgccgaugacacugcuggaugggauacaagaauaaccgaagacgaucuccaaaacgaggccaagaucacugacauuauggaaccagagcaugcacugcuagcuacaagcaucuuuaaacuuaccuaucagaauaagguugugaggguccagcgccccgccaagaacggcacagugauggaugugauuuccagacgggaccagagggguagugggcaagucggaacuuacggccugaauaccuucacgaacauggaagcucagcucauccgucagauggagucugagggcauauuucugccuagcgaauuggagaccccaaacuuagccgaacgaguucuggauuggcucgagaaauaugggguggaacgccuuaagagaauggcaauuuccggagacgacuguguagugaaacccaucgaugaccgguucgcgacagcccugacugcucuaaaugauauggguaaggucaggaaagacaucccgcagugggagccuucaaagggcuggaacgauuggcaacaggugcccuuuugcagucaccacuuccaucagcugauuaugaaggacgggcgcgagauaguugugccauguagaaaucaggaugaacucgucggacgggccagggugucucaaggcgcagguuggagcuugcgagagaccgcuugccuggggaaauccuacgcccagauguggcagcuuauguauuuucaccguagagaccugcgccucgcagccaacgcgaucuguucagcuguaccuguugauugggugcccacaagccggacuaccuggucuauucaugcccaccaucaauggaugacgacagaagacauguuauccgucuggaauaggguguggaucgaggaaaacccauggauggaggauaagacccacguuaguagcuggggagacgugcccuaccugggcaaaagagaggaccaguggugcggcucguugauugggcugacugcacgcgccacaugggcuuccaauauccaggucgccauaaaccaggugcggaggcucaucggaaaugaaaacuaucuugauuacaugaccucuaugaagcgauucaaaaaugagggugacccugaaggcgcacugugguga

SEQ ID NO: 14026 - RNA, 9879 nt, Artificial Sequence
  derived and/or modified CDS sequence (opt3) from DENV-1__EU482482__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaauaaaauauggggaaggcgaagcuggccacucaacgaagguaucauggccguaggcauugugucgauccugcuaucaucucugcuuaagaacgauguuccccucgccgggccucugauugcuggaggcauguugaucgcauguuacgugauaagugguuccagcgccgacuuaucucuggagaaagcggcugaggucagcugggaagaggaagccgagcauuccggggcaucacacaauauucucguggaaguacaggaugacggaaccaugaagaucaaagaugaggagcgcgacgauacucugacaauccuucugaaggccaccuugcuagcugugaguggcgucuauccccugagcauuccagcaacacucuucguuugguacuucuggcagaagaagaagcagcggucuggcgugcugugggacacuccuucacccccagaaguggagagagccguccuugaugacgggauauauaggaucaugcagcguggauuacugggucgcagccaggugggcguugggguauuucaagaaaacguguuccauaccauguggcacgucacacggggagcggugcucauguaccagggcaaaagauuggagccgaguugggcuagcguuaagaaagaccugauuuccuacggugggggauggaggcuccagggcucuuggaauaccggcgaggaagugcaggucaucgccguggagccugggaagaaccccaaaaauguacaaacagcaccaggaacuuuuaagacccccgaaggugaggucggcgccauugcucuggauuucaagccugggacgucgggaagcccaaucgugaaccgagaaggcaaaauaguuggucuuuaugggaauggaguggucacaacuucaggcaccuacguguccgccaucgcacaggcuaaggccagucaggagggcccccugccugagauugaagacgagguuuuucggaaacgcaacuugacaaucauggaucuacacccggggucuggaaagaccagaagguaucugccagcgauugugcgggaagccaucaaacgaaagcucagaacuuuaauacuggcacccacccgcgucguggcuagcgagauggccgaagcucuuaaggguaugccuauuagguaccaaacaacggcaguaaaauccgagcauacuggcaaggagaucguggaccugaugugccacgccaccuucacaaugcgucucuugucaccaguucggguccccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccguggaagcauuuccacagagcaaugccgucauccaggaugaggaacgcgacauuccugagcgaucuuggaacucaggguaugaguggaucacggauuuccccggaaaaacuguaugguuugugccauccauaaagaguggcaaugacauugcuaacugucugaggaaaaauggcaagcggguuauccagcucagcaggaagacauucgauaccgaauaccagaaaaccaagaacaacgacugggacuacguggucacuacagauaucucggagaugggggcgaauuuccgcgccgaccgugugauugauccuagacggugccugaaacccguuauccuuaaggacggaccagaaagggugauucuagcagguccgaugccugucaccguggcuucugccgcacagcgccgaggcagaauagggcggaaccacaauaaagagggagaucaguauaucuacaugggccagccccugaacaaugacgaggaucaugcccacuggacagaagcuaagauguuguuagacaacauuaauacuccagaggguaucauccccgcccuguuugaaccugagagggaaaaguccgcggcaauugauggggaguaucgccucagaggcgaggccaggaaaacguucguagaacugaugcggcguggagaccuuccaguguggcugagcuacaagguugcuucagagggcuuucaauauagugaucgccgauggugcuucgacggggaaagaaacaaucagguccucgaggaaaacauggauguggagauauggaccaaagagggagaaaggaagaaauugcggccccgcuggcuggacgccagaacauacucugacccucuagcucugagggaguuuaaggaguucgcagccggucggcgauccgugagcggcgaucucauccuugagauugggaaacugccgcagcacuuaacucagagagcucaaaaugccuuggacaaccuggucaugcuccauaauucagaacagggaggccgcgcauauaggcacgcgauggaggagcugccagauaccaucgaaacacuuaugcugcucgccuugauugcuguucugaccgguggggugacuuuauuuuuccuaaguggccggggacugggcaagacgagcaucgggcuccuuuguguaauggccuccucugugcuguuguggauggcaagcgucgagccccauuggauagcugccuccaucauucuggaauuuuuccucauggugcugcuuaucccugagcccgaccgucagagaaccccacaggauaaccaacucgcauacguugugauuggacuguuguuuaugauccugacagucgccgcuaaugagauggguuuacuagaaacuaccaagaaagaccugggcauagggcacguagcgguggagaaccaccaucacgccgcaaugcucgauguugaccuucauccugcuucagccuggacacuguacgccguggcaaccacuauuaucacacccaugaugaggcacacgauugaaaacaccacugcuaauaucucuuugacagccauagcgaaccaggcugccauccugaugggacucgauaagggcuggccaauuaguaaaauggacaucggugucccucugcuugcauuagggugcuauagccaggugaauccgcugacccucaccgccgcugucuugaugcugguggcacauuacgccauuaucggccccggacuacaagcgaaggcuacacgcgaggcccagaaacggacugcagccggcauaaugaagaacccaacgguugaugggauuguggcuaucgaccuggauccuguaguguaugacgccaaguucgaaaaacagcucggacagaucaugcuucugauuuuguguaccagccaaauccugcucaugcgaacaacuugggcacugugcgaguccauaaccuuagcuacaggcccccuuaccacucugugggaggguucuccagggaaguuuuggaauacgacaauugccgucucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauuauggagguugaccguuccgaagcaaaagaggggcugaagaggggagagacaacuaaacacgcugugagucggggcaccgccaaguugcgcugguucgucgaacgaaaucuggugaaaccugaggguaagguaaucgaucucggcugugggagaggaggcuggagcuacuauugcgccggguuaaagaaagugacagaaguuaagggauacacgaaaggcggucccgggcacgaggaaccgauaccaauggcgaccuacggauggaaccuggugaaacuucauucuggcaaagacgucuuuuucaucccucccgagaagugugauacucugcuaugcgacauuggcgaguccucaccaaaucccacaaucgaagaggggaggacccuccgggugcugaaaauggucgaaccuugguugcgcggaaaccaauuuuguauuaagauccugaauccguauaugcccagcgugguugagacucucgagcagaugcagagaaagcacgguggcaugcuuguaaggaacccacugucgcgaaauucuacacaugaaauguacugggugaguugcgggaccggaaacauugucuccgcugugaauaugacgagccggauguuacugaaccguuucaccauggcacacagaaaaccuacauaugagcgcgauguugacuugggcgccgguacuaggcacguggcugucgaacccgagguggccaaccucgauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcugcuaacuaagcccugggacgugaucccuauggugacccaaauugcuaugacagauaccacuccauuugggcagcagagagucuucaaagagaagguugacacgcgcacacccaaagcgaagaggggaaccgcccaaauaauggaagugacugcaaaauggcuuugggguuuucugagccgaaacaagaagccgcggaucuguaccagagaggaguucacaaggaaaguacgcucuaaugcugccauuggcgcaguguuugucgacgagaaccaguggaacucagccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcgucgagggggagggauuacauaaacuggguuauauuuugagagacaucucgaagauaccuggcgggaauauguacgccgaugacaccgcaggaugggauacuaggaucacagaagacgaucuccagaacgaggcucgcauuaccgacaucauggaaccagagcacgcccugcuagcuaaaucaauuuuuaaacuuacuuaucaaaauaaagugguaagaguucagcggcccgccaagaacggcacagugauggaugucaucagcaggcgugaccagcgagguuccggacaggugggaaccuacggccugaauacauucacuaacauggaagcacaacucauacgccagauggagagugagggcauauuuucuccuagcgaacuggagaccccaaacuuggcgaagagaguguuagauuggcuggaaaaauauggggucgagcggcucaagaggauggccaucuccggagacgacuguguugugaaacccaucgaugaccgcuucgcuacggcccuuaccgcacugaaugauauggguaagguaagaaaagacauuccgcagugggaaccuucaaagggcuggaacgauuggcagcaagugcccuuuugcagucaucacuuccaccagcuaauaaugaaggacgggcgggagaucgucgugccauguaggaaucaggaugagcugguuggacgagcucgugugucucagggcgccgguuggagccucagagaaacagcaugcuuggggaaauccuacgcccaaauguggcagcugauguauuuucaucgccgggaccuuaggcuggcggcuaacgccauuuguucagcagucccuguggauuggauccccacuagcagaaccacauggucuauucacgcccaucaccaguggaugacuaccgaggacaugcucuccguauggaaucgcguuuggaucgaagagaacccauggauggaagauaagacgcauauaaguagcuggggagacgugcccuacuuaggcaaacgggaggaccaauggugcggcucgcugaucggguugacagcuagggccaccugggcaacuaauauucaggucgcuaucaaccaggugcgaagacugauuggaaaugagaacuaccucgauuauaugacauccaugaagcgguucaaaaaugaaucugacccugagggugcccuuugguga

SEQ ID NO: 14027 - RNA, 9879 nt, Artificial Sequence
  derived and/or modified CDS sequence (opt3) from DENV-1__EU482485__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucugggguguggaagaggcggguggagcuacuauugcgccggacucaagaaaguuacagaggugaagggcuacacgaaaggugggcccggacacgaggagccgauaccaauggcgaccuacggcuggaacuuagucaagcugcauucuggcaaagacguguuuuucaucccucccgaaaagugugauacucuucugugcgacauuggggaguccucaccaaaucccacaaucgaggaaggaaggacccuacggguccucaaaaugguggagccuuggcugcgcgguaaccaauuuuguauuaagaucuugaauccguauaugcccagcguuguagaaacucuggagcagaugcagagaaagcacggcgggaugcucgugaggaacccacuuucgcgaaauucuacacaugagauguacugggucaguugcggaaccggcaacauuguguccgcuguuaauaugacgagccggaugcuguuaaaccguuucaccauggcacacagaaaaccuacauaugaacgcgauguggaccugggugccgggacuaggcacgucgcuguggagcccgaaguagccaacuuggauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucuguaccagagaagaguucacaaggaaagugcgcucuaaugcugccauuggggcagucuuuguggacgaaaaccaguggaacucagccaaggaggcuguugaggaugaacguuucugggaccuggugcaucgggagagagaacuccacaaacagggaaagugcgccacgugcgucuacaacaugaugggcaaaagggagaagaagcugggugaauuugggaaagcgaagggaagucgcgcaaucugguacaugugguugggcgcccgauuccuggaguucgaggcucucggcuuuaugaaugaagaucacugguucucccgggagaacagccuuucugggguggaaggagagggucugcauaaauuaggcuauauucugagagacaucucgaauauaccugggggaaacauguacgccgaugacaccgcaggcugggauacuaggaucacagaggacgauuugcagaaugaagcucgcauuaccgacaucauggagccagaacacgcccuccuggcuaagucaauuuuuaaacuaacuuaucaaaacaagguaguuagagugcagcggcccaccaaaaaugguaccgucauggaugugaucagcaggcgugaccagcgaggguccggacaggugggcacauacggccuuaacacuuucaccaacauggaggcccaacugauacgccagauggaaagugaggggauauuuucuccuagcgagcucgaaacgccaaaucuggcagagagagucuuggauugguuagaaaaguauggaguugagcggcugaagaggauggcgaucuccggugacgacugugugguaaaacccguggaugaccgcuucgccaccgcucucacagcccuuaacgauaugggcaaggucagaaaagacaucccgcagugggaaccuucaaagggguggaaugauuggcagcaagugcccuuuugcagucaucacuuccaccagcugauuaugaaagacggacgggagauaguugugccauguaggaaccaggaugagcuagucggccgagcacgugugucucagggugcuggguggagccugagagaaacugccugccucggaaaguccuacgcacaaauguggcaguugauguauuuucaucgccgggaccugaggcuugccgcgaaugcuaucuguucagccguaccuguugauuggauucccaccagcagaacaacuuggucuauccacgcacaucaccaguggaugaccacggaggacaugcuguccguguggaaccgcgucuggauugaagagaauccauggauggaagauaagacacauaucaguagcuggggcgacgugcccuaccucggcaaacgggaggaccaauggugcgggucguuaauaggacugaccgccagggcuacuugggccacaaacauccagguugcaauuaaucaggugcgaagauugaucgguaacgagaauuaccuggauuauaugaccuccaugaagcgguucaaaaacgaaucugacccugagggcgcucucugguga

SEQ ID NO: 14028 - RNA, 9879 nt, Artificial Sequence
  derived and/or modified CDS sequence (opt3) from DENV-1__EU482486__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagacaucagccgguguuaacaugugcacacugauugccauggaccucggcgaacugugugaagauacuaugaccuacaaaugcccacggauaacagaaguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggacuguucaaacuugagaaggaaguggccgagacucagcacgguaccguuuuggugcagauaaaauacgagggcacggacgcuccuugcaagaucccauucucgacacaagaugaaaaagggguaacccagaacggacgucugauuacugcgaaucccaucgucacagacaaggagaaaccugugaacauagaagcagagccacccuuuggcgagucuuauauuguuaucggugccggggaaaaggcucucaagcuguccugguucaaaaagggcucaaguaucggaaaaauguuugaggccaccgcacgcggcgccagaaggauggcuauucuuggggauacugccugggacuucggaagcaucgguggcguguuuaccuccgucgggaagcuggugcaucagauuuucggaacagcauacggcguauuguuuucuggugugagcuggacgaugaaaauagggaucggcguucuccugaccugguuaggacuaaauucacggaguacuucccuaagcaugacauguauugcggucggccucgugacccuguaccuuggggugaugguccaggcugauucuggaugcguuaucaacuggaagggccgagaauugaagugugguucagggaucuucgugacaaaugaggugcacacuuggaccgaacaauauaaauuucaggccgacaguccgaagcgccugagcgcagccauuggaaaggcuugggaggagggcguaugcgguauaagauccgccacgaggcucgaaaacaucauguggcggcagauuucuaacgagcugaaucauaucuuacuggaaaacgacaugaaguucacagucgugguuggcgauguggucgggauucuugcacagggcaagaagaugauccgcccucaacccauggagcacaaauacucguggaaaagcuggggcaaggcuaagauaaucggggccgacgugcagaauaccacuuuuauuaucgauggaccaaacaccccugaaugucccgacgaucagagagcguggaauauuugggagguugaggacuauggcuucgguaucuuuacaacuaacauaugguugaagcucagggauuccuacacccaggugugcgaccaccgucugaugucagccgcuauuaaagauaguaaggcaguacaugccgacaugggguauuggaucgaaucugagaaaaaugaaacauggaagcuagcucgggccagcuucauugaggucaagacguguaucuggccaaaaucccacacccuguggucaaacggagugcucgaaagcgagaugauaauccccaagauuuacggcgguccuaucucucaacauaauuaucgaccaggcuacuucacucagacagcagggccguggcaccugggaaaacuugaguuggauuuugaccugugcgaaggcaccacuguggucguugaugagcacugcgggaacagaggacccuccuuaaggacaaccacggugacuggcaagauuauccaugaaugguguugccgcaguuguacccucccuccacugcgguucaaaggugaggacgggugcugguacggaauggagauaagacccguaaaggaaaaggaggaaaaucuugugaaaagcauggucucugcgggcuccggugagguggacucauuuagucugggcuugcucuguauuagcaucaugaucgaagagguuaugaggucgcgcuggucccgaaagaugcugaugacagggacccuagccguguucuuucugcucauuaugggacagcugacuuggaacgaucuuauccggucuugcauuauggucggcgcuaaugccagcgaccguauggggaugggaacaaccuauuuggcacugauggcuacauucaaaaugagaccuauguuugccgugggcuuacucuucaggcgccugacuucacgggagguucuucugcuaaccauaggucucagucugguggcauccgucgaauugccaaacucucuggaggaauuaggggauggacucgccaugggcaucaugauucugaaacuucugacggacuuucaaagcuaccaguugugggcuacacuccugucccuaaccuucaucaaaacuaccuuuucacugcacuaugcguggaagacaauggccaugguacuuagcauugugagucuccugcccuugugucugucuacuaccucccagaagacgacaugguuaccgguucuccugggcagccuugggugcaaaccucugaccauguucuugaucgcagagaauaagauauggggaagaaaaucguggccacucaacgaagguaucauggcugugggcauugucucaauccugcuaucuagucugcuuaagaacgaugugccccucgccgggccucugauugccggaggcauguugaucgcuuguuacguaauauccgguagcucugcagacuuaagccuggagaaagccgcggagguguccugggaagaggaagcugagcauucaggggccagucacaauauucucgucgaaguucaggaugacggaacuaugaagaucaaagaugaggagagggacgauacacugaccauccuucugaaggcaacuuugcuagccgugagcggcguguauccccugucuauuccagcuacacucuuugucugguacuucuggcaaaagaaaaagcagcgauccggcgugcugugggacaccccuucacccccagaaguugagcgcgcaguacuugaugacgggauauaucggaucaugcagagaggauuacuggguaggagucaggugggcgucgggguguuccaagaaaacguuuuucauacgauguggcacgugacucguggagccguccucauguaccagggcaaacgcuuggagccgagcugggcguccgugaagaaagaccugauuucuuacggugggggauggcggcuccagggcucguggaauaccggcgaggaaguacaggucaucgcuguggagccugggaagaaccccaagaauguucaaacagccccaggaaccuucaaaacacccgaaggugaggugggcgcaauugcccuggauuuuaagccugggacuagcggaucaccaaucgucaacagagaaggcaaaauagugggucuuuaugggaauggaguugugaccacguccggcacauacgucagugcuaucgcccaggcaaaggcuucucaggagggcccccugccugagauugaagacgagguguucaggaaacgaaacuugacuaucauggaucuacacccggggagcggaaagacccggcgcuaucugccagccauuguaagagaagcgaucaagaggaaacuccggacauuaauacuggcccccacccgagugguugcauccgagauggcugaagcccuuaaggguaugccuauuagauaccaaacuaccgcugucaaaucagagcauacaggccgcgagaucguggaccugaugugccacgcaacguuuacuaugaggcucuugucuccagugcguguccccaauuauaacaugaucauuauggaugaagcccauuucaccgacccuagcaguaucgccgcucggggguacauauccacaagaguaggaaugggcgaggcggcagccauuuuuaugaccgcuacuccgcccgguagcguggaagccuucccacagucuaaugcaguuauccaggaugaggaaagggacauuccugagcgcucauggaacuccggguaugaguggaucacagauuuucccggaaagaccgugugguucgucccaaguauaaaaagcggcaaugacauugccaacugucugcgaaagaauggcaagagagugauccagcucucgcggaaaacguuugauacugaauaccaaaagaccaagaacaacgacugggacuacguugugaccaccgauaucucugagaugggggcuaauuucagggcggaccgcgucauugauccucguagaugccugaagcccgugauccuuaaagacggaccagaacggguaauucuagccgguccgaugccugugacuguugcauccgcugcccagaggcgcggccgaauagggagaaaccacaauaaggagggagaucaguauaucuacaugggccagccccugaacaaugacgaggaucaugcacacuggacagaagccaagauguuguuagacaacauuaauaccccagaggguaucauccccgcucuguucgaaccugagcgggaaaagagcgccgcgauugauggggaguauaggcuccgcggcgaggcaagaaagacauuugucgagcugaugaggcggggagaccuuccaguguggcugucauacaaaguggccagugagggcuuccaauauucugaucgucgcuggugcuuugacggggaacgaaacaaucagguccucgaggaaaacauggauguugagauauggacuaaggagggagaaaggaaaaaguugaggccccgguggcuggacgcucgcacguacuccgacccucuagcccugagagaguucaaagaauuugcugcagguaggcggagcgugucaggcgaucucauccuugagauugggaagcugccgcagcacuuaacccagcgagcccaaaaugcuuuggacaaccugguaaugcuccauaauagugaacagggaggcagagccuaucgccacgcaauggaggagcugccagauacaaucgaaacucuuaugcugcucgcguugauugccgugcugaccgguggggucacauuauucuuucuaagcggcaggggacugggcaagaccuccaucgggcuccuuugugugauggcuucuagcgcccuguuguggauggcauccguugagccccauuggauagcugccucaaucauucuggaguucuuucucauggugcugcuuaucccugagcccgaccggcagcguacuccacaggauaaccaacucgcauacgucguaauuggacuguuguucaugauccugacgguggccgcuaaugagauggguuuacuagaaaccaccaaaaaggaccugggcauagggcacguugcgguggagaaccaccaucacgccacuaugcucgaugucgaccuucauccugcaucugcuuggacccuguacgccguggccacaaccauuaucacucccaugaugagacacacaauugaaaacacgaccgcaaauaucaguuugacugcuauagccaaccaggcggcuauccugaugggacucgauaaaggcuggccaauuucgaagauggacaucggugucccucugcuugccuuagggugcuauagccaggugaauccgcugacacucaccgcagccguuuugaugcugguggcucauuacgcaauuaucggccccggacuacaagccaaagcgaccagggaggcucagaagcgcacagccgcaggcauaaugaagaacccaacuguagaugggauuguggccaucgaccuggauccugucguuuaugacgcuaaauuugaaaagcagcucggacagaucaugcuucugauuuuguguacgucccaaauccugcucaugcggaccacaugggcccugugcgagucuauaacuuuagcaaccggcccccuuacaacccugugggaggguucaccagggaaauucuggaauacuacgauugcugugagcauggccaacaucuuucgaggauccuaccucgcgggcgccggucuagcauucagucugaugaagucuuugggcgggggaagaaggggcacaggggcucagggagaaacccugggcgagaaauggaagcgccagcucaaucagcuuagcaagucagaguucaacacuuauaaacgguccgguauuauggaggucgacagaagugaagccaaggaggggcugcguaggggagagaccacaaaacacgcagugagccggggcacugcuaaguugcgcugguuuguagaacgaaaucuggugaaaccugaggguaagguuaucgaucucggcugugggagaggaggcuggucuuacuauugcgccggguuaaagaaagugaccgaagucaagggauacacaaaaggcggucccgggcacgaggaaccgauaccaauggccacguacggauggaaccuggugaaacuucauuccggcaaagacgucuucuuuaucccucccgagaagugugauacccugcuaugcgacauuggcgagucaagcccaaaucccacuaucgaagaggggaggacacuccgggugcugaaaaugguugaaccuugguugcgcggaaaccaauucuguauuaagauccugaauccguauaugcccucgguaguggagacccucgagcagaugcagagaaagcacgguggcaugcuugucaggaacccacugucucgaaauaguacucaugaaauguacuggguguccugcgggacaggaaacauuguuagcgcggugaauaugaccucacggauguuacugaaccguuuuacgauggcucacagaaaaccuaccuaugagcgcgaugucgacuugggcgcagguacaaggcacguggccguagaacccgagguggcuaaccucgauaucauagggcagcggauugaaaauaucaagcaugagcacaaauccacuuggcauuacgacgaggauaacccuuauaagaccugggccuaccacggaucuuaugaaguuaaaccaagcggcagugcauccagcauggucaauggcguggugaagcugcuaacaaagcccugggacgucaucccuaugguuacucaaauugccaugaccgauacaaccccauucgggcagcagagaguguuuaaagagaagguagacacucgcacgcccaaagcuaagaggggaacagcgcaaauaauggaagugaccgcccgauggcuuugggguuuccugucucggaacaaaaagccgagaaucuguacuagggaggaauuuacccgcaagguccguucaaaugcagcuauuggcgccguguucguugacgagaaccaguggaauagugcaaaagaggccguggaagaugagcgguuuugggaccucguccauagagaaagggagcugcacaagcaggggaaaugcgcuacaugcguguacaacaugaugggaaagcgcgagaaaaaguugggcgaguucgguaaggccaaagggucccgagcgaucugguacauguggcugggagcacgguuucucgaguucgaagcccuuggcuucaugaaugaggaucacugguuuagcagagaaaacucucugucgggcguagagggggagggauuacauaagcuggguuauauuuugagggacaucucaaaaauaccuggcgggaauauguacgcugaugacacggccggaugggauacccgcaucacugaagacgaucuccagaacgaggcaaagauuacagacaucauggaaccagagcacgcucugcuagccaccagcauuuucaaacuuacuuaucaaaauaagguugugagaguccagcggcccgcuaggaacggcacagugauggaugugaucucccgucgagaccagcgcgguagugggcaggucggaaccuacggccugaauacauuuacuaacauggaagcccaacucauaagacagauggagucugagggcauuuucagcccuuccgaacuggagaccccaaacuuggcagaacggguuuuagauuggcuggagaaacaugggguggaaaggcucaagcgcauggcgaucucaggagacgacuguguagugaagcccaucgaugacagauuugccacggcucuuagugcccugaaugauauggguaaaguccggaaggacauuccgcagugggagccuucuaaaggcuggaacgauuggcagcaagugcccuucugcagccaccacuuucaucagcuaauaaugaaggacgggagggagaucguugugccaugucgaaaucaggaugaacuggucggacgugcaagagugucccagggcgcugguuggucacuccgcgagaccgccugcuuggggaaaagcuaugcacaaauguggcagcugauguacuuccaccggagggaccuuagacuggccgcgaacgcuauuuguucugccguaccuguugauugggugcccacaucccgcacuaccuggaguauccaugcacaccaucaguggaugacaacugaagacaugcucagcgucuggaaucggguguggauugaggaaaacccauggauggaggauaagacccacaucucguccuggggagacguucccuauuuaggcaagagggaggaccaauggugcggcucucugauaggguugacggcccgagcuacaugggccaccaauauccagguggcaauuaaccaggucagacggcugaucggaaaugaaaacuaccucgauuacaugacuucaaugaaaagguuuaagaaugacagcgauccugagggugcucuuugguga

SEQ ID NO: 14029 - RNA, 9879 nt, Artificial Sequence
  derived and/or modified CDS sequence (opt3) from DENV-1__EU482487__SS-prME
uccgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugccaaaaaugagaccuggaagcuggcacgggcgagcuucaucgaaguuaagacuuguauauggccaaaaucccacacacuauggucaaacggagugcuggagagcgaaaugaucauucccaagaucuacggcgguccuauuucucaacauaauuaucgaccaggcuacuucacccagacugccgggccguggcaccucggaaaacuggagcuugauuuugacuugugcgagggcacaaccguagucguggaugaacacugcgggaacagaggacccucccugaggacgacuaccgugacaggcaagaucauacaugagugguguugccgcaguuguaccuuaccuccacuccgguucagaggugaagacgggugcugguacggaauggagauuaggcccgucaaagagaaggaagagaaucugguuaagagcauggugucugcuggcuccggugaaguagacucauuuagucuuggccuguuguguaucagcaucaugauugaggaagugaugcgcucgcgauggucccggaaaaugcucaugacugggacacuggccgucuucuuucuacugaucaugggacagcucaccuggaacgaucugauucgucuuugcauaauggugggcgcaaaugcuucugacagaauggggaugggaacaacuuauuuggcccugauggcaaccuucaagaugaggccuauguuugccguuggcuuacucuuccgccggcugacgagcagagaggugcuucugcuaacaaucggucucucacuggucgcuaguguggaguugccaaacucccuggaagaguuaggggauggacucgcgaugggcauuaugauccugaaacuucugaccgacuuucaaucucaccaguugugggccacucuccugagccuaaccuucauuaagacaacuuuuucccugcauuacgcauggaaaaccauggcuaugguucuuucaaucgugagccucuucccccuguguuugaguacgacaucucagaagaccacuuggcugccggucuuacucggcucccuggggugcaagccucuuacaauguuucugauagccgaaaauaaaaucuggggaaggcgaagcuggccauugaacgaggguauuauggccguaggcaucgugucgauucuccugucaucucuacugaagaacgauguuccccuugcugggccucucaucgcaggaggcaugcugauagccuguuaugugauuagugguuccagcgcggacuugucuuuagaaaaagcugccgaggucagcugggaggaagaggcagaacacuccggggccucacauaauauccugguggagguacaggaugacggaaccaugaagaucaaagaugaggaacgcgacgauacucucacaauucugcuuaaggcuacccuguuggcagugaguggcgucuacccccuaagcauaccagccacgcuguucguuugguauuucuggcagaaaaagaagcagcggucuggcgugcucugggacacuccuucacccccagagguggaaagagcgguccuggaugacgggaucuacaggauuaugcagcguggacuuuuaggucgcagccaggugggcguugggguauuucaagagaacguguuccacaccauguggcacgucacacggggagcugugcugauguaucagggcaaaagacucgaaccgaguugggccagcguuaagaaagacuugaucuccuacggugggggauggaggcugcagggcucuuggaauaccggcgaggaggugcaggucauugcaguggaaccugggaagaaccccaaaaauguacaaacagccccaggaacuuuuaagacccccgagggugaagucggcgcuaucgcccucgauuucaagccugggacgucgggaagcccaauagugaaccgagagggcaaaaucguuggucuguacgggaauggaguggucacaacuucaggcaccuauguguccgcaauugcucaggccaaggcgagucaggaaggcccccuuccugagaucgaggacgaaguuuuucggaaacgcaaccugacaauuauggauuugcauccggggucuggaaagaccagaagguaccuaccagccaucgugcgggaggcaauaaaacgaaagcugagaacucucauuuuagcucccacccgcgucguggccagcgaaauggcugaggcacugaaggguaugccuaucagguaucaaacaacggccguaaaauccgaacacacuggcaaggagaucguggaccuuaugugccaugccaccuucacaaugcgucugcucucaccaguucggguccccaauuacaacaugauuaucauggaugaggcucacuuuaccgacccuucuagcauagcggcaagaggguauauuaguacuagggugggaaugggcgaagccgcugccaucuucaugacagcaaccccgcccgguuccguggaggccuuuccacagagcaaugcugucauucaggaugaggaacgcgacaucccugaacgaucuuggaacucaggguacgaguggauaacggauuuccccggaaaaacuguaugguuugugccauccauuaagaguggcaaugacaucgcgaacuguuugaggaaaaauggcaagcggguuauccagcugagcaggaagacauucgauaccgaguaucagaaaaccaagaacaacgacugggacuacguggucacuacagauauuucggaaaugggggccaauuuccgcgcagaccgugugaucgauccuagacggugccucaaacccguuauucugaaggacggaccagagagggugauacuugcugguccgaugccugucaccguggccucugcagcccagcgccgaggcagaaucgggcggaaccauaauaaagaaggagaucaguacauuuauaugggccagccccuaaacaaugacgaggaucacgcucacuggacagaggccaagaugcuguuggacaacaucaauacuccagaagguaucauucccgcguuauuugagccugaaagggagaaguccgcagccauagauggggaauaccgccugagaggcgaggcuaggaaaacguucguagagcucaugcggcguggagaccugccaguguggcuuagcuauaagguugccucagaaggcuuucaauacagugaucgccgauggugcuucgacggggagagaaacaaucagguccuggaagagaacauggauguggaaaucuggaccaaagagggagagaggaagaaacuccggccccgcugguuggacgcuagaacauauucugacccucuggcacuaagggaauuuaaggaguucgccgcuggucggcgauccgugagcggcgaucugauucucgaaaucgggaaacuuccgcagcaucugacucagagagcccaaaaugcauuagacaacuuggucaugcugcacaauucagagcagggaggccgcgcguacaggcaugccauggaggaacucccagauaccauugagacacugaugcuucuggcucucaucgccguuuugaccgguggggugacucuguuuuucuuaaguggccggggacuaggcaagacgagcauagggcugcucuguguaauggcauccucugugcuucuguggauggcuagcgucgaaccccacuggaucgccgcauccauuaucuuggaguuuuuccugauggugcuccugauuccugaacccgaccgucagagaaccccacaggauaaccaacuugccuauguugugaucggacuccuguuuaugauauugacagucgcugcgaaugagaugggucuguuagagacuaccaagaaagaccuaggcauugggcacgccgcaguagaaaaccaucaccaugcugccaugcuggauguggaccuccacccugccucagcauggacacuuuacgcuguugccaccacuaucauuacacccaugaugaggcauacgaucgagaacaccacugcgaauauaucucugacagcuaucgccaaccaggcagccauuuugaugggacuggauaagggcuggccaaucaguaaaauggacauuggugugccucuccuggcucuugggugcuacucgcaggucaauccguuaacccugaccgcagccgugcucauguuggucgcgcacuaugcuaucauaggccccggacugcaagccaaggcaacacgcgaagcccagaaacggacugcugccggcauuaugaagaacccaacgguggaugggaucguugcaaucgaccuagauccugugguauacgacgcuaaguucgagaaacagcugggacagauuaugcuccuuauccuguguaccagccaaauauugcugaugcgaacaacuugggcccucugcgaauccauuacccuggcgacaggccccuuaaccacucuuugggaggguucuccagggaaguuuuggaauacgacaaucgccgugucaauggcaaacauuuucagaggaagcuaucuggcuggcgccggucucgcauucucccuaaugaaaagucugggcgggggaaggcgcggcaccggggcucagggagagacuuugggcgaaaaguggaaacggcagcugaaucagcucucuaagagcgaguuuaacaccuacaagagaucagguaucauggaagucgaccguuccgaggccaaagaagggcuuaagaggggagagacaacuaaacacgccguuagucggggcaccgcgaagcugcgcugguucguggagcgaaauuuggucaaaccugaagguaaggugauagaucugggcugugggagaggaggcuggagcuauuacugcgcugggcucaagaaaguaacagaggugaagggauauacgaaaggcggucccgggcaugaggagccgaucccaauggcaaccuacggauggaacuuaguuaagcugcacucuggcaaagacguguuuuucauuccucccgaaaagugugauacucuucugugcgacaucggcgaguccucaccaaaucccacaauugaggaagggaggacccuacggguccucaaaaugguggagccuuggcugcgcggaaaccaauuuuguaucaagauuuugaauccguacaugcccagcgucguggaaacucuggagcagaugcagagaaagcaugguggcaugcucguuaggaacccacuuucgcgaaauucuacacacgagauguauuggguaaguugcgggaccggaaacaucguguccgccgucaauaugacgagccggaugcuguuaaaccguuucaccauggcucacagaaaaccuacauacgaacgcgauguggaccugggcgccgguacuaggcauguugcaguggagcccgaagucgccaacuuggauauaauugggcagcggaucgagaauaucaagcacgaacauaaaucaaccuggcacuaugacgaggauaacccuuacaagacaugggcuuaucauggauccuacgaggugaaaccaucuggcagcgcgaguuccaugguaaauggcgugguuaagcuccugacuaagcccugggacgucauuccuauggugacccaaauagccaugacagauaccacuccauuugggcagcagagaguguucaaagaaaaggucgacacgcgcacacccaaagcaaagaggggaaccgcucaaaucauggagguuacugccaaauggcuaugggguuuucuuagccgaaacaagaagccgcggauuuguaccagagaagaguucacaaggaaagugcgcucuaaugcagccaucggcgcuguauuuguggacgaaaaccaguggaacucagccaaggaggcggucgaggaugaacguuucugggaccuggugcaccgggagagagaacuccacaaacaggggaagugcgcaacgugcguuuauaacaugaugggaaaaagggagaagaagcugggcgaauuugguaaagccaaggggagucgcgcuauuugguacaugugguugggagcccgauuccuggaguucgaggcacucggcuuuaugaaugaagaucauugguucucccgggagaacagccuuucuggcguggaaggggagggacugcacaaauuagguuacauccugagagacauaucgaagaucccuggcgggaauauguaugcugaugacaccgccggaugggauacuaggauuacagaggacgauuugcagaacgaagcucgcaucaccgacauuauggagccagaacaugcccuccuggcaaaaucaaucuuuaagcuaacuuaccaaaauaaagucgugagaguacagcggcccgcgaagaacggcacaguuauggaugugauaagcaggcgugaccagcgagguuccgggcaggucggaaccuauggccuuaauacauucacuaacauggaggcccaacugauucgccagauggaaagugagggcaucuuuucuccuagcgagcucgaaaccccaaaccuggcugagagaguguuggauugguuaaagaaauacgggguggaacggcugaagaggauggccaucuccggagacgacugugucguuaaacccauugaugaccgcuucgcaacggcucucaccgcccuuaaugauauggguaaggugagaaaagacauaccgcagugggagccuucaaagggcuggaacgauuggcagcaaguacccuuuugcagucaccacuuccaucagcugaucaugaaggacgggcgggaaauuguggucccauguaggaaucaggaugagcuagugggacgagcacguguuucucagggcgccgguuggagccugagagagacagcgugccucgggaaauccuaugcucaaauguggcaguugauguacuuucaccgccgggaccugaggcuugccgcaaacgccaucuguucagcugugccugucgauuggauucccacuagcagaaccacauggucuauccaugcccaccaucaguggaugacuaccgaagacaugcuguccguguggaaucgcguauggauagaggaaaacccauggauggaggauaagacgcacaucaguagcuggggagacguucccuaucucggcaaacgggaagaccaauggugcggcucguuaauugggcugacagcaagggcuaccugggccacuaauauccagguggcgauuaaccagguccgaagauugaucggaaaugagaacuaccuggauuacaugacauccaugaagcgguucaaaaaugagggugacccugaaggcgcucucugguga

SEQ ID NO: 14030 - RNA, 9879 nt, Artificial Sequence
  derived and/or modified CDS sequence (opt3) from DENV-1__EU482488__SS-prME
agcgugaccaugcugcucaugcuuaugcccacagcacuggcuuuccacuugacuacgagaggaggggaaccucauaugaucgucuccaagcaggaaagagggaaaucuuuacuguuuaagaccucagccgguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuugaggcaaccgccagaggcgcuaggcggauggccauucugggggauacugcaugggacuucggauccaucgguggcguuuuuaccucuguggggaaacuuguccaucagauuuucggaacagcguacggcgugcuguuuagcgguguaucauggacgaugaagauagggaucggcguguugcucaccuggcugggauuaaauagucgauccacuagccugucuaugacauguauugcuguuggccuagucacccucuaccugggggugauggugcaggccgauucaggaugcgucaucaacuggaaaggccgcgaacuuaagugugguagugggaucuucguuacaaaugaggugcacacuuggaccgaacaauauaaguuucaggcagacagcccgaaaagauuguccgccgcuauuggaaaggccugggaggagggcgugugcgguauaaggucugcaacgcggcuggaaaacaucauguggaaacagauuucgaacgagcucaaucauauccuguuagaaaacgacaugaagcugacaguagucgugggcgauguugcugggauucuugcccagggcaagaaaaugauccgcccucaacccauggaguacaaauauagcuggaaguccuggggcaaggcgaaaauaaucggggccgacgugcagaauaccacuuucauuaucgauggaccaaacaccccugaaugucccgacgaucagagagcuuggaauauuugggaggucgaggacuacggcuuugguaucuucacaacuaacauaugguugaagcucagggauucauauacccaggugugcgaccaccgucugaugagugcagccauuaaagauucuaaggcuguucacgccgacaugggguacuggaucgaaagcgagaaaaaugaaacauggaagcuagcacgggcguccuuuauugaggugaagacguguaucuggccaaaaucacauacccuguggagcaacggaguacucgaaucugagaugauaauccccaagauuuauggcgguccuaucucccaacacaauuaccgaccaggcuacuucacucagacagccgggccguggcaucugggaaaacuugaguuggauuucgaccugugcgaaggcaccacugucgugguggaugagcacugcgggaacagaggacccaguuuaaggacaaccacggucacuggcaagauuauccacgaaugguguugccgcagcuguacccucccuccacugcgguuuaaaggugaggacgggugcugguauggaauggagauaagacccguuaaggaaaaggaggaaaaucuugugaaaucuaugguauccgcuggcucaggugagguggacaguuucagccugggcuugcucuguauuucgaucaugaucgaagaggucaugaggucccgcuggucucgaaagaugcugaugacagggacccuagccguguuuuuccugcucauuaugggacagcugacuuggaacgaucuuauccgguugugcauuaugguuggcgcaaaugcuagcgaccguauggggaugggaacaaccuaccuggccuuaauggcaacauuuaaaaugagaccuauguucgccgugggccuccuguuuaggcgccuuacuucacgggagguccugcuacucaccauaggucugaguuugguggcuuccguugaacugccaaacucuuuagaggaacucggggauggacuggcgaugggcaucaugauucuuaagcuguugacggacuuccaaagccaucagcucugggccacacugcuaucccugaccuuuaucagaacuaccuucucacuucacuaugcauggaaaacaauggcuauggugcucagcauugucagucuguuucccuugugucugucuacuaccucccagaagacgacaugguuaccgguacuccugggcagccuugggugcaagccucugaccauguucuugaucgccgagaauaaaauauggggaaggaagucguggccacucaacgaagguaucauggccgugggcauuguuucaauccugcuaucuagucugcuuaaaaacgaugugccccucgcugggccucugauugcaggaggcauguugaucgccuguuacgucauauccgguagcucugcggacuuaagccuggagaaggcugccgagguguccugggaagaggaagcagagcauucaggggccagucacaauauucucguagaagugcaggaugacggaacuaugaaaaucaaggaugaggagcgagacgauacacugaccauccuucugaaagcuacuuugcuagcagucagcggcguuuauccccugucuauuccagccacacucuuugugugguacuucuggcaaaagaagaaacagcgcuccggcgugcugugggacaccccuucacccccagaagucgagcgggcggugcuugaugacgggauauauagaaucaugcagaggggauuacugggucguagucagguuggcguagggguguuccaagaaaacgucuuucauacgauguggcacgugacucgcggagcuguucucauguaccagggcaagcgguuggagccgagcugggccuccgugaaaaaggaccugauuucuuacggugggggauggagacuccagggcucguggaauaccggcgaggaaguccaggugaucgcaguagagccugggaaaaaccccaagaauguccaaacagccccaggaaccuucaagacaagcgaaggugaggugggcgcuauugcccuggauuuuaaacccgggacuucaggauccccuaucguuaacagggaaggcaagauagugggucuuuaugggaauggagucgugaccacgaguggcacauacguuucugcaaucgcucaggccaaagcgagccaggagggcccacugcccgagauugaagacgagguguuccgaaagcggaacuugacuaucauggaucuacacccuggguccggaaaaacccgcagauaucugccggccauugucagggaagcaaucaagcggcgacucagaacauuaauacuggcuccaacccgcgugguagccucagagauggcugaagcacuuaaggguaugcccauuagguaccaaacuaccgccgugaaaucugagcauacaggcaaggagaucguugaccugaugugccacgccacguuuacuaugcgucucuugagcccuguccgggugccaaauuauaacaugaucauuauggaugaagcucauuucaccgaccccaguuccaucgcggcaagaggguacauaagcacaagggugggaaugggcgaggccgcugccauuuuuaugaccgcaacuccuccggguucugucgaagccuucccccagucaaaugcuguaauccaggaugaggaacgcgacauuccagagcgauccuggaacaguggguaugaguggaucacagauuuuccuggaaaaaccgugugguucguucccagcauaaagucgggcaaugacauugcgaacugucugaggaaaaauggcaagcgggugauccagcucucuaggaagacguuugauacugaauaccagaaaacaaagaacaacgacugggacuacgucgugaccaccgauaucuccgagaugggggccaauuuccgcgcagaccguguuauugauccaagacggugccugaaaccugugauccuuaaggacggacccgaaagggucauucuagcugguccaaugccggugacuguagccagcgcagcccagcgccgaggcagaauagggcggaaccacaauaaagagggagaucaguauaucuacaugggccagccucugaacaaugacgaggaucaugcucacuggacagaagccaagauguuguuagacaacauuaauacccccgaggguaucaucccagcgcuguucgaacccgagagggaaaagucagcagccauugauggggaguaucgccucagaggcgaggcuaggaaaacauuuguggaacugaugcggcguggagaccuuccuguuuggcugaguuacaaggucgccucugagggcuuccaauauuccgaucgccgauggugcuuugacggggaaagaaacaaucaggugcucgaggaaaacauggauguggagauauggacuaaagagggagaaaggaagaaauugcggccacgcuggcuggacgcuagaacguacagcgacccccuagcacugagggaguucaaggaauuugccgcuggucggcgaucagucaguggcgaucucauccuugagauugggaaacugccucagcacuuaacccagagagcccaaaaugcauuggacaaccugguuaugcuccauaauagcgaacagggaggccgcgcguauaggcacgccauggaggagcugccggauacaaucgaaacucuuaugcugcucgcuuugauugccgugcugaccggugggguaacauuauucuuucuauccggccggggacugggcaagaccucuaucgggcuccuuugugugauggcaagcuccguccuguuguggauggcuucaguggagccacauuggauagccgcaucuaucauucuggaguucuuucucaugguucugcuuauccccgagccugaccgucagagaacuccccaggauaaccaacucgccuacguggucauuggacuguuguucaugauccugacgguagcugcgaaugagauggguuuacuagaaaccacaaagaaagaccugggcauagggcacguggccguugagaaccaccaucacgcagcuaugcucgauguggaccuucauccagccagugccuggacucuguacgcagucgcuaccacaauuaucaccccuaugaugaggcacacuauugaaaacacaacggccaauaucucguugaccgcgauagcuaaccaggccgcaauccugaugggacucgauaagggcuggcccauuagcaaaauggacaucggugugccacugcuugccuuagggugcuauucccaggucaauccucugacucucacagcugcaguguugaugcugguugcccauuacgcgauuaucggcccgggacuacaagcuaaggccacccgcgaggcacagaaacggaccgccgcuggcauaaugaagaaccccacaguggaugggauuguagccaucgaccuggauccaguggucuaugacgcaaaguuugaaaaacagcucggacagaucaugcuucugauuuuguguacuucucaaauccugcucaugcgaacgaccugggcucugugcgagucaauaacauuagccacuggcccucuuaccacacugugggaggguagccccgggaaguucuggaauaccacuauugcgguuuccauggccaacaucuuuagaggaaguuaccucgcaggcgcuggucuagccuucucucugaugaagucauugggcgggggaaggcgcggcacgggggcacagggagaaacacugggcgagaaguggaaacggcagcucaaucagcuuagcaaguccgaguucaacaccuauaagagaagugguauuauggagguggaccguagcgaagcuaaagaggggcugaagaggggagagacuaccaaacacgccgucucucggggcacagccaaguugcgcugguuuguggaacgaaaucugguaaaaccagaggguaaggugaucgaucucggcugugggagaggaggcugguccuacuauugcgcgggguuaaagaaaguuacugaagugaagggauacaccaaaggcgguccugggcacgaggaacccauaccgauggcuacauacggauggaaccuggucaaacuucauucaggcaaagacguguucuuuaucccaccugagaagugugauacgcugcuaugcgacauuggcgagagcucgcccaauccaaccaucgaagaggggaggacucuccggguccugaaaaugguggaacccugguugcgcggaaaccaauucuguauuaagauccugaauccuuauaugccgucuguuguagagacacucgagcagaugcagagaaagcacgguggcaugcuugugaggaacccccugagucgaaauuccacccaugaaauguacugggucagcugcgggacuggaaacauugugucagcaguuaauaugacaucccggauguuacugaaccguuuuaccauggcccacagaaaaccaacguaugagcgcgauguggacuugggcgcugguaccaggcacgucgccguggaaccugagguagcaaaccucgauaucauagggcagcggauugaaaauaucaagcaugagcacaaaucuacauggcauuacgacgaggauaaccccuauaagacuugggccuaccacggaagcuaugaagugaaaccuaguggcuccgcuagcucuaugguuaauggcgucgugaagcugcuaaccaagccaugggacgugauccccauggucacacaaauugcgaugacugauaccacaccuuucgggcagcagagaguuuuuaaagagaagguggacacccgcacuccaaaagccaagaggggaacggcacaaauaauggaaguaacagcuaaauggcuuugggguuuccugucacgaaacaagaagccccggaucuguaccagagaggaauuuacuaggaaagugcgcaguaaugccgcaauuggcgccgucuucguggacgagaaccaguggaacuccgcuaaggaggccguugaagaugagcguuuuugggaccucgugcaucgggaaagagagcugcacaaacaggggaagugcgcgaccugcgucuacaacaugaugggaaaaagggaaaagaaguugggcgaguucgguaaagcaaaggggagccgcgccaucugguacauguggcugggagcucgauuucucgaguucgaagcccuuggcuucaugaaugaggaucacugguuuucucgggaaaacucgcugucaggcguggagggggagggauuacauaaacuggguuauauuuugagagacaucagcaagauaccgggcgggaauauguacgcagaugacacagcuggaugggauacgaggaucaccgaagacgaucuccagaacgaggccaaaauuacugacaucauggaaccugagcacgcucugcuagccaaguccauuuucaaacuuacauaucaaaauaagguaguucgcgugcagagaccagcaaagaacggcaccgucauggaugugaucagucggagggaccagcgugguucuggacaggugggaacuuacggccugaauacauuuaccaacauggaagcgcaacucauacgacagauggagagcgagggcauuuucucccccucagaacuggagacaccuaacuuggccgggcgcgucuuagauuggcuggaaaaacauggaguugagagacucaagcggauggcuaucaguggugacgacugugugguaaaaccaaucgaugacagguuugccacugcacuuaccgcucugaaugauaugggcaaggugcgcaaagacauuccccagugggaaccgucuaagggguggaacgauuggcagcaagucccuuucugcagccaccacuuucaucagcuaauaaugaaggacggaagagagaucgugguucccugucggaaucaggaugagcuggugggcagggcccgagucucccagggugcaggguggucacuccgugaaacggccugcuugggaaaaagcuaugcgcaaauguggcagcugauguacuuccacagacgcgaccuucggcuggcugccaacgcaauuuguucugccgugccaguagauuggguuccuaccuccaggacaacuuggaguauccaugcucaccaucaguggaugaccacagaggacaugcucagcguguggaauagagucuggauugaagagaaccccuggauggaagauaagacucacgugucguccugggaggacguuccauauuuaggcaaacgcgaggaccaauggugcggcucucugaucggguugaccgcccgggcaacgugggcuacaaauauacagguggccaucaaccaggucaggcgacugcucggaaaugaaaacuaccuugauuacaugaccucaaugaagagauuuaaaaaugagagcgaccccgaaggugcgcugugguga

SEQ ID NO: 14031 - RNA, 9879 nt, Artificial Sequence
  derived and/or modified CDS sequence (opt3) from DENV-1__EU482489__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacacugauugcucuguuucucgcacaugccaucggcaccucgauuacgcagaagggcaucauauucaucuuacugaugcuuguuacuccaucaauggcuaugcgcugcguggggauuggaagcagagauuuugucgaggguuugaguggcgccacauggguggacguaguucuggagcacggguccugugugaccacuauggcgaaggauaaacccacacuagacaucgaacuccugaagaccgaggucacgaacccugcagugcuuaggaaacugugcauugaagccaagaucucuaauaccacaacugauagccgguguccaacccaaggagaggcuacauugguggaagaacaagacgccaacuucgucugccgccgaacuuuuguugauagaggcugggguaauggguguggacucuucggcaaaggcucccugauaaccugcgcaaaguuuaagugcgugacaaaauuagaggggaagauuguacaguacgaaaaccugaaauauucagugaucgucaccgugcacacuggagaccagcaucaaguugguaaugagaguacggaacacggcacaaccgcuacuauuacaccccaagccccuaccaccgagauccagcucacugacuacggggcgcuuacacuggauuguagcccaaggacgggauuggacuucaacgaaauggugcuacugaccaugaaggagaaaucuuggcucguccauaagcagugguuucuggaucuuccgcugcccuggacuuccggcgccucaacaagccaagagaccuggaaucggcaggacuugcucgugacauucaaaacugcacacgcuaagaagcaggaaguaguugugcuggguagucaagagggggccaugcacaccgcuuuaacgggcgccaccgaaauccagacaucuggaacuaccacaauuuuugcaggccaucugaaaugccgucuaaagauggauaaacucacucugaaggggauguccuaugucauguguaccgguagcuucaaacuugagaaggaauuggccgagacgcagcacggaacagugcugguccagauaaaguacgagggcaccgacgcuccuugcaaaaucccauucucgacucaagaugaaaagggggugacacagaacggacgccucauuaccgcgaaucccaucguuacugacaaagagaagccugugaacauagaagcagagccacccuuuggcgagucuuauauuguaaucggugccggggaaaaagcucugaaacuuuccugguucaagaaaggcucaaguaucggaaagauguuugaggccaccgcaagaggcgccaggcggauggcuauucugggggauacagccugggacuucggaagcaucgguggcgucuuuacguccguggggaaauugguucaucagauuuucggaaccgcauacggcgugcucuuuucuggugucagcuggacuaugaagauagggaucggcgugcuguuaacauggcugggacuaaauucacgaaguaccucccucagcaugacauguauugcgguaggccuggugacucuuuacuuggggguuaugguccaggcugauucuggaugcgugaucaacuggaaaggccgcgaacugaagugugguucagggaucuucgugaccaaugagguccacacguggacagaacaauauaaguuucaggccgacaguccgaaaagacucagcgcagccauuggaaaggcuugggaggagggcguuugcgguauaagguccgccacccggcuggaaaacaucauguggaaacagauuucuaacgaguuaaaucauauccugcuugaaaacgacaugaaguucacuguggugguaggcgaugucgcagggauuuuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggagguugaggacuacggcuucgguaucuuuaccacaaacauauggcucaagcugagggauuccuauacacaggugugcgaccaccgucuaaugucagcugcaauuaaagauaguaaggccguccacgcugacaugggguacuggaucgaaucugagaaaaaugaaaccuggaagcuggcccgggcauccuucauugaggugaagacuuguaucuggccaaaaucccauacacucuggucaaacggaguucuggaaagcgagaugauaauccccaagauuuauggcgguccuaucucucaacacaauuaccgaccaggcuacuucacccagacugcggggccguggcaucuuggaaaauuggagcuggauuuugacuuaugcgaaggcacaaccgugguagucgaugagcacugcgggaacagaggacccucccucaggacgacuaccgugacaggcaagauuauccacgaaugguguugccgcaguuguacccugccuccacuucgguucagaggugaggacgggugcugguauggaauggagauaaggcccgugaaagaaaaggaggaaaaucuggucaagagcaugguuucugccggcuccggugagguggacucauuuaguuugggccuccuguguauuagcaucaugaucgaagagguaaugcgcucgcgauggucccggaaaaugcuaaugacugggacacuggcuguguucuuucuccugauuaugggacagcuuaccuggaacgauuugauccgucugugcauuauggucggcgccaaugcaucugacagaauggggaugggaacaacuuacuuagcucucauggccaccuucaagaugaggccuauguuugcagugggccugcuuuuccgccggcugacgagcagagagguucuacuccugacaauagguuugucacugguggccagugucgaauuaccaaacucccucgaggaacugggggauggacuugcuaugggcaucaugauucugaaauugcucaccgacuuucaaucucaucagcugugggcgacucuacugagccuuaccuucaucaagacaacuuuuucccuccacuaugccuggaaaaccauggcaauggugcugucaauuguuagcuuguucccccuguguuuaaguacgacaucucagaagaccacuuggcucccggugcugcuuggcucccuggggugcaagccuuugacaauguuucucaucgcugagaauaaaauauggggaaggcgaagcuggccacugaacgaagguaucauggccgucggcauuguaucgauccuacugucaucucuucucaagaacgaugugccccuggccgggccuuugauugcuggaggcauguuaaucgcauguuacguuauaagugguuccagcgccgaccugucucucgagaaagcggcugaggugagcugggaagaggaagccgagcauuccggggcaucacacaauauucuggucgaagugcaggaugacggaaccaugaagaucaaagaugaggagcgcgacgauacucuuacaauccuguugaaggccacccuacuggcuguaaguggcguguauccccucagcauuccagcaacgcuguucgucugguacuucuggcagaaaaagaagcagcggucuggcguucuuugggacacuccuucacccccagaaguggagagagccguguuagaugacgggauauauaggaucaugcagcguggacugcucggucgcagccaggucggcguggggguuuuucaagaaaacguauuccauaccauguggcacgugacacggggagcggucuugauguaccagggcaaaagacuggagccgaguugggcuagcgugaagaaagaccucauuuccuacggugggggauggaggcugcagggcucuuggaauaccggcgaggaaguucaggugaucgccgucgagccugggaagaaccccaaaaaugugcaaacagcaccaggaacuuuuaagacccccgaaggugagguaggcgccauugcucuugauuucaagccugggacgucgggaagcccaaucgucaaccgagaaggcaaaauagugggucuguaugggaauggaguugugacaacuucaggcaccuacgucuccgccaucgcacaggcuaaggccagucaggagggccccuugccugagauugaagacgagguguuucggaaacgcaaccuaacaaucauggaucugcacccggggucuggaaagaccagaagguaucucccagcgauuguucgggaagccaucaaacgaaaguuaagaacucugauacuugcacccacccgcguggucgcuagcgagauggccgaagcucugaaggguaugccuauuagguaccaaacaacggcagugaaauccgagcauacuggcaaggagaucguagaccucaugugccacgccaccuucacaaugcguuugcugucaccagugcggguucccaauuauaacaugaucauuauggaugaagcccauuuuaccgacccuucuagcaucgcugcgagaggguacauaaguacuagggucggaaugggcgaggcagccgcuauuuucaugacagccaccccgcccgguuccguggaagcauuuccacagagcaaugccgugauccaggaugaggaacgcgacauuccugagcgaucuuggaacucaggguaugaguggaucacggauuuccccggaaaaacugucugguuuguaccauccauaaagaguggcaaugacauugcuaacugucucaggaaaaauggcaagcgggugauccagcugagcaggaagacauucgauaccgaauaccagaaaaccaagaacaacgacugggacuacguugugacuacagauaucucggagaugggggcgaauuuccgcgccgaccgugucauugauccuagacggugccuuaaacccgugauccuaaaggacggaccagaaaggguuauucuggcagguccgaugccugugaccgucgcuucugccgcacagcgccgaggcagaauagggcggaaccacaauaaagagggagaucaguauaucuacaugggccagcccuugaacaaugacgaggaucaugcccacuggacagaagcuaagauguuacuggacaacauuaauacuccagaggguaucauccccgcccucuuugaaccugagagggaaaaguccgcggcaauugauggggaguaucgccugagaggcgaggccaggaaaacguucguggaacuuaugcggcguggagaccugccaguauggcucagcuacaagguggcuucagagggcuuucaauauagugaucgccgauggugcuucgacggggaaagaaacaaucagguuuuggaggaaaacauggaugucgagauauggaccaaagagggagaaaggaagaaacugcggccccgcuggcuagacgccagaacauacucugacccucuggcucucagggaguuuaaggaguucgcagccggucggcgauccgugagcggcgaucuuauccuggagauugggaaauuaccgcagcacuugacucagagagcucaaaaugcccuggacaaccucgugaugcugcauaauucagaacagggaggccgcgcauauaggcacgcgauggaggagcuuccagauaccaucgaaacacugaugcucuuggcccugauugcugucuuaaccggugggguuacucuauuuuuccugaguggccggggacucggcaagacgagcaucgggcuucugugugugauggccuccucuguauugcuguggauggcaagcguggagccccauuggauagcugccuccaucauucucgaauuuuuccugaugguccuucucaucccugagcccgaccgucagagaaccccacaggauaaccaacuggcauacgugguuauuggauugcuguuuaugaucuuaacaguggccgcuaaugagaugggucuacuggaaacuaccaagaaagaccucggcauagggcacgucgcgguagagaaccaccaucacgccgcaaugcuugauguggaccugcauccugcuucagccuggacauuguacgccguugcaaccacuauuaucacacccaugaugaggcacacgauugaaaacaccacugcuaauaucucucugacagccauagcgaaccaggcugccauccucaugggacuggauaagggcuggccaauuaguaaaauggacaucggugugccucuuuuagcacuggggugcuauucgcaggucaauccgcucaccuugaccgccgcugugcugaugcuagucgcacauuacgccauuaucggccccggacugcaagcgaaggcuacacgcgaggcccagaaacggacugcagccggcauaaugaagaacccaacgguggaugggauuguugcuaucgaccucgauccugugguauaugacgccaaguucgaaaaacagcuuggacagaucaugcuguugauucuguguaccagccaaauccuccugaugcgaacaacuugggcauuaugcgaguccauaacccuugcuacaggcccccugaccacucucugggaggguucuccagggaaguuuuggaauacgacaauugccgugucaauggcgaacaucuucagaggaagcuaccuagccggcgcaggucuggcuuucuccuugaugaaaagucugggcgggggaaggcgcggcaccggggcccagggagaaacucucggcgagaaguggaaacggcagcuuaaucagcugucuaagagcgaauuuaacaccuauaagagaucagguauuauggaggucgaccguuccgaagcaaaagagggguugaagaggggagagacaacuaaacacgcuguuagucggggcaccgccaagcugcgcugguucguggaacgaaaucucgucaaaccugaggguaaggugaucgauuuaggcugugggagaggaggcuggagcuacuauugcgccgggcugaagaaaguaacagaagugaagggauacacgaaaggcggucccgggcacgaggaaccgauaccaauggcgaccuacggauggaaccuuguuaagcugcauucuggcaaagacguguuuuucaucccucccgagaagugugauacucuacucugcgacauuggcgaguccucaccaaaucccacaaucgaagaggggaggacccugcgggucuugaaaaugguggaaccuuggcugcgcggaaaccaauuuuguauuaagauccucaauccguauaugcccagcgucguggagacucuugagcagaugcagagaaagcacgguggcaugcugguuaggaacccauuaucgcgaaauucuacacaugaaauguacuggguaaguugcgggaccggaaacauuguguccgcugucaauaugacgagccggaugcuguugaaccguuucaccauggcacacagaaaaccuacauaugagcgcgauguggaccucggcgccgguacuaggcacguugcuguggaacccgaggucgccaaccuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguaaauggcgugguuaagcuacuuacuaagcccugggacgucaucccuauggugacccaaauugcuaugacagauaccacuccauuugggcagcagagaguguucaaagagaaggucgacacgcgcacacccaaagcgaagaggggaaccgcccaaauaauggaaguuacugcaaaauggcugugggguuuucucagccgaaacaagaagccgcggaucuguaccagagaggaguucacaaggaaagugcgcucuaaugcugccauuggcgcaguauuuguggacgagaaccaguggaacucagccaaggaggcugucgaagaugagcguuucugggaccuggugcaucgggaaagagaguugcacaaacaggggaagugcgccacgugcguuuacaacaugaugggaaaaagggaaaagaagcugggcgaguuugguaaagcgaaggggagucgcgcaaucugguacauguggcucggagcccgauuccuugaguucgaagcucugggcuuuaugaaugaggaucacugguucucccgggaaaacagcuuaucuggcguggagggggagggacugcauaaauuggguuauauucucagagacaucucgaagauaccuggcgggaauauguacgccgaugacaccgcaggaugggauacuaggaucacagaagacgaucugcagaacgaggcucgcauuaccgacaucauggaaccagagcacgcccuacuugcuaaaucaauuuuuaagcugacuuaucaaaauaaagucgugagaguacagcggcccgccaagaacggcacaguuauggaugugaucagcaggcgugaccagcgagguuccgggcaggucggaaccuacggccucaauacauucacuaacauggaagcacaacugauacgccagauggagagugagggcauauuuucuccuagcgaauuggagaccccaaacuuagcggaaagagugcuggauuggcucgagaaguaugggguggaacggcuuaaaaggauggccaucuccggagacgacugugucguuaagcccaucgaugaccgcuucgcuacggcccugaccgcacuaaaugauauggguaaagugagaaaggacauuccgcagugggagccuucaaaaggcuggaacgauuggcagcaaguacccuuuugcagucaucacuuccaccagcugauaaugaaggacgggcgggagaucguggucccauguaggaaucaggaugaacucgugggacgagcucguguuucucagggcgccgguuggagcuugagagagacagcaugccuggggaaguccuacgcccaaauguggcagcuuauguauuuucaucgccgggaccugaggcucgcggcuaacgccauuuguucagcagugccugucgauuggauccccacuagcagaaccacauggucuauucacgcccaucaccaguggaugacuaccgaagacauguuauccguguggaaucgcguauggaucgaggaaaacccauggauggaggauaaaacgcauauaaguagcuggggagacguucccuaccugggcaagcgggaggaccaauggugcggcucguugaucgggcugacagcuagggccaccugggcaacuaauauucagguggcuaucaaccagguccgaagacucauuggaaaugaaaacuaccuugauuauaugacauccaugaaacgguucaagaaugagucugacccugaaggugcccugugguga

SEQ ID NO: 14032 - RNA, 9879 nt, Artificial Sequence
  derived and/or modified CDS sequence (opt3) from DENV-1__EU482490__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaccaucggugccggggaaaaagcucugaagcucuccugguucaagaaaggcucaaguaucggaaagauguuugaggccacagcaagaggcgccaggcggauggcuauucugggggauacggccugggacuucggaagcaucgguggcguguuuaccuccguugggaaacuugugcaucagauuuucggaacugcauacggcguccuguuuucuggugugagcuggacaaugaagauagggaucggcguauugcucaccuggcugggauuaaauucacgaaguacaucccugagcaugacuuguauugcggugggccuaguuacccucuaccugggggucauggugcaggcugauucuggaugcgugaucaacuggaaaggccgcgaacuuaagugugguucagggaucuucgucacgaaugagguucacacauggaccgaacaauauaaguuucaggccgacaguccgaaaagauugagcgcagccauuggaaaggcuugggaggagggcgugugcgguauaagguccgccacucggcuggaaaacaucauguggaaacagauuucuaacgagcucaaucauauccuguuagaaaacgacaugaaguucaccgugguagucggcgauguggcagggauucuggcucagggcaaaaagaugauccgcccucaacccauggaguacaaauauucguggaaaagcuggggcaaggccaagauaaucggggcggacguucagaauacaacuuuuauuaucgauggaccaaacaccccugaaugucccgacgaucagagagccuggaauauuugggagguggaggacuacggcuucgguaucuuuacaacgaacauauggcuuaaguugagggauuccuauacccaggucugcgaccaccgucucaugucagcugcaauuaaagauaguaaggccgugcacgcugacaugggguacuggaucgaaucugagaaaaaugaaacuuggaagcuggcccgggccuccuucauugagguuaagacauguaucuggccaaaaucccauacccuauggucaaacggagugcuggaaagcgagaugauaauccccaagauuuauggcgguccuaucucucaacacaauuaccgaccaggcuacuucacucagacagcggggccguggcaucucggaaaacuggagcuugauuuugacuugugcgaaggcaccacgguagucguggaugagcacugcgggaacagaggacccucccugaggacuaccacagugaccggcaagauuauccacgaaugguguugccgcaguuguacuuuaccuccacuccgguucagaggugaggacgggugcugguauggaauggagauaaggcccgucaaagaaaaggaggaaaaucugguuaagagcauggugucugccggcuccggugagguagacucauuuagucuuggccuguuguguauuagcaucaugaucgaagaggugaugcgcucgcgauggucccggaaaaugcucaugacagggacccuggcugucuucuuucuacugauuaugggacagcucacauggaacgaucugauccgucuuugcauuauggugggcgccaaugcaucugacagaauggggaugggaacuaccuacuuggcucugauggccacguucaagaugaggccuauguuugcaguuggcuuacucuuccgccggcugacaagcagagaggugcuucugcuaaccauaggucucucacuggucgccaguguggaauugccaaacucccuggaggaauuaggggauggacucgcuaugggcaucaugauucugaaacuucugacugacuuucaaucucaucaguugugggcgacccuccugagccuaacauucaucaagacuaccuuuucccugcacuaugccuggaaaacgauggcaaugguucuuucaauugugagccucuucccccuguguuugaguacaaccucucagaagacuacauggcugccggucuuacucggcucccuggggugcaagccucuuaccauguuucugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaacuaugaagaucaaagaugaggagcgcgacgauacacucaccauccugcuuaaggccacgcuguuggcugugaguggcgucuauccccuaagcauuccagcaacucuguucguuugguacuucuggcagaaaaagaagcagcggucuggcgugcucugggacaccccuucacccccagaaguggagagagccguccuggaugacgggauauauaggaucaugcagcguggacuuuuaggucgcagccaggugggcguugggguauuucaagaaaacguguuccauacaauguggcacgucacccggggagcggugcugauguaccagggcaaaagacucgagccgaguugggcuagcguuaagaaagacuugauuuccuacggugggggauggaggcugcagggcucuuggaauacaggcgaggaagugcaggucaucgccguggagccugggaagaaccccaaaaauguacaaacugcaccaggaaccuuuaagacgcccgaaggugaggucggcgccauugcucucgauuucaagccugggacaucgggaagcccaaucgugaaccgagaaggcaaaauaguuggucuguaugggaauggaguggucacuaccucaggcacauacguguccgccaucgcacaggcuaaggccagucaggagggcccccuuccugagauugaagacgagguuuuucggaaacgcaaccugaccaucauggauuugcacccggggucuggaaagacuagaagguaucuaccagcgauugugcgggaagccaucaaacgaaagcugagaacccucauauuagcacccacacgcgucguggcuagcgagauggccgaagcucugaaggguaugccuauuagguaccaaacgacugcaguaaaauccgagcauaccggcaaggagaucguggaccuuaugugccacgccacauucaccaugcgucugcucucaccaguucggguccccaauuauaacaugaucauuauggaugaagcccauuuuacugacccuucuagcaucgcugcgagaggguacauaaguacaagggugggaaugggcgaggcagccgcuauuuucaugaccgccacgccgcccgguuccguggaagcauuuccacagagcaaugccgucauccaggaugaggaacgcgacauuccugagcgaucuuggaacucaggguaugaguggaucacugauuuccccggaaaaacaguaugguuugugccauccauaaagaguggcaaugacauugcuaacuguuugaggaaaaauggcaagcggguuauccagcugagcaggaagaccuucgauaccgaauaccagaaaacuaagaacaacgacugggacuacguggucacaaccgauaucucggagaugggggcgaauuuccgcgccgaccgugugauugauccuagacggugccucaaacccguuauccugaaggacggaccagaaagggugauucuugcagguccgaugccugucacaguggcuucugccgcacagcgccgaggcagaauagggcggaaccacaauaaagagggagaucaguauaucuacaugggccagccccuaaacaaugacgaggaucaugcccacuggacugaagcuaagaugcuguuggacaacauuaauacgccagaggguaucauccccgccuuauuugaaccugagagggaaaaguccgcggcaauugauggggaguaucgccugagaggcgaggccaggaaaaccuucguagaacucaugcggcguggagaccugccaguguggcuuagcuacaagguugcuucagagggcuuucaauauagugaucgccgauggugcuucgacggggaaagaaacaaucagguccuggaggaaaacauggauguggagauauggacaaaagagggagaaaggaagaaacuccggccccgcugguuggacgccagaacuuacucugacccucuggcucuaagggaguuuaaggaguucgcagccggucggcgauccgugagcggcgaucugauccucgagauugggaaacuuccgcagcaccugacccagagagcucaaaaugccuuagacaacuuggucaugcugcauaauucagaacagggaggccgcgcauauaggcacgcgauggaggagcucccagauacaaucgaaacccugaugcuucuggcccucauugcuguuuugacugguggggugacgcuguuuuucuuaaguggccggggacuaggcaagaccagcaucgggcugcucuguguaauggccuccucugugcuucuguggauggcaagcgucgagccccauuggauagcugccuccaucauuuuggaauuuuuccugauggugcuccugaucccugagcccgaccgucagagaacaccacaggauaaccaacuugcauacguugugauuggacuccuguuuaugaucuugacugucgccgcuaaugagaugggucuguuagaaaccacaaagaaagaccuaggcauagggcacguagcgguggagaaccaccaucacgccgcaaugcuggauguugaccuccauccugcuucagccuggacccuuuacgccguggcaacuacaauuaucacgcccaugaugaggcacaccauugaaaacacuacagcuaauaucucucugaccgccauagcgaaccaggcugccaucuugaugggacuggauaagggcuggccaauuaguaaaauggacaucggugucccucuccuggcacuugggugcuauagccaggugaauccguuaacccugacagccgcuguccucauguugguggcacauuacgccauuaucggccccggacugcaagcgaaggcuacucgcgaggcccagaaacggacggcagccggcauaaugaagaacccaaccguugaugggauuguggcuaucgaccuagauccuguaguguaugacgccaaguucgaaaaacagcugggacagaucaugcuccuuauucuguguacaagccaaaucuugcugaugcgaacuaccugggcacucugcgaguccauaacacuggcuaccggccccuuaacuacgcuuugggaggguucuccagggaaguuuuggaauacaaccauugccgucucaauggcgaacaucuucagaggaagcuaccuggccggcgcaggucucgcuuucucccuaaugaaaagucugggcgggggaaggcgcggcacuggggcccagggagaaaccuugggcgagaaguggaaacggcagcugaaucagcucucuaagagcgaauuuaacacauauaagagaucagguauuauggagguugaccguuccgaagcaaaagaggggcuuaagaggggagagacuaccaaacacgcugugagucggggcacagccaagcugcgcugguucgucgaacgaaauuuggugaaaccugaggguaagguaaucgaucugggcugugggagaggaggcuggagcuacuauugcgccgggcucaagaaagugacggaaguuaagggauacaccaaaggcggucccgggcacgaggaaccgauaccaauggcgacuuacggauggaacuuagugaagcugcauucuggcaaagacgucuuuuucaucccucccgagaagugugauacacuucugugcgacauuggcgaguccucaccaaaucccaccaucgaagaggggaggacucuacgggugcucaaaauggucgaaccuuggcugcgcggaaaccaauuuuguauuaagaucuugaauccguauaugcccagcgugguugagacacuggagcagaugcagagaaagcacgguggcaugcucguaaggaacccacuuucgcgaaauucuacccaugaaauguacugggugaguugcgggacgggaaacauugucuccgcugugaauaugaccagccggaugcuguuaaaccguuucacaauggcacacagaaaaccuacuuaugagcgcgauguugaccugggcgccgguaccaggcacguggcugucgaacccgagguggccaacuuggauaucauagggcagcggauugaaaauaucaagcaugagcacaaaucaacauggcauuacgacgaggauaacccuuauaagacuugggcauaccacggauccuaugaaguaaaaccaucuggcagcgccaguuccauggugaauggcguugucaagcuccugaccaagcccugggacgugaucccuauggugacacaaauugcuaugaccgauacuacgccauuugggcagcagagagucuucaaagagaagguugacacacgcacccccaaagcgaagaggggaacugcccaaauaauggaagugaccgcaaaauggcuaugggguuuucuuagccgaaacaagaagccgcggaucuguacaagagaggaguucacgaggaaaguacgcucuaaugcugccauuggcgcaguguuugucgacgagaaccaguggaacucagccaaggaggcuguggaagaugagcguuucugggaccugguucaucgggaaagagagcuccacaaacaggggaagugcgcaaccugcguguacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcgucgagggggagggacugcauaaauuagguuauauucugagagacaucucgaagauaccuggcgggaauauguacgccgaugacacugcaggaugggauacaaggaucaccgaagacgauuugcagaacgaggcucgcauuacugacaucauggaaccagagcacgcccuccuggcuaaaucaauuuuuaagcuaacauaucaaaauaaagugguaagaguucagcggcccgccaagaacggcaccgugauggaugucaucagcaggcgugaccagcgagguuccggacaggugggaacauacggccuuaauacuuucaccaacauggaagcacaacugauacgccagauggagagugagggcauauuuucuccuagcgaacucgagacgccaaaccuggcggaaagaguguuggauugguuagagaaguauggggucgaacggcugaaaaggauggccaucuccggagacgacuguguugugaagcccaucgaugaccgcuucgcuaccgcccucacagcacuuaaugauauggguaaaguaagaaaggacauuccgcagugggagccuucaaaaggcuggaacgauuggcagcaagugcccuuuugcagucaucacuuccaccagcugauaaugaaggacgggcgggagaucgucgugccauguaggaaucaggaugagcuaguuggacgagcucgugugucucagggcgccgguuggagccugagagagacugcaugccucgggaaguccuacgcccaaauguggcaguugauguauuuucaucgccgggaccugaggcuugcggcuaacgccauuuguucagcagucccuguggauuggauccccaccagcagaacaacuuggucuauucacgcccaucaccaguggaugaccacggaagacaugcuguccguauggaaucgcguuuggaucgaggaaaacccauggauggaggauaaaacacauauaaguagcuggggagacgugcccuaccucggcaagcgggaggaccaauggugcggcucguuaaucgggcugaccgcuagggccacuugggcaacaaauauucaggucgcuaucaaccaggugcgaagauugauuggaaaugaaaacuaccuggauuauaugaccuccaugaaacgguucaagaaugagucugacccugaaggugcccucugguga

SEQ ID NO: 14033 - RNA, 9879 nt, Artificial Sequence
  derived and/or modified CDS sequence (opt3) from DENV-1__EU482491__SS-prME
agcgugaccaugcugcucaugcuuaugcccacugcacuggcuuuccacuugacuacgcggggaggggaaccucauaugaucgucuccaagcaggaaagggggaaaucuuuacuguuuaagaccucagccgguguuaauaugugcacccugauugccauggaccucggcgaguucugugaagauacuaugaccuacaaaugcccacggauuacagaagcggaaccggacgauguggacuguuggugcaaugcuaccgauacuuggguaacauaugggaccuguacgcaaaucggagaacaccgccgagacaagcguaguguggcccuggcaccccaugucggccuuggucuggagacuagaaccgaaacauggaugagcuccgagggggccuggaaacagauucagaggguggaaacuugggcuuugcggcacccuggauuuaccguuaucgcacucuuccuggcccaugcuauuggcacaucuaucacccagaagggcauaaucuuuauucugcucauguuagccacgccaucgauggcgaugcgcugcguggggaucggaucaagagauuucgucgagggucugagcggcgcaacuuggguggacguaguucuugagcacgggaguugugugacaaccauggccaaggauaaacccacuuuggacauugaacugcuaaagacagaggucaccaacccugcugugcucaggaaacugugcaucgaagccaagauauccaauacgaccacagauucucgguguccaacucaaggagaggcaacccuuguggaagaacaggacgcuaacuuugucugccgccgaacauucguugauagaggcugggguaauggguguggacuguuuggcaaaggcagcuugauuacuugcgccaaguucaagugcgugaccaaacucgaggggaagaucguacaguacgaaaaccugaaauauuccgugauugucacagugcacaccggagaccagcaucaaguugguaaugagucaacugaacacggcacgaucgcgacaaucacuccccaagccccuaguaccgagauucaguuaaccgacuacggggcacugacacucgauuguagcccaaggaccggacuugacuuuaacgaaauggugcuguugacuaugaaggagaaaucuuggcuaguccauaagcagugguuccuggaucucccgcugcccuggacauccggcgcuucaacgagccaagagaccuggaaucggcaggaccuucuggugacuuuuaaaacagcccacgcuaagaagcaggaaguaguuguguuggguagucaagagggggccaugcacaccgcacucacaggcgccacugaaauacagaccucuggaacgaccacaaucuucgcuggccaucugaaaugccguuuaaagauggauaaacugacucuacgcgggauguccuaugucauguguaccggcucguucaagcucgagaaagaaguggcggagacacagcacgguacuguccuggugcagauuaaguacgagggcaccgacgcaccuugcaagaucccauuuucgacgcaagaugaaaaagggguuacacagaacggaagacuuauaaccgccaaucccauugugacugacaaggagaaaccuguaaacaucgaagcugagccacccuucggcgagucuuauaucgucauuggugccggggaaaaggcauugaaacuguccugguuuaagaagggcucaaguaucggaaaaauguucgaggccacagcuaggggcgcccggcgaauggcaauucucggggauaccgcgugggacuuuggaagcauagguggcguguucacuuccguugggaagcuggugcaucagaucuuuggaaccgcuuacggcguccuuuucucuggugugagcuggacaaugaaaauugggaucggcguacuguugacguggcucggacuaaauucacgcaguaccuccuuaagcaugacuuguaucgccgugggccugguuacacuauaccucggggucauggugcaggcagauucuggaugcgugauuaacuggaagggcagagaacugaaaugugguucagggauauuugucaccaaugagguucacacauggacugaacaauauaaguuccaggccgacaguccgaagaggcuuagcgcugccaucggaaaagcaugggaggagggcgugugcgguauucgguccgcuacccgcuuggaaaacaucauguggaagcagauuucuaacgagcugaaucauauccuccuggaaaacgacaugaaauuaacggugguagucggcgauguggccgggauacuggcgcagggaaagaaaaugaucagaccucaacccauggaguacaaguauucguggaaaauuuggggcaaggccaagaucauuggggcugacguucagaauacaaccuuuaucauagauggaccaaacacuccugaaugucccgacgaucagagggcauggaauauuugggagguggaggacuacggcuucgguaucuuuaccacaaacauuuggcuuaaauugcgugauagcuauacucaggucugcgaccaccggcucauguccgccgcuaucaaggauucaaaagccgugcacgcagacaugggguacuggauagaaagugagaagaaugaaaccuggaaacuggcgcgagccucuuucaucgagguuaagacauguauuuggccaaagagccauacgcuaugguccaacggagugcuggaaucagagaugaucauucccaaaaucuauggcgguccuauaagccaacacaauuacagaccaggcuacuucacccagacugcugggccguggcaucucggaaagcuggagcuugauuuugacuugugcgaaggcacaaccguagucguggaugagcacugcgggaacaggggacccucucugcgcacuacaaccgugacgggcaaaauuauccacgaaugguguugccgguccuguacuuuaccuccacucagauucaagggugaggacgggugcugguauggaauggagaucaggcccgucaaagaaaaggaggaaaaucugguuaagaguauggugagcgccggcucuggugagguagacuccuuuucacuuggccuguuguguauuaguaucaugauugaagaggugaugcgcagccgauggucgcggaaaaugcucaugaccgggacacuggcagucuucuuucuacugauaaugggacagcucaccuggaacgaucugauccgucuuugcauuauggugggcgcuaaugccuccgacagaauggggaugggaacuacauacuuggcacugauggccaccuucaagaugaggccuauguuugcuguuggcuuacucuuccgccggcugacaucuagagaggugcuucugcuaacuaucggucucagccuggucgcgucaguggaauugccaaacagucuggaggaauuaggggauggacucgccaugggcauuaugauccugaaacuucugaccgacuuucaaucccaucaguugugggcaacgcuccugucucuaacauucauaaggaccacuuuuagccugcacuaugcuuggaagaccauggccaugguucuuuccaucgugucacucuucccccuguguuugagcacaacaagucagaaaaccacguggcugccggucuuacucggcucucuggggugcaagccucuuacaauguuucugauugccgagaauaagaucuggggacgaaaauccuggccauugaacgaagguauuauggcuguaggcaucgugagcauacuccugucgucacuacugaagaacgauguuccccuugcagggccucucauugccggaggcaugcugaucgcguguuacgugaucucugguaguuccgcugacuugagcuuagagaaagccgcagaggucucuugggaagaggaagccgagcauagcggggcuucccacaauauucugguggaaguacaggaugacggaaccaugaagauaaaagaugaggagcgcgacgauacucucacaauccugcuuaaggcaacccuguuggccgugucaggcgucuauccccuaaguauuccagcgacucuguucguuugguacuucuggcagaagaagaagcagcggagcggcgugcucugggacacaccuucucccccagaaguggagagagcuguccuggaugacgggaucuauaggauuaugcagcguggacuuuuaggucgcucccaggugggcguugggguauuucaagaaaacguguuccauaccauguggcacgucacgcggggagccgugcugauguaccagggcaaaagacucgagccgucaugggcaaguguuaagaaagacuugaucagcuacggugggggauggaggcugcagggcuccuggaauacuggcgaggaagugcaggucauagccguggagccugggaagaaccccaaaaauguacaaaccgcuccaggaacauuuaagaccucugaaggugaggucggcgccaucgcacucgauuucaagcccgggacaucgggaagcccuauugugaaccgagaaggcaaaaucguuggucuguaugggaauggaguggucacuaccucaggcacguacguguccgcuauugcccaggcgaaggccagucaggagggcccacuucccgagaucgaagacgagguuuuucggaaacgcaaccugacaauaauggauuugcacccugggucuggaaagacuagaagguaucuaccggcaauugugcgggaagcuaucaaacgaagacugcgcacccucaucuuagccccaacaagggucguggcuagcgagauggcagaagcccugaaggguaugcccauucguuaccaaaccacugccguaaaguccgagcauaccggcaaagagaucguggaccuuaugugccacgcuacauucacgaugcggcugcucucaccuguuagagucccaaauuauaacaugauaauuauggaugaagcgcauuuuacugaccccucuagcaucgcagccaggggguacauuaguacccgcgugggaaugggcgaggcugccgcaaucuucaugacagccaccccuccggguuccguggaggcuuuuccccagagcaaugcggucauacaggaugaggaacgagacauuccagagagaucuuggaacucaggguaugaguggaucacugauuucccuggaaagacaguaugguuugugcccuccaucaaaaguggcaaugacauugccaacuguuugcggaagaauggcaaaaggguuauccagcugagccgcaagaccuucgauacggaauaccaaaagacuaaaaacaacgacugggacuacguggucacaaccgauauuucggagaugggggcaaauuuccgugcugacagagugauagauccacggaggugccucaagccuguuauccugaaagacggacccgaacgcgugauucuugccgguccaaugccggucaccguggcaucugccgcucagcgaagaggccggaucgggaggaaccacaauaaggagggagaucaguauaucuacaugggccagccucuaaacaaugacgaggaucaugcccacuggacugaagcgaaaaugcuguuggacaacauuaauacacccgaggguauaaucccagcauuauuugaacccgagcgcgaaaaguccgccgcuauugauggggaguauagacugaggggcgaggcccggaagaccuucguagaacucaugcgucgcggagaccugccuguguggcuuagcuacaaaguugcuucagagggcuuucaauauagugaucgaagauggugcuucgacggggaaaggaacaaucagguccuggaggaaaacauggauguggagaucuggacaaaggagggagaacggaaaaagcuccgcccaagaugguuggacgcaaggacuuacucugacccccuggcccuacgggaguuuaaagaguucgcugccggucgaagauccgugagcggcgaucugauucucgagaucgggaaacuuccucagcaccugacgcagcgcgcacaaaaugcguuagacaacuuggucaugcugcauaauucagaacagggaggcagggccuaucggcacgcuauggaggagcucccggauaccauagaaacacugaugcuucuggcccucaucgcaguuuugacugguggggugacccuguuuuucuuaaguggccguggacuaggcaaaacaagcauugggcugcucuguguaauggcuuccucugugcuucuguggauggccagcgucgagccacauuggaucgcagccuccauuaucuuggaauuuuuccugauggugcuccugauacccgagccugacagacagaggacaccccaggauaaccaacuugcuuacguugugauuggacuccuguuuaugaucuugacugucgcggccaaugagaugggucuguuagaaacgaccaagaaggaccuaggcauugggcacguagcaguggagaaccaccaucacgcugccaugcuggauguugaccuccauccagccucagcauggacacuuuacgcuguggccacuaccaucauaacaccuaugaugcgccacaccaucgaaaacacuacagcgaauauuucucugacggcuaucgccaaccaggcagccauuuugaugggacuggauaaaggcuggcccaucaguaagauggacauaggugucccacuccuggcucuugggugcuauagccaggugaauccuuuaacccugacugcagccguccucauguugguggcgcauuacgcuauuaucggcccgggacugcaagccaaagcaacacgggaggcccagaagcgaaccgcugccggcaucaugaaaaaccccaccguugaugggauuguggcaaucgaccuagauccaguaguguaugacgcuaaguucgaaaagcagcugggacagauaaugcuccuuauucuguguacaagccaaaucuugcugaugagaacuacgugggcccucugcgaguccauuacccuggcgacaggcccuuuaacuacccuuugggaggguucucccgggaaauuuuggaauacaaccaucgccgucucaauggcaaacauauucaggggaagcuaccuggcuggcgccggucucgcauucucccuaaugaagagucugggcgggggacgccggggcacuggggcucagggagaaacguugggcgagaaauggaagagacagcugaaucagcucucuaaaagcgaauuuaacacauauaagcguucagguaucauggagguugacagguccgaagccaaggaggggcuuaaacggggagagaccacuaagcacgccgugagucgcggcaccgcgaaacugcgaugguucgucgaaagaaauuuggugaagccagaggguaaaguaauugaucugggcugugggaggggaggcuggagcuacuauugcgcugggcucaagaaggugacagaaguuaaaggauacacuaagggcgguccugggcacgaggaacccaucccgauggcaaccuacggauggaacuuagugaaacugcauucuggcaaggacgucuuuuucauuccaccugagaaaugugauacacuucugugcgacaucggcgaguccucacccaauccaacgauugaagaggggcggacccuacgcgugcucaagauggucgaacccuggcugagaggaaaccaauuuuguaucaaaauauugaauccuuauaugccgagcgugguugagacucuggagcagaugcagaggaagcacgguggcaugcucguacgaaacccccuuucgagaaauucuacacaugaaauguacugggugaguugcgggaccggaaacauugucuccgccgugaauaugacuagccguaugcuguuaaacagauucacaauggcucaccgcaagccaaccuaugagagggauguugaccugggcgccgguacgcggcacguggcagucgaaccugagguggccaacuuggauaucaucgggcagagaauugaaaauauaaaacaugagcacaagucaaccuggcauuacgacgaggauaaccccuauaaaacaugggcuuaccacggauccuaugaaguaaagccuucuggcagcgcgaguuccauggugaauggcguugucaaacuccugacuaagccaugggacgugauccccauggugacccaaauugccaugacagauacuaccccuuuugggcagcagcgcgucuucaaggagaaaguugacacaaggaccccaaaggcaaaacgaggaacugcucaaaucauggaagugacggccaaguggcuaugggguuuucuuagccggaacaaaaagcccagaauuuguacaagggaggaguucacccgcaagguacguucuaaugcagccaucggcgcuguguuugucgacgagaaccaguggaacucagccaaagaggcgguggaagaugagcgguucugggaccugguucauagagaaagggagcuccacaagcaggggaaaugcgcaacuugcguguacaacaugaugggaaagcgcgagaaaaagcugggcgaguuugguaaggccaaagggagucgagcuauaugguacaugugguugggagcccgguuccuggaguucgaagcacucggcuuuaugaaugaggaucacugguucuccagagaaaacagccuuucuggcgucgagggggagggacugcauaaguuagguuauauccugagggacauuucgaaaaucccgggcgggaauauguacgcugaugacaccgccggaugggauacacgcauuacggaagacgauuugcagaacgaggcuaagaucaccgacauaauggaaccugagcacgcccuccuggcaaaaucaauuuuuaagcuaacuuaucaaaauaaagugguaagaguucagcggccagcgaagaacggcacagugauggaugucaucagcaggcgugaccagcgagguuccggacaggugggaaccuacggccuuaauacuuucacaaacauggaagcccaacugauccgccagauggagagugagggcauauuuucucccagcgaacucgagaccccuaaccuggcugggagaguguuggauugguuagaaaagcauggagucgagcggcugaaaaggauggccauauccggugacgacuguguugugaagccaaucgaugaccgcuucgcaacagcucucacugcccuuaaugauaugggcaaaguaagaaaggacauuccccagugggaaccgucaaaaggguggaacgauuggcagcaagugccuuuuugcagucaccacuuccaucagcugaucaugaaggacggacgggagauugucgugcccuguaggaaucaggaugagcuaguuggccgagcacgugugucucagggugccggguggagccugagagaaaccgcgugccucggaaaguccuaugcucaaauguggcaguugauguacuuucaccgccgggaccugaggcuugccgcaaacgccaucuguucagcugucccaguggauuggguaccuacgagcagaaccacauggucuauacaugcccaccaucaguggaugacuaccgaggacaugcuguccguuuggaaucgcguguggaucgaagagaaccccuggauggaagauaaaacacacgucaguagcuggggcgacgugccauaucucggcaagcgggaggaccaauggugcgggucguuaauuggacugacugcaagggcuaccugggccacgaauauccagguugcgauuaaccaggugcgaagauugcuggguaaugagaacuaccucgauuacaugacauccaugaaacgguucaagaaugaaucugaccccgagggcgcucuuugguga

SEQ ID NO: 14034 - RNA, 9879 nt, Artificial Sequence
  derived and/or modified CDS sequence (opt3) from DENV-1__EU482493__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauaugguugaagcucagggauuccuacacgcaggucugcgaccaccgucugaugucagcugcaauuaaagauaguaaggccgugcaugcugacaugggguauuggaucgaaucugagaaaaaugaaaccuggaagcuagcccgggcauccuucauugagguuaagacuuguaucuggccaaaaucccacacacuguggucaaacggagugcucgaaagcgagaugauaauccccaagauuuacggcgguccuaucucucaacauaauuaucgaccaggcuacuucacccagacugcggggccguggcaccugggaaaacuugaguuggauuuugaccugugcgaaggcacaaccguagucguggaugagcacugcgggaacagaggacccuccuuaaggacgacuaccgugacaggcaagauuauccaugaaugguguugccgcaguuguacccucccuccacugcgguucagaggugaggacgggugcugguacggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauugugggacagcugaccuggaacgaucuuauccguuugugcauuaugguuggcgccaaugcaucugacagaauggggaugggaacaacuuaucuggcuuuaauggccaccuucaagaugaggccuauguuugcagugggccuccuguuccgccggcuuacgagcagagagguccugcuacucacaauaggucugucauugguggccaguguugaacugccaaacuccuuagaggaacucggggauggacuggcuaugggcaucaugauucuuaaacuguugaccgacuuucaaucucaccagcucugggcgacucugcuaagccugaccuucaucaagacaacuuuuucccuucauuacgccuggaaaaccauggcaauggugcucucagucguaagccuguuccccuugugucugaguacgacaucucagaagaccacuugguuaccggugcuccugggcucccuugggugcaagccucugacaauguuuuugauugcugagaauaaaaucuggggaaggcgaagcuggccacucaacgaagguauaauggccguuggcaucgugucgauucugcuaucaucucugcuuaagaacgaugucccccucgccgggccucugaucgcuggaggcauguugauugcauguuaugugaucagugguuccagcgccgacuuaucucuggagaaagcggcugagguaagcugggaagaggaagccgagcacuccggggcaucacauaauauacucguggaaguccaggaugacggaaccaugaagauuaaagaugaggagcgcgacgauacucugacaauccuucugaaggccaccuugcuagcuguuaguggcguguacccccugagcaucccagcaacacucuucgugugguauuucuggcagaagaagaagcagcggucuggcguccugugggacacuccuucacccccagaaguggagagagccguucuugaugacgggauuuacaggauaaugcagcguggauuacugggucgcagccagguaggcgugggggucuuucaagaaaacguguuccacaccauguggcacguuacacggggagcggugcucauguaucagggcaaaagauuggagccgaguugggcuagcgucaagaaagaccugaucuccuacggugggggauggaggcuccagggcucuuggaauaccggcgaggaagugcagguaauugccgucgagccugggaagaaccccaaaaaugugcaaacagcaccaggaacuuuuaagacccccgaaggugagguuggcgccaucgcucuggauuucaagccugggacgucgggaagcccaauugugaaccgagaaggcaaaaucgucggucuuuacgggaauggagugguuacaacuucaggcaccuauguguccgccauagcacaggcuaaggccagucaggagggcccccugccugagaucgaagacgaggucuuucggaaacgcaacuugacaauuauggaucuacauccggggucuggaaagaccagaagguaccugccagcgaucgugcgggaagccauuaaacgaaagcucagaacuuuaauccuggcacccacccgcguaguggcuagcgagauggccgaagcucuuaaggguaugccuauaagguaucaaacaacggcaguuaaauccgagcacacuggcaaggagauugucgaccugaugugccaugccaccuucacaaugcgucucuugucaccagugcgggugcccaauuacaacaugaucaucauggaugaagcccacuuuaccgacccuucuagcauugcugcgagaggguauaucaguacuagggucggaaugggcgaggcagccgcuauauucaugacagccaccccgcccgguuccguagaagcauuuccacagagcaaugccgugauucaggaugaggaacgcgacaucccugagcgaucuuggaacucaggguacgaguggauuacggauuuccccggaaaaacuguuugguuugugccauccaucaagaguggcaaugacauagcuaacugucugaggaaaaauggcaagcgggucauucagcucagcaggaagacauucgauaccgaauaucagaaaaccaagaacaacgacugggacuacgugguuacuacagauaucucggagaugggggcgaauuuccgcgccgaccgugugaucgauccuagacggugccugaaacccgucauucuuaaggacggaccagaaagggugauccuagcagguccgaugccuguaaccguggcuucugccgcacagcgccgaggcagaauugggcggaaccauaauaaagagggagaucaguacauauauaugggccagccccugaacaaugacgaggaucacgcccacuggacagaagcuaagauguuguuagacaacaucaauacuccagaggguauuauccccgcccuguuugaaccugagagggaaaaguccgcggcaaucgauggggaguaccgccucagaggcgaggccaggaaaacguucguugaacugaugcggcguggagaccuuccagucuggcugagcuauaagguggcuucagagggcuuucaauacagugaucgccgauggugcuucgacggggaaagaaacaaucaggugcucgaggaaaacauggaugucgagauuuggaccaaagagggagaaaggaagaaauugcggccccgcuggcuggacgccagaacauauucugacccucuagcucugagggaguuuaaggaguucgcagccggucggcgauccguuagcggcgaucucauacuugagaucgggaaacugccgcagcauuuaacucagagagcucaaaaugccuuggacaaccuggugaugcuccacaauucagaacagggaggccgcgcauacaggcaugcgauggaggagcugccagauaccauugaaacacuuaugcugcucgccuugaucgcuguacugaccgguggggugacuuuauuuuuccuaaguggccggggacugggcaagacgagcauugggcuccuuugugucauggccuccucugugcuguuguggauggcaagcguugagccccacuggaucgcugccuccauaauccuggaauuuuuccucauggugcugcuuauuccugagcccgaccgucagagaaccccacaggauaaccaacucgcauaugucguaaucggacuguuguuuaugauucugacaguggccgcuaaugagauggguuuacuagaaacuaccaagaaagaccugggcaucgggcacguugcgguggagaaccaucaccaugccgcaaugcucgaugucgaccuucacccugcuucagccuggacacuguacgccguggcaaccacuauaauuacacccaugaugaggcauacgaucgaaaacaccacugcuaauauuucuuugacagccaucgcgaaccaggcugccauacugaugggacucgauaagggcuggccaaucaguaaaauggacauuggugucccucugcuugcauuagggugcuacagccaggugaauccgcugacccucaccgccgcuguuuugaugcugguggcacacuaugccaucauuggccccggacuacaagcgaaggcuacacgcgaggcccagaaacggacugcagccggcaucaugaagaacccaacgguagaugggauaguggcuauugaccuggauccugucguuuacgacgccaaguucgaaaaacagcucggacagaucaugcuucugaucuuguguaccagccaaauucugcucaugcgaacaacuugggcacugugcgaguccaucaccuuagcuacaggcccccuuaccacucugugggaggguucuccagggaaguuuuggaauacgacaauagccgugucaauggcgaacauuuucagaggaagcuaucucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuacaagagaucagguaucauggaggucgaccguuccgaagcaaaagaggggcugaagaggggagagacaacuaaacacgcugugagucggggcaccgccaaguugcgcugguucguagaacgaaaucuggugaaaccugaggguaagguuauugaucucggcugugggagaggaggcuggagcuauuacugcgccggguuaaagaaagugacagaagucaagggauauacgaaaggcggucccgggcaugaggaaccgaucccaauggcgaccuacggauggaaccuggugaaacuucacucuggcaaagacgucuuuuucauaccucccgagaagugugauacucugcuaugcgacaucggcgaguccucaccaaaucccacaauugaagaggggaggacccuccgggugcugaaaaugguugaaccuugguugcgcggaaaccaauuuuguaucaagauucugaauccguacaugcccagcguaguggagacucucgagcagaugcagagaaagcaugguggcaugcuugucaggaacccacugucgcgaaauucuacacacgaaauguauugggugaguugcgggaccggaaacaucguuuccgcugugaauaugacgagccggauguuacugaaccguuucaccauggcacacagaaaaccuacauacgagcgcgaugucgacuugggcgccgguacuaggcauguggcuguagaacccgagguggccaaccucgauauuaucgggcagcggauagaaaauauuaagcacgagcauaaaucaaccuggcacuaugacgaggauaacccuuacaagacaugggcauaucauggauccuacgaaguuaaaccaucuggcagcgccaguuccauggucaauggcguggugaagcugcuaacuaagcccugggacgucaucccuaugguuacccaaaucgcuaugacagauaccacuccauuugggcagcagagaguguucaaagagaagguagacacgcgcacacccaaagcgaagaggggaaccgcccaaauuauggaagugacugcaaaauggcuuugggguuuucugagccgaaacaagaagccgcggauauguaccagagaggaguucacaaggaaaguccgcucuaaugcugccaucggcgcaguguuuguugacgagaaccaguggaacucagccaaggaggcuguggaagaugagcguuucugggaccucguccaccgggaaagagagcugcacaaacaggggaagugcgccacgugcguguauaacaugaugggaaaaagggaaaagaaguugggcgaguuugguaaagcgaaggggagucgcgcaauuugguacauguggcugggagcccgauuccucgaguucgaagcucuuggcuuuaugaaugaggaucauugguucucccgggaaaacagccugucuggcguagagggggagggauuacacaaacuggguuacaucuugagagacauuucgaagaucccuggcgggaauauguaugccgaugacaccgcaggaugggauacuaggauaacagaagacgaucuccagaacgaggcucgcaucaccgacauuauggaaccagagcaugcccugcuagcuaaaucaaucuuuaaacuuacuuaccaaaauaaaguugugagaguccagcggcccgccaagaacggcacagugauggaugugauuagcaggcgugaccagcgagguuccgggcaggucggaaccuauggccugaauacauucacuaacauggaagcacaacucauccgccagauggagagugagggcauauuuucuccuagcgaacuggagaccccaaacuuggcggaaagaguuuuagauuggcuggagaaguacgggguggaacggcucaaaaggauggccauuuccggagacgacuguguagugaagcccaucgaugaccgcuucgcuacggcccuuaccgcacugaaugauauggguaaagucagaaaggacaucccgcagugggagccuucaaaaggcuggaacgauuggcagcaagugcccuuuugcagucaccacuuccaucagcuaauuaugaaggacgggcgggagauaguugugccauguaggaaucaggaugaacuggucggacgagcucgugugucucagggcgccgguuggagccucagagagacagcaugcuuggggaaguccuaugcccaaauguggcagcugauguacuuucaccgccgggaccuuaggcuggcggcuaacgccaucuguucagcaguaccuguugauuggauucccacuagcagaaccacauggucuauccaugcccaccaucaguggaugacuaccgaagacaugcucuccguguggaaucgcgucuggauugaggaaaacccauggauggaggauaaaacgcacaucaguagcuggggagacgugcccuauuuaggcaagcgggaggaccaauggugcggcucgcugauaggguugacagcuagggccaccugggcaacuaauauccagguugcuauuaaccaggugcgaagacugaucggaaaugaaaacuaccucgauuacaugacauccaugaaacgguucaagaaugagucugacccugaaggugcccuuugguga

SEQ ID NO: 14035 - RNA, 9879 nt, Artificial Sequence
  derived and/or modified CDS sequence (opt3) from DENV-1__EU482494__SS-prME
uccgugaccaugcugcucaugcuuaugcccaccgcacuggcuuuccacuugacuacgcggggcggggaaccucauaugaucgucuccaagcaggaaaggggaaagucuuuacuguuuaagaccucagccgguguuaacaugugcacacuaauugccauggaccucggcgaacugugugaagauacuauaaccuacaaaugcccacggaucacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauucagaggguggaaaccugggcccuccggcacccuggauucacaguuaucgcucuguuucuggcacaugccauuggcaccucgaucacgcagaagggcauaaucuucauucucuuaaugcuggcuacuccaucaauggccaugcgcugcguggggaucggaagcagagauuuugucgagggucuuaguggcgcgacauggguggacguaguuuuggagcacggguccugugugaccacuauggcaaaggauaaacccacacuggacauugaacuacucaagaccgaggucacgaacccugccgugcugaggaaacuuugcaucgaagcuaagauaucuaauaccacaacugauagccgguguccaacccaaggagaggccacacugguggaagaacaggacgcaaacuucgucugccgccgaacuuuuguugauagaggcugggguaauggguguggauuguucggcaaaggcucccucauuaccugcgcuaaguuuaagugcgugacaaaacuggaggggaagaucguacaguacgaaaacuuaaaauauucagugauugucaccgugcacacuggagaccagcaucaaguugguaaugagaguacggaacacggcacaaccgccacuaucacaccccaggcgccuacaaccgagauccagcugacugacuacggggcccucacacuugauuguagcccaaggacgggacuggacuucaacgaaaugguguugcuaaccaugaaggagaaaucuuggcugguccauaagcagugguuucucgaucugccgcuucccuggacuuccggcgcaucaacaagccaagagaccuggaaucggcaggaccuguuggugacauucaaaacugcucacgccaagaagcaggaaguaguugugcucgguagucaagagggggcuaugcacaccgcccugacgggcgcaaccgaaauucagacaucuggaacuaccacaauauuugccggccauuuaaaaugccgucugaagauggauaaacuaacucuccgcgggauguccuaugucauguguaccgggucguucaagcuggagaaagaaguggcugagacgcagcacgguacaguccuugugcagaucaaguacgagggcaccgacgcgccuugcaagauuccauucucgacucaagaugaaaaagggguuacacagaacggaagauugaucaccgcaaaucccauagugacugacaaggagaaaccuguaaacauugaagccgagccacccuuuggcgagucuuauaucgucaucggugcuggggaaaaggcccugaaacucuccugguucaagaagggcucaaguauuggaaaaauguuugaggcaaccgccaggggcgcucggcgaauggccauccugggggauacagcaugggacuucggaagcauugguggcguguuuacguccguugggaaacuugugcaucagauauucggaaccgcguacggcguccuguuuucuggugugagcuggacuaugaaaaucgggauuggcguauugcucacauggcugggauuaaauucacgcaguaccucccugagcaugacauguaucgcugugggccuaguuacucucuaccugggggucauggugcaggccgauucuggaugcgugaucaacuggaagggcagagaacuuaaaugugguucagggauuuucgucaccaaugagguucacacguggacagaacaauauaaguuucaggcagacaguccgaagagguugagcgccgcuauaggaaaagccugggaggagggcgugugcgguauccgguccgcaacccgccuggaaaacauuauguggaagcagaucucuaacgagcucaaucauauucuguuagaaaacgacaugaaauucacugugguagucggcgauguggcugggauccuggcccagggaaagaaaaugauaagaccucaacccauggagcacaaguacucguggaaaagcuggggcaaggcgaagaucauuggggccgacguucagaauaccacauuuaucauugauggaccaaacacuccugaaugucccgacgaucagagggcuuggaauaucugggagguggaggacuauggcuucgguauauuuaccacaaacauuuggcuuaaauugcgugauuccuacacgcaggucugcgaccaccggcucaugucagcagccaucaaggauaguaaagcugugcaugccgacaugggguauuggauugaaucugagaagaaugaaaccuggaaacuggcacgagcgagcuucaucgagguuaagacuuguauauggccaaagucccacacacuauggucaaacggagugcuggaaagcgagaugaucauucccaaaaucuacggcgguccuauuucucaacauaauuauagaccaggcuacuucacccagacugccgggccguggcaccucggaaagcuggagcuugauuuugacuugugcgaaggcacaaccguagucguggaugagcacugcgggaacaggggacccucccugcgcacgacuaccgugacaggcaaaaucauacaugaaugguguugccggaguuguaccuuaccuccacucagauucaggggugaggacgggugcugguacggaauggagauucgccccgucaaggaaaaagaggaaaaucugguuaagagcauggugucugcuggcuccggugagguagacucauuuagucuuggccuguuguguaucagcaucaugauugaagaggugaugcgaucgcgguggucccguaagaugcucaugacugggacacuggccgucuucuuucuacugaucaugggacagcucaccuggaacgaucugauuagacuuugcauaauggugggcgcaaaugcuucugacaggauggggaugggaacaacuuauuuggcccugauggcaaccuucaaaaugcgcccuauguuugccguuggcuuacucuuccggagacugacgagcagggaggugcuucugcuaacaaucggucucucacuggucgcuaguguggaauugccaaacucccuggaggaauuaggggauggacucgcgaugggcauuaugauccugaaacuucugaccgacuuucaaucucaccaguugugggccacucuccugagccuaaccuucauuaaaacaacuuuuucccugcauuacgcauggaagaccauggcuaugguucuuucaaucgugagccucuucccccuguguuugaguacgacaucucagaaaaccacuuggcugccggucuuacucggcucccuggggugcaagccucuuacaauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuaugugauuagugguuccagcgcggacuugucuuuagagaaggcugccgaggucagcugggaagaggaagcagagcacuccggggccucacauaauauccugguggaaguacaggaugacggaaccaugaaaaucaaggaugaggagcgggacgauacucucacaauucugcuuaaagcuacccuguuggcagugaguggcgucuacccccuaagcauaccagccacgcuguucguuugguauuucuggcaaaagaaaaagcagagaucuggcgugcucugggacacuccuucacccccagaaguggagagggcgguccuggaugacgggaucuaccguauuaugcagcgcggacuuuuaggucggagccaggugggcguugggguauuucaagaaaacguguuccacaccauguggcacgucacaagaggagcugugcugauguaucagggcaagaggcucgagccgaguugggccagcguuaaaaaggacuugaucuccuacggugggggauggcgacugcagggcucuuggaauaccggcgaggaagugcaggucauugcaguggagccugggaaaaaccccaagaauguacaaacagccccaggaacuuuuaaaacccccgaaggugaggucggcgcuaucgcccucgauuucaagccugggacgucgggaagcccaauagugaaccgggaaggcaagaucguuggucuguacgggaauggaguggucacaacuucaggcaccuauguguccgcaauugcucaggccaaagcgagucaggagggcccccuuccugagaucgaagacgagguuuuucgcaagagaaaccugacaauuauggauuugcauccggggucuggaaaaaccaggcgguaccuaccagccaucgugcgagaagcaauaaagagaaaacugcgcacucucauuuuagcucccaccagggucguggccagcgagauggcugaagcacugaaggguaugccuauccguuaucaaacaacggccguaaaguccgagcacacuggcaaagagaucguggaccuuaugugccaugccaccuucacaaugcggcugcucucaccaguuagaguccccaauuacaacaugauuaucauggaugaagcucacuuuaccgacccuucuagcauagcggcaaggggguauauuaguacucgcgugggaaugggcgaggccgcugccaucuucaugacagcaaccccgcccgguuccguggaagccuuuccacagagcaaugcugucauucaggaugaggaacgagacaucccugagagaucuuggaacucaggguacgaguggauaacggauuuccccggaaagacuguaugguuugugccauccauuaaaaguggcaaugacaucgcgaacuguuugcggaagaauggcaaaaggguuauccagcugagccgcaagacauucgauaccgaauaucaaaagaccaaaaacaacgacugggacuacguggucacuacagauauuucggagaugggggccaauuuccgugcagacagagugaucgauccucggaggugccucaagcccguuauucugaaagacggaccagaacgcgugauacuugcugguccgaugccugucaccguggccucugcagcccagcgaagaggccggaucgggaggaaccauaauaaggagggagaucaguacauuuauaugggccagccccuaaacaaugacgaggaucacgcucacuggacagaagccaaaaugcuguuggacaacaucaauacuccagaggguaucauucccgcguuauuugaaccugagcgcgaaaaguccgcagccauagauggggaguacagacugaggggcgaggcucggaagacguucguagaacucaugcgucgcggagaccugccaguguggcuuagcuauaaaguugccucagagggcuuucaauacagugaucgaagauggugcuucgacggggaaaggaacaaucagguccuggaggaaaacauggauguggagaucuggaccaaggagggagaacggaaaaagcuccgccccagaugguuggacgcuaggacauauucugacccucuggcacuacgggaguuuaaagaguucgccgcuggucgaagauccgugagcggcgaucugauucucgagaucgggaaacuuccgcagcaucugacucagcgcgcccaaaaugcauuagacaacuuggucaugcugcacaauucagaacagggaggcagggcguaccggcaugccauggaggagcucccagauaccauugaaacacugaugcuucuggcucucaucgccguuuugaccgguggggugacucuguuuuucuuaaguggccguggacuaggcaaaacgagcauagggcugcucuguguaauggcauccucugugcuucuguggauggcuagcgucgagccccacuggaucgccgcauccauuaucuuggaauuuuuccugauggugcuccugauuccugagcccgacagacagaggaccccacaggauaaccaacuugccuauguugugaucggacuccuguuuaugauauugacagucgcugcgaaugagaugggucuguuagaaacuaccaagaaggaccuaggcauugggcacguagccguggagaaccaucaccaugcagcuaugcuggauguugaccuccacccugccucagccuggacacuuuacgcaguggcuaccacuaucauuacacccaugaugcgccauacgaucgaaaacaccacugccaauauaucucugacagcgaucgcuaaccaggccgcaauuuugaugggacuggauaaaggcuggccaaucaguaagauggacauuggugucccucuccuggcccuugggugcuacagccaggugaauccguuaacccugaccgcugcaguccucauguugguggcccacuaugcgaucauaggccccggacugcaagcuaaagccacacgggaggcacagaagcgaacugccgcuggcauuaugaaaaacccaacgguugaugggaucguggccaucgaccuagauccuguaguguacgacgcaaaguucgaaaagcagcugggacagauuaugcuccuuauccuguguaccagccaaauauugcugaugagaacaacuugggcucucugcgaguccauuacccuggccacaggccccuuaaccacucuuugggaggguucuccagggaaauuuuggaauacgacaaucgcggucucaauggccaacauuuucaggggaagcuaucuggcaggcgcuggucucgccuucucccuaaugaagagucugggcgggggacgccggggcaccggggcacagggagaaacuuugggcgagaaauggaagagacagcugaaucagcucucuaaaagcgaauuuaacaccuacaagcguucagguaucauggagguugacagguccgaagcuaaggaggggcuuaaacggggagagacaacuaagcacgccgugagucgcggcaccgccaaacugcgaugguucgucgaaagaaauuuggugaagccugaggguaaaguaauagaucugggcugugggaggggaggcuggagcuauuacugcgcggggcucaagaaggugacagaaguuaaaggauauacgaagggcggucccgggcaugaggaaccgaucccaauggcuaccuacggauggaacuuagugaaacugcacucuggcaaggacgucuuuuucauuccucccgagaaaugugauacucuucugugcgacaucggcgaguccucaccaaaucccacaauugaagaggggcggacccuacgcgugcucaagauggucgaaccuuggcugagaggaaaccaauuuuguaucaaaauuuugaauccguacaugcccagcgugguugagacucuggagcagaugcagaggaagcaugguggcaugcucguacgaaacccacuuucgagaaauucuacacacgaaauguauugggugaguugcgggaccggaaacaucgucuccgcagugaauaugacgagccguaugcuguuaaacagauucaccauggcccaccgcaagccuacauacgagagggauguugaccugggcgcugguacucggcauguggccgucgaacccgagguggcaaacuuggauauaauugggcagagaaucgaaaauaucaaacacgagcauaagucaaccuggcacuaugacgaggauaacccuuacaaaacaugggccuaucauggauccuacgaaguaaagccaucuggcagcgcuaguuccauggugaauggcguugucaaacuccugacuaagcccugggacgugauuccuauggugacccaaauagcgaugacagauaccacuccauuugggcagcagcgcgucuucaaggagaaaguugacacgaggacacccaaggccaaacgaggaaccgcacaaaucauggaagugacugcuaaguggcuaugggguuuucuuagccggaacaaaaagccgagaauuuguaccagggaggaguucacacgcaagguacguucuaaugccgcaaucggcgccguguuugucgacgagaaccaguggaacucagcuaaagaggccguggaagaugagcgguucugggaccugguucacagagaaagggagcuccacaagcaggggaaaugcgcgacgugcguguauaacaugaugggaaagcgcgagaagaagcugggcgaguuugguaaggcaaaagggagucgagccauuugguacaugugguugggagcucgguuccuggaguucgaagcccucggcuuuaugaaugaggaucauugguucuccagagaaaacagccuuucuggcgucgagggggagggacugcacaaguuagguuacauccugagggacauaucgaaaaucccuggcgggaauauguaugcagaugacaccgcuggaugggauacucgcauuacagaagacgauuugcagaacgaggccagaaucaccgacauuauggaaccagagcaugcucuccuggccaagucaaucuuuaaacuaacuuaccaaaauaaggugguacggguucagaggcccgccaagaauggcacagugauggaugucauaagccgucgagaccagcgcgguuccggacaggugggaaccuauggccuuaauacauucacuaacauggaagcgcaacugauuagacagauggagagugagggcaucuuuucuccuagcgaacucgagaccccaaaccuggccgaacggguguuggauugguuagagaaguacggggucgaaaggcugaagcgcauggcuaucuccggagacgacuguguugugaaacccauugaugacagauucgccacggcacucaccgcucuuaaugauauggguaagguacggaaagacauaccgcagugggagccuucaaagggcuggaacgauuggcagcaagugcccuuuugcagucaccacuuccaucagcugaucaugaaagacgggagggagauugucgugccaugucgaaaucaggaugagcuaguuggacgugccagagugucucagggcgcagguuggagccugcgcgagacagccugccucgggaaguccuaugcgcaaauguggcaguugauguacuuucaccggagggaccugagacuugcugccaacgcaaucuguucagccgucccuguggauuggauucccacuagccgcaccacauggucuauccaugcucaccaucaguggaugacuaccgaagacaugcuguccguauggaaucggguuuggauagaggaaaacccauggauggaggauaagacgcacaucaguagcuggggagacgugcccuaucucggcaaaagggaggaccaauggugcggcucguuaauugggcugacagcccgagcaaccugggcuacuaauauccaggucgccauuaaccaggugagacgguugaucggaaaugaaaacuaccuggauuacaugacauccaugaagagguucaaaaaugagucugacccugaaggugcgcucugguga

SEQ ID NO: 14036 - RNA, 9879 nt, Artificial Sequence
  derived and/or modified CDS sequence (opt3) from DENV-1__EU482495__SS-prME
agcgugacaaugcugcucaugcuuaugcccacagcacuggcuuuccacuugacuacgagaggaggggaaccucauaugaucgucuccaagcaggaaagggggaaaucuuuacuguuuaagacaucagccgguguuaacaugugcacacugauugccauggaccucggcgaacugugugaagauacuaugaccuacaaaugcccacggauaacagaaguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggacuguucaaacuugagaaggaaguggccgagacucagcacgguaccguuuuggugcagauaaaauacgagggcacggacgcuccuugcaagaucccauucucgacacaagaugaaaaagggguaacccagaacggacgucugauuacugcgaaucccaucgucacagacaaggagaaaccugugaacauagaagcagagccacccuuuggcgagucuuauauuguuaucggugccggggaaaaggcucucaagcuguccugguucaaaaagggcucaaguaucggaaaaauguuugaggccaccgcacgcggcgccagaaggauggcuauucuuggggauacugccugggacuucggaagcaucgguggcguguuuaccuccgucgggaagcuggugcaucagauuuucggaacagcauacggcguauuguuuucuggugugagcuggacgaugaaaauagggaucggcguucuccugaccugguuaggacuaaauucacggaguacuucccuaagcaugacauguauugcggucggccucgugacccuguaccuuggggugaugguccaggcugauucuggaugcguuaucaacuggaagggccgagaauugaagugugguucagggaucuucgugacaaaugaggugcacacuuggaccgaacaauauaaauuucaggccgacaguccgaagcgccugagcgcagccauuggaaaggcuugggaggagggcguaugcgguauaagauccgccacgaggcucgaaaacaucauguggcggcagauuucuaacgagcugaaucauaucuuacuggaaaacgacaugaaguucacagucgugguuggcgauguggucgggauucuugcacagggcaagaagaugauccgcccucaacccauggagcacaaauacucguggaaaagcuggggcaaggcuaagauaaucggggccgacgugcagaauaccacuuuuauuaucgauggaccaaacaccccugaaugucccgacgaucagagagcguggaauauuugggagguugaggacuauggcuucgguaucuuuacaacuaacauaugguugaagcucagggauuccuacacccaggugugcgaccaccgucugaugucagccgcuauuaaagauaguaaggcaguacaugccgacaugggguauuggaucgaaucugagaaaaaugaaacauggaagcuagcucgggccagcuucauugaggucaagacguguaucuggccaaaaucccacacccuguggucaaacggagugcucgaaagcgagaugauaauccccaagauuuacggcgguccuaucucucaacauaauuaucgaccaggcuacuucacucagacagcagggccguggcaccugggaaaacuugaguuggauuuugaccugugcgaaggcaccacuguggucguugaugagcacugcgggaacagaggacccuccuuaaggacaaccacggugacuggcaagauuauccaugaaugguguugccgcaguuguacccucccuccacugcgguucaaaggugaggacgggugcugguacggaauggagauaagacccguaaaggaaaaggaggaaaaucuugugaaaagcauggucucugcgggcuccggugagguggacucauuuagucugggcuugcucuguauuagcaucaugaucgaagagguuaugaggucgcgcuggucccgaaagaugcugaugacagggacccuagccguguucuuucugcucauuaugggacagcugacuuggaacgaucuuauccggucuugcauuauggucggcgcuaaugccagcgaccguauggggaugggaacaaccuauuuggcacugauggcuacauucaaaaugagaccuauguuugccgugggcuuacucuucaggcgccugacuucacgggagguucuucugcuaaccauaggucucagucugguggcauccgucgaauugccaaacucucuggaggaauuaggggauggacucgccaugggcaucaugauucugaaacuucugacggacuuucaaagcuaccaguugugggcuacacuccugucccuaaccuucaucaaaacuaccuuuucacugcacuaugcguggaagacaauggccaugguacuuagcauugugagucuccugcccuugugucugucuacuaccucccagaagacgacaugguuaccgguucuccugggcagccuugggugcaaaccucugaccauguucuugaucgcagagaauaagauauggggaagaaaaucguggccacucaacgaagguaucauggcugugggcauugucucaauccugcuaucuagucugcuuaagaacgaugugccccucgccgggccucugauugccggaggcauguugaucgcuuguuacguaauauccgguagcucugcagacuuaagccuggagaaagccgcggagguguccugggaagaggaagcugagcauucaggggccagucacaauauucucgucgaaguucaggaugacggaacuaugaagaucaaagaugaggagagggacgauacacugaccauccuucugaaggcaacuuugcuagccgugagcggcguguauccccugucuauuccagcuacacucuuugucugguacuucuggcaaaagaaaaagcagcgauccggcgugcugugggacaccccuucacccccagaaguugagcgcgcaguacuugaugacgggauauaucggaucaugcagagaggauuacuggguaggagucaggugggcgucgggguguuccaagaaaacguuuuucauacgauguggcacgugacucguggagccguccucauguaccagggcaaacgcuuggagccgagcugggcguccgugaagaaagaccugauuucuuacggugggggauggcggcuccagggcucguggaauaccggcgaggaaguacaggucaucgcuguggagccugggaagaaccccaagaauguucaaacagccccaggaaccuucaaaacacccgaaggugaggugggcgcaauugcccuggauuuuaagccugggacuagcggaucaccaaucgucaacagagaaggcaaaauagugggucuuuaugggaauggaguugugaccacguccggcacauacgucagugcuaucgcccaggcaaaggcuucucaggagggcccccugccugagauugaagacgagguguucaggaaacgaaacuugacuaucauggaucuacacccggggagcggaaagacccggcgcuaucugccagccauuguaagagaagcgaucaagaggaaacuccggacauuaauacuggcccccacccgagugguugcauccgagauggcugaagcccuuaaggguaugccuauuagauaccaaacuaccgcugucaaaucagagcauacaggccgcgagaucguggaccugaugugccacgcaacguuuacuaugaggcucuugucuccagugcguguccccaauuauaacaugaucauuauggaugaagcccauuucaccgacccuagcaguaucgccgcucggggguacauauccacaagaguaggaaugggcgaggcggcagccauuuuuaugaccgcuacuccgcccgguagcguggaagccuucccacagucuaaugcaguuauccaggaugaggaaagggacauuccugagcgcucauggaacuccggguaugaguggaucacagauuuucccggaaagaccgugugguucgucccaaguauaaaaagcggcaaugacauugccaacugucugcgaaagaauggcaagagagugauccagcucucgcggaaaacguuugauacugaauaccaaaagaccaagaacaacgacugggacuacguugugaccaccgauaucucugagaugggggcuaauuucagggcggaccgcgucauugauccucguagaugccugaagcccgugauccuuaaagacggaccagaacggguaauucuagccgguccgaugccugugacuguugcauccgcugcccagaggcgcggccgaauagggagaaaccacaauaaggagggagaucaguauaucuacaugggccagccccugaacaaugacgaggaucaugcacacuggacagaagccaagauguuguuagacaacauuaauaccccagaggguaucauccccgcucuguucgaaccugagcgggaaaagagcgccgcgauugauggggaguauaggcuccgcggcgaggcaagaaagacauuugucgagcugaugaggcggggagaccuuccaguguggcugucauacaaaguggccagugagggcuuccaauauucugaucgucgcuggugcuuugacggggaacgaaacaaucagguccucgaggaaaacauggauguugagauauggacuaaggagggagaaaggaaaaaguugaggccccgguggcuggacgcucgcacguacuccgacccucuagcccugagagaguucaaagaauuugcugcagguaggcggagcgugucaggcgaucucauccuugagauugggaagcugccgcagcacuuaacccagcgagcccaaaaugcuuuggacaaccugguaaugcuccauaauagugaacagggaggcagagccuaucgccacgcaauggaggagcugccagauacaaucgaaacucuuaugcugcucgcguugauugccgugcugaccgguggggucacauuauucuuucuaagcggcaggggacugggcaagaccuccaucgggcuccuuugugugauggcuucuagcgcccuguuguggauggcauccguugagccccauuggauagcugccucaaucauucuggaguucuuucucauggugcugcuuaucccugagcccgaccggcagcguacuccacaggauaaccaacucgcauacgucguaauuggacuguuguucaugauccugacgguggccgcuaaugagauggguuuacuagaaaccaccaaaaaggaccugggcauagggcacguugcgguggagaaccaccaucacgccacuaugcucgauauugaccuucauccugcaucugcuuggacccuguacgccgucgccacaaccaucauuacucccaugaugagacacacaaucgaaaacacgaccgcaaauauaaguuugacugcuaucgccaaccaggcggcuauucugaugggacucgauaaaggcuggccaaucucgaagauggacauuggugugccucugcuugccuuagggugcuauagccaggucaauccgcugacacucaccgcagccguguugaugcugguugcucauuacgcaaucauaggccccggacuacaagccaaagcgaccagggaggcucagaagcgcacagccgcaggcauuaugaagaacccaacuguggaugggaucguagccaucgaccuggauccuguggucuaugacgcuaaauuugaaaagcagcucggacagauuaugcuucugaucuuguguacgucccaaauacugcucaugcggaccacaugggcccugugcgagucuauuacuuuagcaaccggcccccuuacaacccugugggaggguucaccagggaaauucuggaauacuacgaucgcuguuagcauggccaacauuuuucgaggauccuaccucgcgggcgccggucuagcauucagucugaugaagucuuugggcgggggaagaaggggcacaggggcucagggagaaacccugggcgagaaauggaagcgccagcucaaucagcuuagcaagucagaguucaacacuuauaaacgguccgguaucauggagguggacagaagugaagccaaggaggggcugcguaggggagagaccacaaaacacgcagucagccggggcacugcuaaguugcgcugguuuguggaacgaaaucugguaaaaccugaggguaaggugauagaucucggcugugggagaggaggcuggucuuacuauugcgccggguuaaagaaaguuaccgaagugaagggauacacaaaaggcggucccgggcacgaggaaccgaucccaauggccacguacggauggaaccuggucaaacuucauuccggcaaagacguguucuuuauuccucccgagaagugugauacccugcuaugcgacaucggcgagucaagcccaaaucccacuauugaagaggggaggacacuccggguccugaaaaugguggaaccuugguugcgcggaaaccaauucuguaucaagauucugaauccguauaugcccucgguuguagagacccucgagcagaugcagagaaagcacgguggcaugcuugugaggaacccacugucucgaaauaguacucaugaaauguacugggucuccugcgggacaggaaacaucgugagcgcgguuaauaugaccucacggauguuacugaaccguuuuacgauggcucacagaaaaccuaccuaugagcgcgauguggacuugggcgcagguacaaggcacgucgccguggaacccgagguagcuaaccucgauauaauugggcagcggaucgaaaauaucaagcaugagcacaaauccacuuggcauuacgacgaggauaacccuuauaagaccugggccuaccacggaucuuaugaagugaaaccaagcggcagugcauccagcaugguuaauggcgucgugaagcugcuaacaaagcccugggacgugauuccuauggucacucaaauagccaugaccgauacaaccccauucgggcagcagagaguuuuuaaagagaagguggacacucgcacgcccaaagcuaagaggggaacagcgcaaaucauggaaguaaccgcccgauggcuuugggguuuccugucucggaacaaaaagccgagaauuuguacuagggaggaauuuacccgcaaggugcguucaaaugcagcuaucggcgccgucuucguggacgagaaccaguggaauagugcaaaagaggccguugaagaugagcgguuuugggaccucgugcauagagaaagggagcugcacaagcaggggaaaugcgcuacaugcgucuacaacaugaugggaaagcgcgagaaaaaguugggcgaguucgguaaggccaaagggucccgagcgauuugguacauguggcugggagcacgguuucucgaguucgaagcccuuggcuucaugaaugaggaucacugguuuagcagagaaaacucucugucgggcguggagggggagggauuacauaagcuggguuauaucuugagggacauaucaaaaaucccuggcgggaauauguacgcugaugacacggccggaugggauacccgcauuacugaagacgaucuccagaacgaggcaaagaucacagacauuauggaaccagagcacgcucugcuagccaccagcaucuucaaacuuacuuaucaaaauaagguaguuagagugcagcggcccgcuaggaacggcacagucauggaugugauaucccgucgagaccagcgcgguaguggacaggugggaaccuacggccugaauacauuuacuaacauggaagcccaacucauuagacagauggagucugagggcaucuucagcccuuccgaacuggagaccccaaacuuggcagaacgggucuuagauuggcuggagaaacaugggguugaaaggcucaagcgcauggcgaucucaggagacgacugugugguaaagcccauugaugacagauuugccacggcucuuagugcccugaaugauauggguaaagugcggaaggacauaccgcagugggagccuucuaaaggcuggaacgauuggcagcaaguccccuucugcagccaccacuuucaucagcuaaucaugaaggacgggagggagauugugguuccaugucgaaaucaggaugaacuggugggacgugcaagagucucccagggcgcugguuggucacuccgcgagaccgccugcuuggggaaaagcuaugcacaaauguggcagcugauguacuuccaccggagggaccuuagacuggccgcgaacgcuaucuguucugccgugccuguagauuggguucccacaucccgcacuaccuggaguauucaugcacaccaucaguggaugacaacugaagacaugcucagcguguggaaucgggucuggaucgaggaaaacccauggauggaggauaagacccacauaucguccuggggagacgugcccuauuuaggcaagagggaggaccaauggugcggcucucugaucggguugacggcccgagcuacaugggccaccaauauucagguugcaaucaaccaggugagacggcugauuggaaaugaaaacuaccucgauuacaugacuucaaugaaaagguuuaagaaugacagcgauccugagggugcucuuugguga

SEQ ID NO: 14037 - RNA, 9879 nt, Artificial Sequence
  derived and/or modified CDS sequence (opt3) from DENV-1__EU482496__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuacuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaucaguugugggcgacucuccugagccuaaccuucauuaagacaacuuuuucccugcacuaugccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuacgugauuagugguuccagcgccgacuugucuuuagagaaagcggcugaggucagcugggaagaggaagccgagcauuccggggcaucacacaauauccugguggaaguacaggaugacggaaccaugaagaucaaagaugaggagcgcgacgauacucucacaauucugcuuaaggccacccuguuggcugugaguggcgucuauccccuaagcauaccagcaacgcuguucguuugguacuucuggcagaaaaagaagcagcggucuggcgugcucugggacacuccuucacccccagaaguggagagagccguccuggaugacgggaucuauaggauuaugcagcguggacuuuuaggucgcagccaggugggcguugggguauuucaagaaaacguguuccauaccauguggcacgucacacggggagcggugcugauguaccagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguaugggaauggaguggucacaacuucaggcaccuacguguccgccauugcacaggcuaaggccagucaggagggcccccuuccugagaucgaagacgagguuuuucggaaacgcaaccugacaauuauggauuugcacccggggucuggaaagaccagaagguaucuaccagcgaucgugcgggaagccauaaaacgaaagcugagaacucucauuuuagcacccacccgcgucguggcuagcgagauggccgaagcucugaaggguaugccuaucagguaccaaacaacggcaguaaaauccgagcauacuggcaaggagaucguggaccuuaugugccacgccaccuucacaaugcgucugcucucaccaguucggguccccaauuauaacaugauuaucauggaugaagcccauuuuaccgacccuucuagcauagcugcgagaggguacauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguaugaguggauaacggauuuccccggaaaaacuguaugguuugugccauccauuaagaguggcaaugacaucgcuaacuguuugaggaaaaauggcaagcggguuauccagcugagcaggaagacauucgauaccgaauaccagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccacaauaaagagggagaucaguauauuuacaugggccagccccuaaacaaugacgaggaucaugcccacuggacagaagcuaagaugcuguuggacaacaucaauacuccagaggguaucauucccgccuuauuugaaccugagagggaaaaguccgcggcaauagauggggaguaucgccugagaggcgaggccaggaaaacguucguagaacucaugcggcguggagaccugccaguguggcuuagcuacaagguugcuucagagggcuuucaauauagugaucgccgauggugcuucgacggggaaagaaacaaucagguccuggaggaaaacauggauguggagaucuggaccaaagagggagaaaggaagaaacuccggccccgcugguuggacgccagaacauacucugacccucuggcucuaagggaguuuaaggaguucgcagccggucggcgauccgugagcggcgaucugauucucgagaucgggaaacuuccgcagcaccugacucagagagcucaaaaugccuuagacaacuuggucaugcugcauaauucagaacagggaggccgcgcauauaggcacgcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccauuggaucgcugccuccauuaucuuggaauuuuuccugauggugcuccugauuccugagcccgaccgucagagaaccccacaggauaaccaacuugcauacguugugaucggacuccuguuuaugauauugacagucgccgcuaaugagaugggucuguuagaaacuaccaagaaagaccuaggcauugggcacguagcgguggagaaccaccaucacgccgcaaugcuggauguugaccuccauccugcuucagccuggacacuuuacgccguggcaaccacuaucauuacacccaugaugaggcacacgaucgaaaacaccacugcuaauauaucucugacagccaucgcgaaccaggcugccauuuugaugggacuggauaagggcuggccaaucaguaaaauggacauuggugucccucuccuggcacuugggugcuauagccaggugaauccguuaacccugaccgccgcuguccucauguugguggcacauuacgccaucauaggccccggacugcaagcgaaggcuacacgcgaggcccagaaacggacugcagccggcauuaugaagaacccaacgguugaugggaucguggcuaucgaccuagauccuguaguguaugacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuacuauugcgccgggcucaagaaagugacagaaguuaagggauacacgaaaggcggucccgggcacgaggaaccgaucccaauggcgaccuacggauggaacuuagugaagcugcauucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguauaugcccagcgugguugagacucuggagcagaugcagagaaagcacgguggcaugcucguaaggaacccacuuucgcgaaauucuacacaugaaauguacugggugaguugcgggaccggaaacaucgucuccgcugugaauaugacgagccggaugcuguuaaaccguuucaccauggcacacagaaaaccuacauaugagcgcgauguugaccugggcgccgguacuaggcacguggcugucgaacccgagguggccaacuuggauauaauugggcagcggaucgaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcuccugacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuaugggguuuucuuagccgaaacaagaagccgcggauuuguaccagagaggaguucacaaggaaaguacgcucuaaugcugccaucggcgcaguguuugucgacgagaaccaguggaacucagccaaggaggcuguggaagaugagcguuucugggaccugguucaucgggaaagagagcuccacaaacaggggaagugcgccacgugcguguacaacaugaugggaaaaagggaaaagaagcugggcgaguuugguaaagcgaaggggagucgcgcaauuugguacaugugguugggagcccgauuccuggaguucgaagcucucggcuuuaugaaugaggaucacugguucucccgggaaaacagccuuucuggcgucgagggggagggacugcauaaauuagguuauauccugagagacauaucgaagaucccuggcgggaauauguacgccgaugacaccgcaggaugggauacuaggauuacagaagacgauuugcagaacgaggcucgcaucaccgacauuauggaaccagagcacgcccuccuggcuaaaucaaucuuuaagcuaacuuaucaaaauaaagugguaagaguucagcggcccgccaagaacggcacagugauggaugucauaagcaggcgugaccagcgagguuccggacaggugggaaccuacggccuuaauacauucacuaacauggaagcacaacugauucgccagauggagagugagggcaucuuuucuccuagcgaacucgagaccccaaaccuggcggaaagaguguuggauugguuaaagaaauauggggucgagcggcugaagaggauggccaucuccggagacgacuguguugugaaacccauugaugaccgcuucgcuacggcccucaccgcacuuaaugauauggguaagguaagaaaagacauaccgcagugggaaccuucaaagggcuggaacgauuggcagcaagugcccuuuugcagucaucacuuccaccagcugaucaugaaggacgggcgggagauugucgugccauguaggaaucaggaugagcuaguuggacgagcucgugugucucagggcgccgguuggagccugagagaaacagcaugccucgggaaauccuacgcccaaauguggcaguugauguauuuucaucgccgggaccugaggcuugcggcuaacgccaucuguucagcagucccuguggauuggauucccacuagcagaaccacauggucuauccacgcccaucaccaguggaugacuaccgaggacaugcuguccguauggaaucgcguuuggauagaagagaacccauggauggaagauaagacgcauaucaguagcuggggagacgugcccuaccucggcaaacgggaggaccaauggugcggcucguuaauugggcugacagcuagggccaccugggcaacuaauauccaggucgcuauuaaccaggugcgaagauugaucggaaaugagaacuaccuggauuauaugacauccaugaagcgguucaaaaaugaaucugacccugagggugcccucugguga

SEQ ID NO: 14038 - RNA, 9879 nt, Artificial Sequence
  derived and/or modified CDS sequence (opt3) from DENV-1__EU482497__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagguaccuggaaucggcaggaccuguugguaacauucaaaacugcacacgcuaagaagcaggagguugugguccucgggagucaagaaggcgccaugcacaccgcucugacgggagccaccgagauccagacaucuggcacuaccacaauuuuugcagggcauuuaaaaugccgucugaagauggauaaacuaacucucaagggaauguccuaugugauguguaccgguagcuucaaacuggaaaaggaggucgccgaaacgcagcacggcacagugcuuguucagauaaaguacgaggggaccgacgcuccuugcaaaaucccauucucgacucaagaugagaagggagugacacagaacggccgcuugauuaccgcgaaucccaucguaacugacaaagaaaagccugucaacauagaggcagaaccacccuuuggugagucuuauauugugaucggggccggcgagaaagcucugaagcucuccugguucaagaaaggaucaaguaucggcaagauguuugaagccaccgcaagaggggccaggcggauggcuauucugggagauacagccugggacuucgguagcaucggcgggguuuuuacguccgugggaaaacuuguccaucagauuuucggcaccgcauacggugugcuguuuucugggguaagcuggacuaugaagauaggcaucggaguguugcucacauggcugggcuuaaauucacgaaguaccucccugagcaugacauguauugcgguugggcuagucacucucuaccugggagugauggugcaggcugauucuggcugcgucaucaacuggaaaggucgcgagcuuaagugugggucaggaaucuucguuaccaaugaagugcacacguggacagagcaauauaaguuucaggccgacaguccgaaaagauugagcgcagccauuggcaaggcuugggaagagggugugugcggcauaagguccgccacccggcuggagaacaucauguggaaacagauuucuaacgaacucaaucauauccuguuagagaacgacaugaaguucacuguagucgugggggauguugcaggcauucuggcucagggcaaaaagaugauccgcccucaacccauggaauacaaauauucguggaaaagcugggggaaggccaagauaaucggagcggacgugcagaauaccacauuuauuaucgauggcccaaacacuccugagugucccgacgaucagagagccuggaauauuugggaagucgaggacuacgguuucgggaucuuuaccacaaacauauggcuuaaguugagggauuccuauacacaggugugcgaccaccgucucaugucagcugcaauuaaagauaguaaggccguucacgcugacaugggauacuggaucgagucugagaaaaaugagaccuggaagcuggcccgggcgagcuucauugaagugaagacuuguaucuggccaaaaucccauacacuauggucaaacggcguacuggagagcgaaaugauaauccccaagauuuaugguggcccuaucucucaacacaauuaccgaccaggguacuucacccagacugcaggaccguggcaucucggcaaacuggagcuugauuuugacuugugcgaggggacaaccgucgugguggaugaacacugcggaaacagaggccccucccugaggacgacuaccgucacagguaagauuauccacgagugguguugccgcaguuguaccuuaccuccacuccgguucagaggggaagacggaugcugguauggcauggagauaaggcccguuaaagagaaggaagagaaucuggugaaguccaugguaucugccgguuccggcgaaguggacucauuuagucuugggcuguuguguauuagcaucaugaucgaggaagucaugcgcucgcgauggucccggaaaaugcucaugacuggaacacuggcuguguucuuucuacugauuaugggccagcucaccuggaacgaucugauccgucuuugcauuaugguuggggccaaugcaucugacagaaugggaaugggcacaacuuacuuggcucugauggccaccuucaagaugaggccuauguuugcaguggguuuacucuuccgccggcugacgagcagagagguccuucugcuaacaauagggcucucacugguggccaguguugaguugccaaacucccuggaagaguuaggagauggccucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucgggucccugggaugcaagccucuuacaauguuucugaucgcugaaaauaaaauaugggguaggcgaagcuggccauugaacgagggcaucauggccguggggauuguuucgauccuccugucaucucuacugaagaacgaugugccccuugccggaccucucauugcuggcgguaugcugaucgcauguuacgucauaaguggguccagcgccgacuugucuuuagaaaaagcggcugaggugagcugggaggaagaggccgaacauuccggagcaucacacaauauucugguagaggugcaggaugacggcaccaugaagaucaaagaugaagaacgcgacgauacucucacaauccugcuuaaggccacccuguuggcugucaguggcguuuauccccuaagcauuccagcaacgcuguucgugugguacuucuggcagaaaaagaagcagcggucuggggugcucugggacacuccuucacccccagaggucgaaagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucugggguguggaagaggcggguggagcuacuauugcgccggacucaagaaaguuacagaggugaagggcuacacgaaaggugggcccggacacgaggagccgauaccaauggcgaccuacggcuggaacuuagucaagcugcauucuggcaaagacguguuuuucaucccucccgaaaagugugauacucuucugugcgacauuggggaguccucaccaaaucccacaaucgaggaaggaaggacccuacggguccucaaaaugguggagccuuggcugcgcgguaaccaauuuuguauuaagaucuugaauccguauaugcccagcguuguagaaacucuggagcagaugcagagaaagcacggcgggaugcucgugaggaacccacuuucgcgaaauucuacacaugagauguacugggucaguugcggaaccggcaacauuguguccgcuguuaauaugacgagccggaugcuguuaaaccguuucaccauggcacacagaaaaccuacauaugaacgcgauguggaccugggugccgggacuaggcacgucgcuguggagcccgaaguagccaacuuggauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucuguaccagagaagaguucacaaggaaagugcgcucuaaugcugccauuggggcagucuuuguggacgaaaaccaguggaacucagccaaggaggcuguugaggaugaacguuucugggaccuggugcaucgggagagagaacuccacaaacagggaaagugcgccacgugcgucuacaacaugaugggcaaaagggagaagaagcugggugaauuugggaaagcgaagggaagucgcgcaaucugguacaugugguugggcgcccgauuccuggaguucgaggcucucggcuuuaugaaugaagaucacugguucucccgggagaacagccuuucugggguggaaggagagggucugcauaaauuaggcuauauucugagagacaucucgaagauaccugggggaaauauguacgccgaugacaccgcaggcugggauacuaggaucacagaggacgauuugcagaacgaagcucgcauuaccgacacuauggagccagaacacgcccuccuggcuagaucaaucuuuaaacuaacauaucaaaauaagguaguucgggugcagaggcccgccaaaaacgguaccgucauggaugugauuagccgucgagaccagcgcggguccggacaggugggcacauacggccuuaauacuuucaccaacauggaggcacaacugaucagacagauggaaagugaggggauauuuucuccuagcgagcucgaaacgccaaaccuggcggagcgggucuuggauugguuagaaaaguauggaguugagaggcugaagcgcauggccauuuccggugacgacugugugguaaaacccaucgaugacagauucgcuaccgcccucacagcacuuaaugauaugggcaaggugcggaaagacaucccgcagugggaaccuucaaagggguggaacgauuggcagcaaguccccuuuugcagucaucacuuccaccagcugauuaugaaagacggaagggagauagugguuccaugucgaaaucaggaugagcuagugggccgugcuagagucucucagggugccggguggagccugcgcgaaacugcaugccucggaaaguccuacgcccaaauguggcaguugauguauuuucaucggagggaccugagacuugcggcuaacgccaucuguucagcagugccuguagauuggauucccaccagccgcacaacuuggucuauccacgcccaucaccaguggaugaccacggaggacaugcuguccguuuggaaucggguguggauugaagagaacccauggauggaagauaagacacauaucaguagcuggggcgacguccccuaccucggcaaaagggaggaccaauggugcgggucguuaauaggacugaccgcucgagccacuugggcaacaaauauccagguggcuauuaaccagguuagacgguugaucgguaaugagaacuaccuggauuauaugaccuccaugaagagguucaaaaaugaaucugacccugagggcgcccucugguga

SEQ ID NO: 14039 - RNA, 9879 nt, Artificial Sequence
  derived and/or modified CDS sequence (opt3) from DENV-1__EU482499__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagguggccaacuuggauauaauugggcagcggaucgaaaauaucaagcacgagcauaaaucaaccuggcacuaugacgaggauaacccuuacaagacaugggcauaucauggauccuacgaaguaaaaccaucuggcagcgccaguuccauggugaauggcguugucaagcuccugacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuaugggguuuucuuagccgaaacaagaagccgcggauuuguaccagagaggaguucacaaggaaaguacgcucuaaugcugccaucggcgcaguguuugucgacgagaaccaguggaacucagccaaggaggcuguggaagaugagcguuucugggaccugguucaccgggaaagagagcuccacaaacaggggaagugcgccacgugcguguauaacaugaugggaaaaagggaaaagaagcugggcgaguuugguaaagcgaaggggagucgcgcaauuugguacaugugguugggagcccgauuccuggaguucgaagcucucggcuuuaugaaugaggaucauugguucucccgggaaaacagccuuucuggcgucgagggggagggacugcacaaauuagguuacauccugagagacauaucgaagaucccuggcgggaauauguaugccgaugacaccgcaggaugggauacuaggauuacagaagacgauuugcagaacgaggcucgcaucaccgacauuauggaaccagagcaugcccuccuggcuaaaucaaucuuuaagcuaacuuaccaaaauaaagugguaagaguucagcggcccgccaagaacggcacagugauggaugucauaagcaggcgugaccagcgagguuccggacaggugggaaccuauggccuuaauacauucacuaacauggaagcacaacugauucgccagauggagagugagggcaucuuuucuccuagcgaacucgagaccccaaaccuggcggaaagaguguuggauugguuaaagaaauacggggucgagcggcugaagaggauggccaucuccggagacgacuguguugugaaacccauugaugaccgcuucgcuacggcccucaccgcacuuaaugauauggguaagguaagaaaagacauaccgcagugggaaccuucaaagggcuggaacgauuggcagcaagugcccuuuugcagucaccacuuccaucagcugaucaugaaggacgggcgggagauugucgugccauguaggaaucaggaugagcuaguuggacgagcucgugugucucagggcgccgguuggagccugagagaaacagcaugccucgggaaauccuaugcccaaauguggcaguugauguacuuucaccgccgggaccugaggcuugcggcuaacgccaucuguucagcagucccuguggauuggauucccacuagcagaaccacauggucuauccaugcccaccaucaguggaugacuaccgaggacaugcuguccguauggaaucgcguuuggauagaagagaacccauggauggaagauaagacgcacaucaguagcugggaggacgugcccuaucucggaaaacgggaggaccaauggugcggcucguuaauuggccugacagcuagggccaccugggcaacuaauauccaggucgcuauuaaccaggugcgaagauugaucgggaaugaaaacuaccuggauuacaugacauccaugaagcgguucaaaaaugagggagacccugaaggugcccucugguga

SEQ ID NO: 14040 - RNA, 9879 nt, Artificial Sequence
  derived and/or modified CDS sequence (opt3) from DENV-1__EU482500__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagauagccaacuuggauauuaucgggcagcggaucgaaaauauuaagcacgagcauaaaucaaccuggcacuaugacgaggauaacccuuacaagacaugggcauaucauggauccuacgaagugaaaccaucuggcagcgccaguuccaugguaaauggcgugguuaagcuccugacuaagcccugggacgucauaccuauggugacccaaaucgcuaugacagauaccacuccauuugggcagcagagaguguucaaagagaaggucgacacgcgcacacccaaagcgaagaggggaaccgcccaaauuauggaaguuacugcaaaauggcuaugggguuuucuuagccgaaacaagaagccgcggaucuguaccagagaggaguucacaaggaaagugcgcucuaaugcugccauuggcgcaguauuuguggacgagaaccaguggaacucagccaaggaggcugucgaagaugagcguuucugggaccuggugcaccgggaaagagagcuccacaaacaggggaagugcgccacgugcguuuauaacaugaugggaaaaagggaaaagaagcugggcgaguuugguaaagcgaaggggagucgcgcaaucugguacaugugguugggagcccgauuccuggaguucgaagcucucggcuuuaugaaugaggaucauugguucucccgggaaaacagccuuucuggcguggagggggagggacugcacaaauuagguuacauacugagagacaucucgaagauuccuggcgggaauauguaugccgaugacaccgcaggaugggauacuaggaucacagaagacgauuugcagaacgaggcucgcauuaccgacaucauggaagccgagcaugcucuccuggccaaaucaauauuuaagcuaacuuaccaaaauaaagucgugagaguacagcggccagcaaagaacggcacaguuauggaugugauuagcaggcgugaccagcgagguuccgggcaggucggaaccuauggccuuaauacauucacuaacauggaagcgcaacugauccgccagauggagagugagggcaucuuuucucccagcgaacucgagaccccuaaccuggccgaaagaguguuggauugguuagagaaguacgggguggaacggcugaaaaggauggcuauuuccggagacgacugugucguuaagccaauagaugaccgcuucgccacggcacucaccgcucuuaaugauauggguaaagugagaaaggacaucccccagugggagccgucaaaaggcuggaacgauuggcagcaaguaccuuuuugcagucaccacuuccaucagcugauuaugaaggacgggcgggagaucgugguccccuguaggaaucaggaugagcuagugggacgagcccguguuucucagggcgcagguuggagccugagagagacagccugccucgggaaguccuaugcgcaaauguggcaguugauguacuuucaccgccgggaccugaggcuugcugccaacgcaauuuguucagccgugccagucgauuggaucccuacuagcagaaccacauggucuauacaugcucaccaucaguggaugacuaccgaagacaugcuguccguguggaaucgcguauggaucgaggaaaaccccuggauggaggauaaaacgcacauuaguagcuggggagacguuccauaucucggcaagcgggaggaccaauggugcggcucguuaaucgggcugacagccagggcaaccugggcuacuaauauucagguggccaucaaccagguccgaagauugauuggaaaugaaaacuaccuggauuacaugacauccaugaaacgguucaagaaugagggugaccccgaaggcgcgcucugguga

SEQ ID NO: 14041 - RNA, 9879 nt, Artificial Sequence
  derived and/or modified CDS sequence (opt3) from DENV-1__EU482501__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucugggguguggaagaggcggguggagcuacuauugcgccggacucaagaaaguuacagaggugaagggcuacacgaaaggugggcccggacacgaggagccgauaccaauggcgaccuacggcuggaacuuagucaagcugcauucuggcaaagacguguuuuucaucccucccgaaaagugugauacucuucugugcgacauuggggaguccucaccaaaucccacaaucgaggaaggaaggacccuacggguccucaaaaugguggagccuuggcugcgcgguaaccaauuuuguauuaagaucuugaauccguauaugcccagcguuguagaaacucuggagcagaugcagagaaagcacggcgggaugcucgugaggaacccacuuucgcgaaauucuacacaugagauguacugggucaguugcggaaccggcaacauuguguccgcuguuaauaugacgagccggaugcuguuaaaccguuucaccauggcacacagaaaaccuacauaugaacgcgauguggaccugggugccgggacuaggcacgucgcuguggagcccgaaguagccaacuuggauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucuguaccagagaagaguucacaaggaaagugcgcucuaaugcugccauuggggcagucuuuguggacgaaaaccaguggaacucagccaaggaggcuguugaggaugaacguuucugggaccuggugcaucgggagagagaacuccacaaacagggaaagugcgccacgugcgucuacaacaugaugggcaaaagggagaagaagcugggugaauuugggaaagcgaagggaagucgcgcaaucugguacaugugguugggcgcccgauuccuggaguucgaggcucucggcuuuaugaaugaagaucacugguucucccgggagaacagccuuucugggguggaaggagagggucugcauaaauuaggcuauauucugagagacaucucgaagauaccugggggaaauauguacgccgaugacaccgcaggcugggauacuaggaucacagaggacgauuugcagaacgaagcucgcauuaccgacaucauggagccagaacacgcccuccuggcuaaaucaauuuuuaagcuaacuuaucaaaauaaaguaguuagagugcagcggcccgccaagaacgguacagucauggaugugaucagcaggcgugaccagcgaggguccggacaggugggcaccuacggccuuaauacauucacuaacauggaggcacaacugauacgccagauggaaagugaggggauauuuucuccuagcgagcucgaaaccccaaaccuggcggagagagucuuggauugguuagaaaaguauggaguugagcggcugaaaaggauggccaucuccggugacgacugugugguaaagcccaucgaugaccgcuucgcuacggcccucaccgcacuuaaugauaugggcaaagugagaaaggacauuccgcagugggaaccuucaaaaggguggaacgauuggcagcaaguccccuuuugcagucaucacuuccaccagcugauaaugaaggacggacgggagaucgugguuccauguaggaaucaggaugagcuagugggccgagcucgugucucucagggugccggguggagccugagagaaacagcaugccucggaaaguccuacgcccaaauguggcaguugauguauuuucaucgccgggaccugaggcuugcggcuaacgccauuuguucagcagugccuguagauuggauccccacuagcagaaccacauggucuauucacgcccaucaccaguggaugacuaccgaggacaugcuguccguuuggaaucgcguguggaucgaagagaacccauggauggaagauaaaacgcauauaaguagcuggggcgacguccccuaccucggcaagcgggaggaccaauggugcgggucguuaaucggacugacagcuagggccaccugggcaacuaauauucagguggcuaucaaccagguucgaagauugauugguaaugagaacuaccuggauuauaugacauccaugaaacgguucaagaaugaaucugacccugagggcgcccucugguga

SEQ ID NO: 14042 - RNA, 9879 nt, Artificial Sequence
  derived and/or modified CDS sequence (opt3) from DENV-1__EU482504__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggugacucuccugagccuaaccuucaucaagacaacuuuuucccugcacuaugcguggaaaaccauggccaugguccuuucaauuguaagccucuucccccuguguuugaguacgacaucucagaagaccacuuggcugccgguguuacucggcucccuggggugcaagccucuuacaauguuucugaucgcagagaauaaaauauggggaaggcgaagcuggccauugaacgaagguaucauggcuguuggcauugugucgauccuccugucaucucuacugaagaacgaugucccccuugccgggccucucauugccggaggcaugcugaucgcuuguuacgugauaagugguuccagcgcagacuugucuuuagagaaagccgcggagguaagcugggaagaggaagcugagcauuccggggccucacacaauauucugguggaaguccaggaugacggaaccaugaagaucaaagaugaggagcgcgacgauacucucacaauccugcuuaaggcaacccuguuggccguuaguggcguguauccccuaagcauuccagcuacgcuguucgugugguacuucuggcagaaaaagaagcagcggucuggcguccucugggacacuccuucacccccagaaguggagagagcaguucuggaugacgggauauauaggaucaugcagcguggacuuuuaggucgcagccagguaggcgugggggucuuucaagaaaacguguuccauaccauguggcacguuacacggggagccgugcugauguaccagggcaaaagacucgagccgaguugggcgagcgucaagaaagacuugauuuccuacggugggggauggaggcugcagggcucuuggaauaccggcgaggaagugcagguaaucgcugucgagccugggaagaaccccaaaaaugugcaaacagccccaggaacuuuuaagacccccgaaggugagguuggcgcaauugcccucgauuucaagccugggacgucgggaagcccaaucgugaaccgagaaggcaaaauagucggucuguaugggaauggagugguuacaacuucaggcaccuacguguccgcuaucgcccaggcaaaggcuagucaggagggcccccuuccugagauugaagacgaggucuuucggaaacgcaaccugacaaucauggauuugcacccggggucuggaaagaccagaagguaucuaccagccauugugcgggaagcgaucaaacgaaagcugagaacucucauauuagcccccacccgcguaguggcaagcgagauggcugaagcccugaaggguaugccuauuagguaccaaacaacggcuguuaaauccgagcauacuggcaaggagaucgucgaccuuaugugccacgcaaccuucacaaugcgucugcucucaccagugcgggugcccaauuauaacaugaucauuauggaugaagcccauuuuaccgacccuucuagcaucgccgcuagaggguacauaaguacuagggucggaaugggcgaggcggcagccauuuucaugacagcuaccccgcccgguuccguagaagccuuuccacagagcaaugcagugauccaggaugaggaacgcgacauuccugagcgaucuuggaacucaggguaugaguggaucacggauuuccccggaaaaacuguuugguuugugccauccauaaagaguggcaaugacauugccaacuguuugaggaaaaauggcaagcgggucauccagcugagcaggaagacauucgauaccgaauaccagaaaaccaagaacaacgacugggacuacgugguuacuacagauaucucggagaugggggcuaauuuccgcgcggaccgugugauugauccuagacggugccucaaacccgucauccugaaggacggaccagaaagggugauucuugccgguccgaugccuguaaccguggcaucugcugcccagcgccgaggcagaauagggcggaaccacaauaaagagggagaucaguauaucuacaugggccagccccuaaacaaugacgaggaucaugcacacuggacagaagccaagaugcuguuggacaacauuaauacuccagaggguaucauccccgcuuuauuugaaccugagagggaaaaguccgccgcgauugauggggaguaucgccugagaggcgaggcaaggaaaacguucguugaacucaugcggcguggagaccugccagucuggcuuagcuacaagguggccucagagggcuuucaauauagugaucgccgauggugcuucgacggggaaagaaacaaucaggugcuggaggaaaacauggaugucgagauauggaccaaagagggagaaaggaagaaacuccggccccgcugguuggacgcuagaacauacucugacccucuggcccuaagggaguuuaaggaguucgcugcaggucggcgauccguuagcggcgaucugaucucagagauugggaaacucccgcagcaccuuacucagagagcccaaaaugcucuggacaacuuagugauguugcauaauagugaacagggaggccgcgccuauaggcacgcaauggaggagcugccagauaccaucgaaacacucaugcugcuugcgcugauugccguacucaccgguggggugacuuuguuuuuccugagcggccggggauuaggcaagacguccaucgggcuacugugugucauggcuucuagcgugcuccuuuggauggccuccguugagccccauuggauagcagcuucaaucauucuggaauuuuucuugauggugcugcucaucccugagcccgaccgucagagaaccccacaggauaaccaacuggccuacgucguaauuggacuucucuuuaugauccugacaguggcagccaaugagauggguuugcuggaaacuaccaagaaagacuuaggcauagggcacguugcuguggagaaccaccaucacgcggccaugcuagaugucgaccugcauccugcaucugcuuggacacucuacgccguggccaccacuauuaucacacccaugaugaggcacacgauugaaaacaccacugcaaauaucagucuuacagcuauagccaaccaggcggcuauccugaugggauuggauaagggcuggccaauuucgaaaauggacaucggugucccucugcucgcccuggggugcuauagccaggugaauccgcuuaccuuaaccgcagccguucugaugcucguggcucauuacgcaauuaucggccccggauugcaagccaaggcgacacgcgaggcucagaaacggacugccgcaggcauaaugaagaacccaacgguagaugggauuguggccaucgaccuggauccugucguuuaugacgcuaaguucgaaaaacagcuaggacagaucaugcugcucauucuuuguaccucccaaauccuguugaugcgaacaacuugggcccugugcgagucuauaacccucgcaacaggcccccugaccacuuuaugggaggguucaccagggaaguuuuggaauacgacaauugcugugagcauggccaacaucuucagaggauccuaccuugcgggcgccggucuggcauucagucucaugaaaucucuaggcgggggaaggcgcggcaccggggcucagggagaaacucugggcgagaaguggaaacggcaguugaaucagcugagcaagucagaauuuaacaccuauaagagauccgguauuauggaggucgaccguagugaagccaaagaggggcucaagaggggagagacaacuaaacacgcagugagccggggcaccgcuaaacuucgcugguucguagaacgaaaucuggugaaaccugaggguaagguuaucgauuugggcugugggagaggaggcuggucuuacuauugcgccgggcugaagaaagugacagaagucaagggauacacgaaaggcggucccgggcacgaggaaccgauaccaauggccaccuacggauggaaccucgugaaguuacauuccggcaaagacgucuuuuucaucccucccgagaagugugauacucugcuuugcgacauuggcgagucaagcccaaaucccacaaucgaagaggggaggacccugcgggugcuaaaaaugguugaaccuuggcuccgcggaaaccaauuuuguauuaagauccugaauccguauaugcccucgguaguggagacuuuggagcagaugcagagaaagcacgguggcaugcuggucaggaacccacucucucgaaauaguacacaugaaauguacuggguguccugcgggaccggaaacauuguuagcgcggugaauaugacgucacggaugcuucugaaccguuucaccauggcucacagaaaaccuacauaugagcgcgaugucgacuuaggcgcagguacuaggcacguggccguagaacccgagguggcuaaccuggauaucauagggcagcggauugaaaauaucaagcaugagcacaaauccaccuggcauuacgacgaggauaacccuuauaagacaugggccuaccacggaucuuaugaaguuaaaccaagcggcagugcauccagcauggucaauggcguggugaaguugcucacuaagcccugggacgucaucccuaugguuacccaaauugccaugacagauaccacuccauuugggcagcagagaguguucaaagagaagguagacacgcgcacacccaaagcuaagaggggaaccgcgcaaauaauggaagugacugccaaauggcugugggguuuucuaucucgaaacaagaagccgcggaucuguaccagagaggaguucacaaggaaaguccgcucaaaugcagcuauuggcgccguguuuguugacgagaaccaguggaauagugcaaaggaggccguggaagaugagcguuucugggaccuuguccaucgggaaagagagcugcacaaacaggggaagugcgcuacgugcguguacaacaugaugggaaaaagggaaaagaagcucggcgaguuugguaaagccaaggggucccgcgcgaucugguacauguggcugggagcacgauucuuggaguucgaagcccugggcuuuaugaaugaggaucacugguucagccgggaaaacucucucucgggcguagagggggagggacuucauaaacuggguuauauuuuaagagacaucucaaagauaccuggcgggaauauguacgcugaugacaccgccggaugggauacuaggaucacagaagacgaucugcagaacgaggcacgcauuaccgacaucauggaaccagagcacgcuuugcucgccaaaagcauuuuuaagcugacuuaucaaaauaaaguugugagaguccagcggcccgcuaagaacggcacagugauggaugugaucuccaggcgugaccagcgagguagugggcaggucggaaccuacggccuaaauacauucacuaacauggaagcccaacuuauacgccagauggagucugagggcauuuuuagcccuuccgaacuggagaccccaaaccucgcagaaagaguucuggauugguuggagaaguaugggaucgaacgguuaaaaaggauggcgaucucaggagacgacugugugguaaagcccauugaugaccgcuucgccacggcucugaccgcccucaaugauauggguaaagugagaaaggacauaccgcagugggagccuaguaaaggcuggaacgauuggcagcaaguccccuuuugcucucaucacuuccaccagcuuaucaugaaggacgggcgggagauugugguuccauguaggaaucaggaugaacuggugggacgagcacgugucagccagggcgcugguuggucccuaagagagacagccugccuggggaagucauacgcacaaauguggcagcucauguauuuucaucgccgggacuugaggcuggccgcgaacgcuaucuguagcgccgugccuguagauuggauucccacuucuagaaccacaugguccauccacgcacaucaccaguggaugacuaccgaagacaugcuuaguguuuggaaucgcguguggauagaggaaaacccauggauggaggauaaaacgcauaucagcucguggggagacguccccuaccugggcaagcgggaggaccaauggugcggcucccucauuggguuaacagccagggcuaccugggccacuaauauccagguggcaauuaaccagguucgaagacugaucggaaaugaaaacuacuuggauuauaugacaucuaugaaacgguucaagaaugagucagacccugaaggugcucugugguga

SEQ ID NO: 14043 - RNA, 9879 nt, Artificial Sequence
  derived and/or modified CDS sequence (opt3) from DENV-1__EU482505__SS-prME
agcgugacaaugcugcuaaugcuuaugcccacagcacuggcuuuccacuugacuacgcgaggcggggaaccucauaugaucgucuccaagcaggaaaggggaaaaucuuuacuguuuaagaccucagccgguguuaacaugugcacacugauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuaaaagggauguccuaugugauguguacugggagcuucaagcucgagaaggaagucgcggagacccagcacgguacggugcugguucagauuaaauacgagggcacagacgcaccuugcaagauaccauuuucgacccaggaugaaaaaggggugacucaaaacggacgccuuaucacagccaaucccauuguaaccgacaaggagaaaccugucaacaucgaagcugagccacccuucggcgagucuuauauagugauuggugccggggaaaaggcauugaagcuguccugguuuaaaaagggcucaaguaucggaaaaauguucgaggccacugcuagaggcgccaggcggauggcaauccucggggauaccgcgugggacuuuggaagcauugguggcguuuucacauccguggggaagcugguccaucagaucuuuggaacggcuuacggcgugcuuuucucugguguaagcuggaccaugaaaauugggauaggcgugcuguugacuuggcucggacuaaauucacgaaguacauccuuaagcaugaccuguaucgccguuggccuggucacacuauaccucggggugauggugcaggcagauucuggaugcgucauuaacuggaagggccgcgaacugaagugugguucagggaucuuuguuacuaaugaggugcacaccuggacggaacaguauaaauuccaagccgacaguccgaagagacuuagcgcugccaucggaaaagcaugggaggagggcgugugcgguauuagguccgcuacacgguuggaaaacauaauguggaagcagaucucuaacgagcugaaucauauucuccuggaaaacgacaugaaauuuaccguagucgugggcgauguugccgggaucuuagcgcagggaaagaaaaugauucgcccucagcccauggagcacaaguacucguggaaaagcuggggcaaagccaagaucauaggggcugacgugcaaaaugcaacuuucaucauugauggaccaaacaccccugaaugucccgacgaucagagagccuggaauaucugggaggucgaggacuauggcuuugguauuuucacaacuaacaucuggcugaaacuuagggauuccuacacccaggugugcgaccaccguuugaugucagcugccauaaaggauaguaaagcaguucaugcggacaugggguauuggauugaaucugagaagaaugaaacauggaagcucgcccgggcuagcuucaucgaggugaaaacguguauuuggccaaagucccacacccuguggucaaacggaguacuagaaagcgagaugaucauacccaaaaucuacggcgguccuauuucucagcauaauuaucgaccaggcuacuuuacucaaacagccgggccguggcaccugggaaagcucgagcuggauuucgaccuuugcgaaggcaccacugucgugguggaugagcacugcgggaacagaggacccuccuugaggacaaccacggucacuggcaaaaucauucaugaaugguguugccgcaguuguacccugccuccauuacgguuuaagggugaggacgggugcugguacggaauggagaucagacccguuaaggaaaaagaggaaaaucucgugaaguccaugguaucugcaggcuccggugagguggacucauucagucugggccuucuguguauaagcauuaugaucgaagaggucaugaggucgcgcuggucccgaaaaauguugaugacagggacccucgcuguguuuuuccugcuaaucaugggacagcugacuuggaacgaucucauucggcugugcaucaugguuggcgccaaugcaucugaccguauggggaugggaacaaccuaucuugccuugauggcuacauuuaagaugagaccuauguucgcggugggccuguuauuuaggcgccucacuagccgggagguccugcuucugaccauuggucuaucacucguggccaguguugaacugccaaacuccuuggaggaacugggggauggauuagcaaugggcauaaugauccucaaacugcuuacggacuuccagucucaccaacugugggcuacauugcucagccugaccuuuauuaagacuaccuucucccuacauuacgccuggaagacaauggccauggugcugucaaucgucagccuuuuuccccucugucugaguacuaccucucagaaaacgacaugguugccgguacuguuaggcucccucgggugcaagccucugaccauguuccuuauugcugagaauaaaaucuggggaagaaagagcuggccacugaacgaagguauaauggcagugggcaucguuucgauuuugcucucaucucugcucaagaacgaugugccccuggccgggccucuuaucgcgggaggcaugcucauugcuuguuaugucaucagugguuccagcgccgaccugucuuuggagaaggcagccgaggugagcugggaagaggaagcugagcacuccggggcaucacauaauauauuaguagaagugcaggaugacggaacuaugaaaauuaaggaugaggagagggacgauacacugaccauccuccugaaggccacucuucuggcggucaguggcguuuaccccuugagcaucccagcuacacuauucgugugguauuuuuggcagaaaaagaaacaacgaucuggcgugcugugggacaccccuucacccccagaagucgagcgcgccgugcucgaugacgggauuuaccggauaaugcagagaggacugcuugguaggagccagguuggcguagggguguuccaggaaaacgucuuucacacgauguggcacgugacucguggagcaguuuuaauguaucaaggcaagcgccuggagccgaguugggccagcgugaaaaaggaccucaucuccuacggugggggauggcgguugcagggcucuuggaauaccggcgaggaaguccaggugauugcuguagagccugggaagaaccccaaaaauguccagacagccccaggaaccuucaagacaucggaaggugaggugggcgcaaucgcucuggauuuuaaacccgggacuagcggaucaccuauuguuaacagagaaggcaagaucgugggucucuacgggaauggagucgugaccacguccggcacauauguuagugccauagcgcaagccaaagcaucucaggagggcccacugcccgagaucgaagacgagguguucaggaagcgaaaccuuacuauuauggaucugcauccugggagcggaaagacccggcgcuacuugccggcuaucgucagagaagccauuaaaaggaagcuacggacacugauccucgcuccaacccgagugguagcauccgagauggccgaagccuuaaaagguaugcccauaagauaucagacuaccgcugugaagucagagcacacaggcaaagagauuguugaccugaugugccaugcgacguuuacuaugcgccuucugucuccugucagggugccaaauuacaacaugaucaucauggaugaagcacacuucaccgaccccagcaguauugccgcucguggguauaucuccacacgggugggaaugggcgaggccgcagccauauuuaugaccgcuacuccuccggguagcgucgaagcguucccccaaucuaaugccguaauucaggaugaggaaagagacaucccagagaggucauggaacuccggguacgaguggauuacagauuuuccuggaaagaccgugugguucguucccaguaucaagagcggcaaugacauagcaaacugucuccgcaaaaauggcaagcgagugauucaguugucgagaaaaacguucgauacugaauaucagaagaccaaaaacaacgacugggacuacgucgugaccaccgauaucucugagaugggggcuaauuuucgggccgacaggguuaucgauccacgccguugccugaagccugugauucucaaggacggacccgaaagagucauccuggcagguccaaugccggugacuguagccuccgcugcccaacggaggggccgcauugggcgaaaccauaauaaagagggagaucaguacauauauaugggccagccucuuaacaaugacgaggaucacgcgcacuggacagaagcaaagaugcuacuggacaacaucaauacccccgaggguauuaucccagccuuguucgaacccgagagagagaaaagcgcugccaucgauggggaguaccgguuaaggggcgaggcucgcaagacauuuguggaacugaugagaaggggagaccucccuguuuggcugucauauaaagucgcaagugagggcuuccaguacucugaucggcguuggugcuuugacggggaacgcaacaaucaagugcuugaggaaaacauggauguggagauuuggacuaaggagggagaaagaaagaagcugagaccaagguggcucgacgcccggacguauuccgaccccuuggcucugcgcgaguucaaggaauuugccgcagguagaaggagcgucucaggcgaucuaauacuggagaucgggaaacucccucagcaucuuacccagcgggcgcagaaugcccuggacaacuuaguuauguugcacaauagugaacaaggaggccgagcuuacagacaugccauggaggagcugccggauacaauugaaacucucaugcugcuugcacugaucgcugugcucaccggugggguaacauuguucuuucugagcggccgcggauuaggcaagaccuccauugggcuacugugugugauggccucuagcguccuccuuuggauggcauccguggagccacacuggaucgccgcuucaauaauccuggaguucuuuuugaugguucugcucauucccgagccugacaggcagcggacuccccaggauaaccagcuggcguauguggucaucggacuucucuucaugauucugacgguagccgcaaaugagauggguuugcuggaaaccaccaaaaaggacuuaggcaucgggcacguggcuguugagaaccaucaccaugccgccaugcuagauguggaccugcacccagcaucugcuuggacucucuacgccgucgcgaccacaauaauuaccccuaugaugcgucauacuaucgaaaacacaacggcuaauauuagucuuaccgccaucgcaaaccaagccgcuauacugaugggauuggauaaaggcuggcccaucucgaagauggacauuggugugccacugcucgcacuggggugcuacagccaggucaauccucuuacuuuaacagccgcggugcugaugcucguugcucacuaugccaucauuggcccgggauugcaggcaaaggccaccagagaggcucagaaaaggaccgccgcaggcaucaugaagaaccccacaguggaugggauaguagcuauugaccuggauccaguggucuacgacacuaaauuugaaaagcagcuaggacagaucaugcugcucauccuuuguacgucccagauucuguugaugcgcaccacaugggcccugugcgagucuaucacucucgcgaccggcccucugacaaccuuaugggaggguucacccgggaaauucuggaauacuacgauagccguuagcauggcaaacauuuuccggggauccuaucuugcuggcgccggucuggcauuuagucucaugaagucucuaggcgggggacgaagaggcacaggggcucaaggagaaacccugggcgagaaguggaaaaggcaguugaaucagcugagcaagucagaguucaacacuuacaaacgcuccgguaucauggagguggaccggagugaagccaaggaggggcucaaaagaggagagaccacaaagcacgccgucagccguggcacugcgaaacuuaggugguuuguggaacggaaucugguaaaaccagaggguaaggugauugauuugggcugugggcgcggaggcuggucuuauuacugcgcugggcugaaaaagguuaccgaagugaaaggauauacaaagggcgguccugggcaugaggaacccaucccgauggcaacguacggauggaaccucgucaaauuacacuccggcaaggacguguucuuuauaccaccugagaagugugauacccugcuuugcgacaucggcgagucaagccccaauccaacuauugaagaggggcgaacacugagaguccuaaaaaugguggaacccuggcucaggggaaaccaguucuguaucaagauucugaauccuuacaugccgucgguuguagagaccuuggagcaaaugcagcggaaacaugguggcaugcuggugcgcaacccccucucuagaaauaguacucacgaaauguauugggucuccugcgggacaggaaacaucgugagcgccguuaauaugaccucaaggaugcuucugaaccgauuuacgauggcucaccggaagccaaccuacgagcgugauguggacuuaggcgccgguacaagacaugucgcaguggaaccugagguagccaaccuggauauuaucgggcagcgcauagaaaauauuaaacacgagcauaaguccacuuggcacuaugacgaggauaaccccuacaagaccugggcuuaucauggaucuuacgaagugaaaccuagcggcagugcguccagcaugguuaauggcgucgugaaguugcucacaaaaccaugggacgugauccccauggucacucagaucgccaugaccgauacaaccccuuucgggcaacagaggguuuuuaaggagaaaguggacacucggacgccaaaggcaaagagaggaacagcucagauuauggaaguaaccgccaaauggcugugggguuuccuaucucgcaacaagaaacccaggauauguacucgagaggaauuuacccggaaggugagaucaaaugcagccaucggcgcugucuucguggacgagaaccaauggaauagugccaaagaggcgguugaagaugagagguuuugggaccuugugcaccgcgaacgugagcugcacaagcaggggaagugcgcaacaugcgucuauaacaugaugggaaaacgggaaaagaaacucggcgaguucgguaaggccaaaggguccagagcuauuugguacauguggcugggagccagguucuuggaguuugaagcacugggcuucaugaaugaggaucauugguuuaaccgcgaaaauagccucucuggcguggagggggagggacuucacaagcuggguuacaucuuacgagacauuucgaaaaucccgggcgggaacauguaugcugaugacacggccggaugggauacccggauaacugaagacgaucugcagaaugaggcuaagaucacagacauuauggaaccugagcaugccuugcucgcaaagucaaucuucaaacugaccuaccagaacaagguaguuagagugcaaaggccagcgaaaaauggcacugucauggaugugauuagccgcagagaccagcgggguuccggacaggugggaacauauggccuaaacaccuuuacaaacauggaagcccagcuuaucaggcaaauggagagugagggcauauucucucccagcgaacuggagacuccuaaucucgcugggcguguccuggauugguuggaaaagcacggaguugagcgauuaaaacgcauggccauuuccggugacgacugugugguaaagccaaucgaugacagauuugcaaccgcucugacggcccucaacgauaugggcaaggugcggaaagacaucccccagugggaaccgucaaagggguggaaugauuggcagcaggucccuuucugcagucaccauuuucaccaacuuauuaugaaagacggaagggagauagugguucccugucgcaaccaggaugagcuggugggcagagcacgggucucucagggugccggguggagccuaagggaaaccgcgugccugggaaaguccuacgcucagauguggcaacucauguauuuccaucgacgugacuugagacuggccgcaaaugccaucuguucagcugugccaguagauuggguuccuacaagccgcacuaccuggucuauucacgcccaucaccaguggaugacaacugaggacaugcuuuccguguggaaccgggucuggaucgaagagaaucccuggauggaagauaaaacccacauuaguagcuggggcgacgugccauaccugggcaagagggaggaccaguggugcgggucgcucaucggauuaacggcaagagcuacaugggccaccaacauacaaguugcgaucaaucaggugcgccggcugauugguaacgagaauuauuuggauuacaugacuuccaugaagagguuuaaaaacgaaaucgaccccgagggcgcucugugguga

SEQ ID NO: 14044 - RNA, 9879 nt, Artificial Sequence
  derived and/or modified CDS sequence (opt3) from DENV-1__EU482506__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacgcuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcauccuccugacaugguuaggacugaauagccgaucaaccagucuauccaugacauguaucgcgguaggccucgugacucuguaccuugggguuaugguccaggcugauagcggaugcgugauuaacuggaaaggccgcgaauugaagugugguucugggauauucgugaccaaugagguccacacguggacagaacaauauaaguuucaggccgacucaccgaaaagacugagugcagccaucggaaaggcuugggaggagggcguuugcgguauuaggagcgccacccggcucgaaaacaucauguggaaacagauuuccaacgagcugaaucauaucuuacuggaaaacgacaugaaguucacuguggugguaggcgaugucgcagggauacuugcucagggcaagaagaugauccgcccucaacccauggaguacaaauauucuuggaagucguggggcaaggccaaaauuaucggggcggacgugcagaauaccacauuuauuaucgauggaccaaacacuccugaaugucccgacgaucagagagccuggaauauaugggagguugaggacuacggcuucgguauuuuuaccacaaacaucugguugaagcucagggauagcuauacacaggugugcgaccaccgucugauguccgcugcaauuaaagauucaaaggccguccacgcugacaugggguacuggaucgaaagugagaaaaaugaaaccuggaagcuagcccgggcaucuuucauagaggugaagacuuguaucuggccaaaaagccauacacugugguccaacggaguucucgaaucagagaugauuauccccaagauuuauggcgguccuaucagccaacacaauuaccgaccaggcuacuucacccagacugcggggccguggcaucugggaaaacuugaguuggauuuugaccugugcgaaggcacaaccgugguagucgaugagcacugcgggaacagaggacccucuuuaaggacgacuaccgugacaggcaagauaauucacgaaugguguugccgcuccuguacccucccuccacugcgguucagaggugaggacgggugcugguauggaauggagaucaggcccgugaaagaaaaggaggaaaaucuugucaagaguaugguuagcgccggcucuggugagguggacuccuuuucacugggcuugcucuguaucaguauuaucauugaagagguaaugcgcagccgauggucgcggaaaaugcugaugacugggacacuagcuguguucuuucugcucauaaugggacagcugaccuggaacgaucuuauccguuugugcauuauggucggcgccaaugcauccgacagaauggggaugggaacaacuuaccuggcuuuaauggccaccuucaagaugaggccuauguuugcagugggccuccuguuccgccggcuuacgucuagagagguucugcuacucacaaucggucugagcuugguggccucagucgaacugccaaacaguuuagaggaacucggggauggacuggcuaugggcauuaugauccuuaaacuguugaccgacuuucaaucccaucagcucugggcgacucugcuaucucugaccuucauaaagacaacuuuuagccuucacuaugccuggaaaaccauggcaauggugcucuccaucguuucacuguuccccuugugucugagcacgacaagucagaagaccacuugguuaccggugcuccugggcucucuugggugcaagccucugacaauguuuuugauugcugagaauaaaaucuggggaaggcgauccuggccacucaacgaagguauuauggccgucggcaucguaagcauacugcuaucgucacugcuuaagaacgaugugccccucgccgggccucugauugcuggaggcauguugaucgcauguuacguuaucucugguaguuccgccgacuuaagccuggagaaagcggcugaggugucuugggaagaggaagccgagcauagcggggcaucccacaauauucucgucgaagugcaggaugacggaaccaugaagauaaaagaugaggagcgcgacgauacucugacaauccuucugaaggccaccuugcuagcuguaucaggcguguauccccugaguauuccagcaacacucuucgucugguacuucuggcagaagaagaagcagcggagcggcguucugugggacacuccuucucccccagaaguggagagagccgugcuugaugacgggaucuauaggauuaugcagcguggauuacugggucgcucccaggucggcguggggguuuuucaagaaaacguauuccauaccauguggcacgugacacggggagcgguccucauguaccagggcaaaagauuggagccgucaugggcuagugugaagaaagaccugaucagcuacggugggggauggaggcuccagggcuccuggaauaccggcgaggaaguucaggugauagccgucgagccugggaagaaccccaaaaaugugcaaacagcaccaggaacuuuuaagacccccgaaggugagguaggcgccaucgcucuggauuucaagccugggacgucuggaucgccaauugucaaccgagaaggcaaaaucgugggucuuuaugggaauggaguugugacaacuagcggcaccuacgucucagccauugcacaggcuaaggccucccaggagggcccccugccugagaucgaagacgagguguuucggaaacgcaacuugacaauaauggaucuacacccggggaguggaaagaccagaagguaucugccagcgauuguucgggaagccaucaaacgaaagcucagaacuuuaauccuggcacccacccgcguggucgcuucugagauggccgaagcucuuaaggguaugccuauuagguaccaaacaacggcagugaaaagcgagcauacuggcaaggagaucguagaccugaugugccacgccaccuucacaaugcgucucuuguccccagugcggguucccaauuauaacaugauaauuauggaugaagcccauuuuaccgacccuucaucuaucgcugcgagaggguacauuagcacuagggucggaaugggcgaggcagccgcuaucuucaugacagccaccccgcccgguaguguggaagcauuuccacaguccaaugccgugauacaggaugaggaacgcgacauuccugagcgaagcuggaacucuggguaugaguggaucacggauuuccccggaaaaacugucugguuuguaccaucaaucaaguccggcaaugacauugcuaacugucugaggaaaaauggcaagcgggugauccagcucaguaggaagacauucgauaccgaauaccagaaaaccaagaacaacgacugggacuacguugugacuacagauauuagcgagaugggggcgaauuuccgcgccgaccgugucauagauccuagacggugccugaaacccgugauccuuaaggacggaccagaaaggguuauucuagcagguccgaugccugugaccgucgcuucggccgcacagcgccgaggcagaaucgggcggaaccacaauaaagagggagaucaguauaucuacaugggccagccccugaacaaugacgaggaucaugcccacuggacagaagcuaagauguuguuagacaacauuaauacuccagaggguauaauccccgcccuguuugaaccugagagggaaaagucugcggcaauugauggggaguaucgccucagaggcgaggccaggaaaacguucguggaacugaugcggcguggagaccuuccaguauggcuguccuacaagguggcuagcgagggcuuucaauauucagaucgccgauggugcuucgacggggaaagaaacaaucagguucucgaggaaaacauggaugucgagaucuggaccaaagagggagaaaggaagaaauugcggccccgcuggcuggacgccagaacauacagugacccucuagcucugagggaguuuaaggaguucgcagccggucggcgaucuguguccggcgaucucauucuugagaucgggaaacugccgcagcacuuaacucagagagcucaaaaugccuuggacaaccuggugaugcuccauaauagcgaacagggaggccgcgcauauaggcacgcgauggaggagcugccagauaccauagaaacacuuaugcugcucgccuugaucgcuguccugaccggugggguuacuuuauuuuuccuaucaggccggggacugggcaagacgaguauugggcuccuuugugugauggccagcuccguacuguuguggauggcaucuguggagccccauuggaucgcugccagcauuauccuggaauuuuuccucaugguccugcuuauaccugagcccgaccgucagagaaccccacaggauaaccaacucgcauacgugguuauuggacuguuguuuaugauccugacaguggccgcuaaugagauggguuuacuagaaacuaccaagaaagaccugggcauugggcacgucgcgguagagaaccaccaucacgccgcaaugcucgauguggaccuucauccugcuuccgccuggacacuguacgccguugcaaccacuaucauaacacccaugaugaggcacacgaucgaaaacaccacugcuaauauuucauugacagccaucgcgaaccaggcugccauucugaugggacucgauaagggcuggccaaucucuaaaauggacauaggugugccucugcuugcauuagggugcuauagucaggucaauccgcugacccucaccgccgcuguguugaugcuggucgcacauuacgccauuaucggccccggacuacaagcgaaggcuacacgcgaggcccagaaacggacugcagccggcaucaugaagaacccaacgguggaugggauuguugcuaucgaccuggauccugugguauaugacgccaaguucgaaaaacagcucggacagauaaugcuucugauuuuguguaccucgcaaauccugcucaugcgaacaacuugggcacugugcgagagcauuaccuuagcuacaggcccccuuaccacucugugggaggguuccccagggaaguuuuggaauacgacaaucgccgugucuauggcgaacauauucagaggaucauaccucgccggcgcaggucuagcuuucagccugaugaaauccuugggcgggggaaggcgcggcaccggggcccagggagaaacucugggcgagaaguggaaacggcagcucaaucagcuuaguaagucugaauuuaacaccuauaagagaagcgguaucauggaggucgaccguucagaagcaaaagaggggcugaagaggggagagacaacuaaacacgcuguuucccggggcaccgccaaguugcgcugguucguggaacgaaaucuggucaaaccugaggguaaggugauugaucucggcugugggagaggaggcuggaguuacuauugcgccggguuaaagaaaguaacagaagugaagggauacacgaaaggcggucccgggcacgaggaaccgaucccaauggcgaccuacggauggaaccugguuaaacuucauagcggcaaagacguguuuuucauuccucccgagaagugugauacucugcuaugcgacaucggcgagucuuccccaaaucccacaauugaagaggggaggacccuccggguccugaaaaugguggaaccuugguugcgcggaaaccaauuuuguaucaagauacugaauccguauaugcccucagucguggagacucucgagcagaugcagagaaagcacgguggcaugcuuguuaggaacccacugagccgaaauucgacacaugaaauguacuggguaucuugcgggaccggaaacauugugagugcugucaauaugacgucccggauguuacugaaccguuucaccauggcacacagaaaaccuacauaugagcgcgauguggacuugggcgccgguacuaggcacguugcuguggaacccgaggucgccaaccucgauaucaucgggcagcggauugaaaauauaaagcaugagcacaaaagcaccuggcauuacgacgaggauaacccuuauaagacaugggcauaccacggaucauaugaagugaaaccauccggcucugccagcaguaugguaaauggcgugguuaagcugcuaacuaagcccugggacgucaucccuauggugacccaaauugcuaugacagauaccacuccauuugggcagcagagaguguucaaagagaaggucgacacgcgcacacccaaagcgaagaggggaaccgcccaaaucauggaaguuacugcaaaauggcuuugggguuuucugucccgaaacaagaagccgcggauuuguaccagagaggaguucacaaggaaagugcgcagcaaugcugccaucggcgcaguauuuguggacgagaaccaguggaacucugccaaggaggcugucgaagaugagcguuucugggaccucgugcaucgggaaagagagcugcacaaacaggggaagugcgccacgugcguuuacaacaugaugggaaaaagggaaaagaaguugggcgaguuugguaaagcgaaggggucacgcgcaauaugguacauguggcugggagcccgauuccucgaguucgaagcucuuggcuuuaugaaugaggaucacugguucagucgggaaaacucccugagcggcguggagggggagggauuacauaaacuggguuauaucuugagagacauuucuaagaucccuggcgggaauauguacgccgaugacaccgcaggaugggauacuaggauuacagaagacgaucuccagaacgaggcucgcaucaccgacauaauggaaccagagcacgcccugcuagcuaaaucgauuuuuaaacuuacuuaucaaaauaaagucgugagaguacagcggcccgccaagaacggcacaguuauggaugugaucucaaggcgugaccagcgagguagcgggcaggucggaaccuacggccugaauacauucacuaacauggaagcacaacucauccgccagauggaguccgagggcauuuuuaguccuucugaacuggagaccccaaacuuggcggaaagaguguuagauuggcuggagaaguaugggguggaacggcucaaaaggauggccauaagcggagacgacugugucguuaagcccaucgaugaccgcuucgcuacggcccuuaccgcacugaaugauauggguaaagugagaaaggacauuccgcagugggagccuuccaaaggcuggaacgauuggcagcaaguacccuuuugcucacaucacuuccaccagcuaaucaugaaggacgggcgggagauuguggucccauguaggaaucaggaugaacuggugggacgagcucguguuagucagggcgccgguuggucucucagagagacagcaugcuugggaaagagcuacgcccaaauguggcagcugauguauuuucaucgccgggaccuuaggcuggcggcuaacgccaucuguuccgcagugccugucgauuggauacccacuucaagaaccacauggagcauccacgcccaucaccaguggaugacuaccgaagacaugcucucuguguggaaucgcguauggauugaggaaaacccauggauggaggauaaaacgcauaucuccaguuggggagacguucccuacuuaggcaagcgggaggaccaauggugcggcagccugauuggguugacagcuagggccaccugggcaacuaauauccagguggcuauuaaccagguccgaagacugauaggaaaugaaaacuaccucgauuauaugacaucgaugaaacgguucaagaaugagggugacccugaaggcgcccuuugguga

SEQ ID NO: 14045 - RNA, 9879 nt, Artificial Sequence
  derived and/or modified CDS sequence (opt3) from DENV-1__EU482509__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacgcuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcgcagggaaacugguucaucagauauucggaaccgcguacggcguguuguuuuccggugucucuuggacuaugaagaucgggauuggcgugcuccugacaugguuaggacugaauagccgaucaaccagucuauccaugacauguaucgcuguaggccucgugacucuguaccuugggguuaugguccaggccgauagcggaugcgugaucaacuggaaaggccgcgaauugaagugugguucugggauuuucgugaccaaugagguccacacguggacagaacaauauaaguuucaggcagacucaccgaaaagacugagugccgcuauaggaaaggccugggaggagggcguuugcgguaucaggagcgcaacccggcucgaaaacauuauguggaaacagaucuccaacgagcugaaucauauuuuacuggaaaacgacaugaaguucacuguggugguaggcgaugucgcugggauccuugcccagggcaagaagaugauacgcccucaacccauggaguacaaauauucuuggaagucguggggcaaggcgaaaaucauuggggccgacgugcagaauaccacauuuaucauugauggaccaaacacuccugaaugucccgacgaucagagagcuuggaauaucugggagguugaggacuacggcuucgguauauuuaccacaaacauuugguugaagcucagggauagcuauacacaggugugcgaccaccgucugauguccgcagccaucaaagauucaaaggcuguccacgccgacaugggguacuggauugaaagugagaaaaaugaaaccuggaagcuagcacgggcgucuuucaucgaggugaagacuuguauauggccaaaaagccauacacugugguccaacggaguucucgaaucagagaugaucgugcccaagauuuauggcgguccuaucagccaacacaauuaccgaccaggcuacuucacccagacugccgggccguggcaucugggaaaacuugaguuggauuuugaccugugcgaaggcacaaccguagucguggaugagcacugcgggaacagaggacccucuuuaaggacgacuaccgugacaggcaagauuauccacgaaugguguugccgcuccuguacccucccuccacugcgguucagaggugaggacgggugcugguauggaauggagauaaggcccgucaaagaaaaggaggaaaaucuuguuaagaguauggugagcgcuggcucuggugagguagacuccuuuucacugggcuugcucuguauuaguaucaucauugaagaggugaugcgcagccgauggucgcggaaaaugcugaugacugggacacuagccgucuucuuucugcucaucaugggacagcugaccuggaacgaucuuauucguuugugcauaauggugggcgcaaaugcuuccgacagaauggggaugggaacaacuuaccuggccuuaauggcaaccuucaagaugaggccuauguuugccguuggccuccuguuccgccggcuuacgucuagagaggugcugcuacucacaaucggucugagcuuggucgcuucaguggaacugccaaacaguuuagaggaacucggggauggacuggcgaugggcauuaugauccuuaaacuguugaccgacuuucaaucccaucagcucugggccacucugcuaucucugaccuucauuaagacaacuuuuagccuucacuaugcauggaaaaccauggcuaugguucucuccaucgugucacuguuccccuugugucugagcacgacaagucagaagaccacuugguuaccgguccuccugggcucucuugggugcaagccucugacaauguuuuugauagccgagaauaaaaucuggggaaggcgauccuggccacucaacgaagguauuauggccguaggcaucgugagcauucugcuaucgucacugcuuaagaacgauguuccccucgcugggccucugaucgcaggaggcauguugauagccuguuacgugauuucugguaguuccgcggacuuaagccuggagaaagcugccgaggucucuugggaagaggaagcagagcauagcggggccucccacaauauccucguggaaguacaggaugacggaaccaugaagaucaaagaugaggagcgcgacgauacucugacaauucuucugaaggcuaccuugcuagcagugucaggcgucuauccccugaguauaccagccacacucuucguuugguacuucuggcagaagaagaagcagcggagcggcgugcugugggacacuccuucucccccagaaguggagagagcgguccuugaugacgggaucuauaggauuaugcagcguggauuacugggucgcucccaggugggcguugggguauuucaagaaaacguguuccauaccauguggcacgucacacggggagcugugcucauguaccagggcaaaagauuggagccgucaugggccaguguuaagaaagaccugaucagcuacggugggggauggaggcuccagggcuccuggaauaccggcgaggaagugcaggucauugcaguggagccugggaagaaccccaaaaauguacaaacagccccaggaacuuuuaagacccccgaaggugaggucggcgcuaucgcccuggauuucaagccugggacgucuggaucgccaauagugaaccgagaaggcaaaaucguuggucuuuaugggaauggaguggucacaacuagcggcaccuacgugucagcaauugcucaggccaaggcgucccaggagggcccccugccugagaucgaagacgagguuuuucggaaacgcaacuugacaauuauggaucuacacccggggaguggaaagaccagaagguaucugccagccaucgugcgggaagcaauaaaacgaaagcucagaacuuuaauucuggcucccacccgcgucguggccucugagauggcugaagcacuuaaggguaugccuaucagguaccaaacaacggccguaaaaagcgagcauacuggcaaggagaucguggaccugaugugccacgccaccuucacaaugcgucucuuguccccaguucggguccccaauuauaacaugauuaucauggaugaagcucauuuuaccgacccuucaucuauagcggcaagaggguacauuagcacuagggugggaaugggcgaggccgcugccaucuucaugacagcaaccccgcccgguaguguggaagccuuuccacaguccaaugcugucauucaggaugaggaacgcgacaucccugagcgaagcuggaacucuggguaugaguggauaacggauuuccccggaaaaacuguaugguuugugccaucaauuaaguccggcaaugacaucgcgaacugucugaggaaaaauggcaagcggguuauccagcucaguaggaagacauucgauaccgaauaccagaaaaccaagaacaacgacugggacuacguggucacuacagauauuagcgagaugggggccaauuuccgcgcagaccgugugaucgauccuagacggugccugaaacccguuauucuuaaggacggaccagaaagggugauacuagcugguccgaugccugucaccguggccucggcagcccagcgccgaggcagaaucgggcggaaccacaauaaagagggagaucaguauauuuacaugggccagccccugaacaaugacgaggaucaugcucacuggacagaagccaagauguuguuagacaacaucaauacuccagaggguaucauucccgcgcuguuugaaccugagagggaaaagucugcagccauagauggggaguaucgccucagaggcgaggcuaggaaaacguucguagaacugaugcggcguggagaccuuccaguguggcuguccuacaagguugccagcgagggcuuucaauauucagaucgccgauggugcuucgacggggaaagaaacaaucagguccucgaggaaaacauggauguggagaucuggaccaaagagggagaaaggaagaaauugcggccccgcuggcuggacgcuagaacauacagugacccucuagcacugagggaguuuaaggaguucgccgcuggucggcgaucuguguccggcgaucucauucuugagaucgggaaacugccgcagcacuuaacucagagagcccaaaaugcauuggacaaccuggucaugcuccauaauagcgaacagggaggccgcgcguauaggcacgccauggaggagcugccagauaccauugaaacacuuaugcugcucgcuuugaucgccguucugaccgguggggugacuuuauuuuuccuaucaggccggggacugggcaagacgaguauagggcuccuuuguguaauggcaagcuccgugcuguuguggauggcuucugucgagccccauuggaucgccgcaagcauuauccuggaauuuuuccucauggugcugcuuauuccugagcccgaccgucagagaaccccacaggauaaccaacucgccuacguugugaucggacuguuguuuaugauacugacagucgcugcgaaugagauggguuuacuagaaacuaccaagaaagaccugggcauugggcacguagccguggagaaccaccaucacgcagcuaugcucgauguugaccuucauccugccuccgccuggacacuguacgcaguggcuaccacuaucauuacacccaugaugaggcacacgaucgaaaacaccacugccaauauaucauugacagcgaucgcuaaccaggccgcaauucugaugggacucgauaagggcuggccaaucucuaaaauggacauuggugucccucugcuugccuuagggugcuauagucaggugaauccgcugacccucaccgcugcagucuugaugcugguggcccauuacgcgaucauaggccccggacuacaagcuaaggccacacgcgaggcacagaaacggacugccgcuggcauuaugaagaacccaacgguugaugggaucguggccaucgaccuggauccuguaguguaugacgcaaaguucgaaaaacagcucggacagauuaugcuucugaucuuguguaccucgcaaauacugcucaugcgaacaacuugggcucugugcgagagcauuaccuuagccacaggcccccuuaccacucugugggaggguuccccagggaaguuuuggaauacgacaaucgcggucucuauggccaacauuuucagaggaucauaccucgcaggcgcuggucuagccuucagccugaugaaauccuugggcgggggaaggcgcggcaccggggcacagggagaaacucugggcgagaaguggaaacggcagcucaaucagcuuaguaagucugaauuuaacaccuauaagagaagcgguaucauggagguugaccguucagaagcuaaagaggggcugaagaggggagagacaacuaaacacgccgugucccggggcaccgccaaguugcgcugguucgucgaacgaaaucuggugaaaccugaggguaagguaauagaucucggcugugggagaggaggcuggaguuacuauugcgcgggguuaaagaaagugacagaaguuaagggauacacgaaaggcggucccgggcacgaggaaccgaucccaauggcuaccuacggauggaaccuggugaaacuucauagcggcaaagacgucuuuuucauuccucccgagaagugugauacucugcuaugcgacaucggcgagucuuccccaaaucccacaauugaagaggggaggacccuccgggugcugaaaauggucgaaccuugguugcgcggaaaccaauuuuguaucaagauucugaauccguauaugcccucagugguugagacucucgagcagaugcagagaaagcacgguggcaugcuuguaaggaacccacugagccgaaauucgacacaugaaauguacugggugucuugcgggaccggaaacaucgucagugcagugaauaugacgucccggauguuacugaaccguuucaccauggcccacagaaaaccuacauaugagcgcgauguugacuugggcgcugguacuaggcacguggccgucgaacccgagguggcaaaccucgauauaauugggcagcggaucgaaaauaucaagcaugagcacaaaagcaccuggcauuacgacgaggauaacccuuauaagacaugggccuaccacggaucauaugaaguaaaaccauccggcucugcuagcaguauggugaauggcguugucaagcugcuaacuaagcccugggacgugauuccuauggugacccaaauagcgaugacagauaccacuccauuugggcagcagagagucuucaaagagaagguugacacgcgcacacccaaagccaagaggggaaccgcacaaaucauggaagugacugcuaaauggcuuugggguuuucugucccgaaacaagaagccgcggauuuguaccagagaggaguucacaaggaaaguacgcagcaaugccgcaaucggcgccguguuugucgacgagaaccaguggaacucugcuaaggaggccguggaagaugagcguuucugggaccucguucaucgggaaagagagcugcacaaacaggggaagugcgcgacgugcguguacaacaugaugggaaaaagggaaaagaaguugggcgaguuugguaaagcaaaggggucacgcgccauuugguacauguggcugggagcucgauuccucgaguucgaagcccuuggcuuuaugaaugaggaucacugguucagucgggaaaacucccugagcggcgucgagggggagggauuacauaaacuggguuauaucuugagagacauaucuaagaucccuggcgggaauauguacgcagaugacaccgcuggaugggauacuaggauuacagaagacgaucuccagaacgaggcccgcaucaccgacauuauggaaccagagcacgcucugcuagccaaaucgaucuuuaaacuuacuuaucaaaauaaagugguaagaguucagcggcccgcaaagaacggcacagugauggaugucauaucaaggcgugaccagcgagguagcggacaggugggaaccuacggccugaauacauucacuaacauggaagcgcaacucauucgccagauggaguccgagggcaucuuuaguccuucugaacuggagaccccaaacuuggccgaaagaguguuagauuggcuggagaaguauggggucgaacggcucaaaaggauggcuaucagcggagacgacuguguugugaagcccauugaugaccgcuucgccacggcacuuaccgcucugaaugauauggguaaaguaagaaaggacauaccgcagugggagccuuccaaaggcuggaacgauuggcagcaagugcccuuuugcucacaucacuuccaccagcuaaucaugaaggacgggcgggagauugucgugccauguaggaaucaggaugaacugguuggacgagcccgugugagucagggcgcagguuggucucucagagagacagccugcuugggaaagagcuacgcgcaaauguggcagcugauguauuuucaucgccgggaccuuaggcuggcugccaacgcaaucuguuccgccgucccuguggauuggauucccacuucaagaaccacauggagcauccacgcucaucaccaguggaugacuaccgaagacaugcucucuguauggaaucgcguuuggauagaggaaaacccauggauggaggauaaaacgcauaucuccaguuggggagacgugcccuacuuaggcaagcgggaggaccaauggugcggcagccugauuggguugacagccagggcaaccugggcuacuaauauccaggucgccauuaaccaggugcgaagacugaucggaaaugaaaacuaccucgauuauaugacaucgaugaaacgguucaagaaugagggugaaccugagggcgcgcuuugguga

SEQ ID NO: 14046 - RNA, 9879 nt, Artificial Sequence
  derived and/or modified CDS sequence (opt3) from DENV-1__EU482510__SS-prME
agcgugaccaugcugcucaugcuuaugcccacagcacuggcuuuccacuugacuacgcggggaggggagccucauaugaucgucuccaagcaggaaagaggaaaaucuuuacuguuuaagaccucagccgguguuaacaugugcacacugauugccauggaccucggagagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucagaacagaggugaccaacccugcaguccugaggaaacuuugcauugaagccaagaucucuaauacgaccacagauagccgguguccaacucaaggagaggcuacccugguugaagaacaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaaggacuggacuggacuucaacgaaaugguguugcuaacaaugaaggagaaauccuggcugguacauaagcagugguuucucgaucugccgcuucccuggacgucaggcgccagcaccagucaagagacuuggaaucggcaggaccuguugguuacauucaaaaccgcacacgcuaagaagcaggaaguggucgugcucgguucucaagagggggccaugcacacagcucugacuggcgccaccgaaauccagacguccggaaccacaacuauuuuugcaggccauuuaaaaugccgucugaagauggauaaacuaacccucaaggggaugagcuaugucauguguacaggaucguucaaacuggagaaggaaguggccgagacucagcacgguaccguucuugugcagauaaaguacgagggcacggacgcuccuugcaaaaucccauucucuacacaagaugggaagggaguaacccagaacggccgcuugauuacugcgaaucccaucgucacagacaaagaaaagccugugaacauagaggcagaaccacccuuuggugaguccuauauuguuaucggggccggcgagaaagcucugaagcucucaugguucaagaaaggaaguagcaucggcaagauguuugaagccaccgcaagaggggccaggcggauggcuauucugggagauacugccugggacuucgguuccaucggcgggguguuuaccucugucggaaaacuugugcaucagauuuucggcacagcauacgguguacuguuuagcggggugucauggacgaugaagauaggcaucggaguuuugcucaccuggcugggcuuaaauagucgauccacuagccugucuaugacauguauugcggucgggcuagugacccucuaccugggagugaugguccaggcugauucaggcugcguuaucaacuggaaaggucgcgagcuuaagugugggaguggaaucuucgugacaaaugaagugcacacuuggaccgagcaauauaaguuucaggccgacagcccgaaaagauuguccgcagccauuggcaaggcuugggaagaggguguaugcggcauaaggucugccacgcggcuggagaacaucauguggcgccagauuucgaacgaacucaaucauauccuguuagagaacgacaugaaauucacagucgugguuggggauguggucggcauucuggcacagggcaagaaaaugaucagaccucaacccauggaacacaaguacagcuggaaauccugggggaaggcuaagauaaucggagccgacgugcagaauaccacuuuuauuaucgauggcccaaacaccccugagugucccgacgaucagagggcguggaauauuugggaaguugaggacuaugguuucgggaucuuuacaacuaacauauggcuuaaauugcgugauucauacacccaggugugcgaccaccggcucaugagugccgcuauuaaggauucuaaagcaguacaugccgacaugggauauuggaucgagagcgaaaagaaugagacauggaaacuggcucgagccuccuucauugaagucaagacguguaucuggccaaagucacacacccuauggagcaacggcgugcuggagucugaaaugauaauccccaaaauuuacgguggcccuaucucccaacauaauuauagaccaggguacuucacucagacagcaggaccguggcaccucggcaagcuggagcuugauuuugacuugugcgaggggaccacuguggucguugaugaacacugcggaaacaggggccccagucugcgcacaaccacggugacugguaaaauuauccaugagugguguugccggagcuguaccuuaccuccacucagauucaagggggaagacggaugcugguacggcauggagauaaggcccguaaaagagaaggaagagaaucuggugaagucuauggucuccgcggguucaggcgaaguggacaguuuuagccuugggcuguuguguauuucgaucaugaucgaggaaguuaugcgcucccgauggucucggaaaaugcucaugacaggaacccuggccguguucuuucuacugauuaugggccagcucacuuggaacgaucugauccguagcugcauuauggucggggcuaaugccucagacagaaugggaaugggcacaaccuaucuugcauugauggcuacauucaagaugaggccuauguuugccgugggucuguuauuccgccggcucacaaguagagagguucugcuucugaccauagggcuaucccucguggcaucugucgagcugccaaacagcuuggaagaacugggagauggcuuagccaugggcaucaugauucucaaacugcuuacggacuuucaauccuaccagcugugggcuacauugcucucacugaccuucaucaagacuaccuuuagccuacacuaugcguggaaaacaauggccaugguacugaguauugugucucuucucccccuguguuuguccacuaccagccagaagacgacauggcugccgguuuuacucgggucgcugggaugcaagccucuuaccauguuccugaucgcagaaaauaaaauaugggguaggaagucauggccauugaacgagggcaucauggcuguggggauugucucuauccuccugaguucccuacugaaaaacgaugugccccuugccggaccucucauugccggcgguaugcugaucgcuuguuacguaauaagcgggucuagcgcagacuuguccuuagaaaaggccgcggaggugucaugggaggaagaggcugaacauaguggagccagccacaauauucuggucgagguucaggaugacggcacuaugaaaaucaaggaugaggaacgagacgauacacucaccauccugcuuaaagcaacucuguuggccgugucuggcguguauccccuauccauuccagcuacacuguuugucugguacuucuggcaaaagaagaaacagcgcucaggggugcucugggacaccccuagucccccagagguugaacgggcaguacuggaugacggaauauauagaaucaugcagaggggucuuuuaggccguagccaggugggggucggaguguuccaagagaacguuuuucauacgauguggcacgugacucgcggcgccguccugauguaccaggguaagcggcucgaaccguccugggcgucugugaaaaaggacuugauuucguacgggggaggcuggagacugcagggcagcuggaauaccggggaggagguacaggucaucgcuguggaaccuggcaaaaaucccaagaauguucaaacagccccagguaccuucaagacacccgagggcgaagugggggcaauugcccucgauuuuaaaccuggaacuucaggcuccccaaucgucaacagggaggguaagauaguggggcuguauggaaauggcguugugaccacgaguggcacauacgucucugcuaucgcccaggcaaaagcuagccaggaagggccccuuccugagauugaggacgaaguguuccgaaagcggaaccugacuaucauggauuugcacccgggauccgguaaaacccgcagauaucuaccagccauuguaagggaggcgaucaagcggaagcugcgaacacucauauuagcccccaccagagugguugcaucagaaauggcugaggcccugaaaggcaugccuauucgcuaccaaacuaccgcugucaagucugaacauacagggagggagaucguggaccuuaugugccacgcaacguuuacuaugcgucugcucagcccagugcggguccccaauuauaacaugaucauuauggaugaggcccauuucaccgacccuaguuccaucgccgcuagaggauacauaagcacaaggguaggcaugggugaagcggcagccauuuuuaugaccgcuacuccgcccgggucuguggaggccuucccacagucaaaugcaguuauccaggaugaggaacgcgacauuccugaacgauccuggaacaguggauaugaguggaucacagauuuucccggcaaaaccgugugguucgucccaagcauaaagucgggcaaugacauugccaacuguuugaggaaaaaugggaagcgggugauccagcugucuaggaagacguuugauacugaguaccagaaaacuaagaacaacgacugggacuacguugugaccaccgauaucuccgaaaugggagcuaauuuccgcgcggaccgugucauugauccuagacggugccucaaacccgugauccugaaggacgguccagagaggguaauucuugccggcccgaugccugugacuguugcaagcgcugcccaacgccgagggagaauaggacggaaccacaauaaagaaggcgaucaguauaucuacaugggucagccccuaaacaaugacgaggaucaugcacacuggacagaggccaagaugcuguuggacaacauuaauaccccagaagggaucauccccgcuuuauucgagccugaaagggagaagucagccgcgauugauggcgaauaucgccugagaggagaggcaaggaaaacauuugucgagcucaugcggcguggcgaccugccaguguggcuuaguuacaagguggccucugaaggguuccaauauuccgaucgccgauggugcuuugacggagagagaaacaaucagguccuggaagagaacauggauguugaaauauggacuaaagagggugagaggaagaaacuccggccccgcugguuggacgcuagaacguacagcgacccucuggcccuaagggaguucaaggaguuugcugcaggccggcgaucagugaguggggaucugauccucgaaauuggaaaacuuccgcagcaccugacccagagagcccaaaaugcuuuagacaacuugguaaugcugcauaauagcgagcagggcggucgcgccuauaggcacgcaauggaggaacucccagauacaaucgagacucugaugcuucuggcgcucauugccguguugaccgggggcgucacacuguucuuuuuauccggacggggccuagggaagaccucuaucggacugcucugugugauggcuagcuccgcccuucuguggauagcaucaguugaaccccauuggaucgcugccucuauuaucuuggaguucuuucugauggugcuccugauuccugaacccgaccgucagagaacuccacaggauaaccaacuugcauacgucguaaucggucuccuguucaugauauugacgguggccgcuaaugagaugggccuguuagagaccacaaagaaagaccuagggauuggacacguugcgguggaaaaccaccaucacgccacuaugcuggaugucgaccuccauccugcaagugcuuggacccuuuacgccguggccacaaccaucauuacucccaugaugaggcacacaaucgagaacacgaccgcaaauauaucgcugacugcuaucgccaaccaggcggcuauuuugaugggccuggauaaggguuggccaaucagcaaaauggacauuggggucccucuccuggcccuuggcugcuauucccaggugaauccguuaacacugaccgcagccguucucauguugguggcucauuacgcaaucauaggacccggccugcaagccaaggcgacccgcgaagcucagaaacggacagccgcagggauuaugaagaacccaacuguagauggaaucguggccaucgaccuagauccugucguuuaugacgcuaaguuugagaaacagcugggccagauuaugcuccuuauccuguguacgucucaaauauugcugaugcgaaccacaugggcccucugcgaaucaauuacucuggcaaccggucccuuaacaacccuuugggaggggagcccaggaaaguucuggaauacuacgaucgcuguguccauggccaacauuuuuagaggcaguuaccuggcgggugccggccucgcauucucucuaaugaaaagccuagggggaggcaggcgcgggacaggagcucagggcgagaccuugggugaaaaguggaaacggcagcugaaucagcucucaaaguccgaguucaacacuuauaagagaagugggaucauggaagucgaccguagcgaggccaaagaaggacuuaggcggggcgagaccacaaagcacgcagugucucgcgguacugcuaaacugcgaugguuuguagagagaaauuuggugaagccugaaggcaaaguuauagaucugggguguggaaggggcgggugguccuacuauugcgccggacucaagaaggugaccgaggucaaaggcuacacaaagggugggcccggacacgaggaaccgaucccaauggccacguacggcuggaacuuagugaaacugcauucaggcaaggacgucuucuuuauuccucccgaaaaaugugauacccuucugugcgacaucggggagagcucgccaaaucccacuauugaggaaggacggacacuacgcgugcucaagaugguugagccuuggcugagagguaaccaauucuguaucaaaauuuugaauccguauaugcccucuguaguggaaacccuggagcagaugcagaggaaguacggcgggaugcucguccgaaacccacuuaguagaaauuccacucacgagauguauugggugagcugcggaacaggcaacaucguuucagcggugaauaugaccucccguaugcuguuaaacagauuuacgauggcucaucgcaagccuaccuacgaaagggaugucgaccugggugcagggacacggcacguggccguagagcccgaaguggcuaacuuggauauaauuggacagagaaucgagaauaucaaacacgaacauaagucuacuuggcacuaugacgaggauaacccuuacaaaaccugggccuaucauggcagcuacgagguuaagccaaguggcuccgcaagcucuauggucaaugggguggugaaacuccugacaaagcccugggacgucauuccuaugguuacucaaauagccaugaccgauacaaccccauucggacagcagcgcguguuuaaggaaaaaguagacacuaggacgcccaaggcuaaacgagguacagcgcaaaucauggaggugaccgcccgguggcuauggggcuuccuuucaagaaacaagaaaccgaggauuuguacucgcgaagaguuuacccguaagguccggaguaaugcagcuaucggggccguguucguugacgaaaaccaguggaacuccgcaaaggaggccguggaggaugaaagauuuugggaccugguccacagggagcgcgaacuccauaaacagggaaagugcgcuacaugcguguacaacaugaugggcaaacgagagaagaaacugggugaguucgggaaggccaagggaagccgggcgauuugguauaugugguugggcgcaagauuucuggaguucgaggcccucggcuucaugaaugaagaucacugguuuucuagggagaacucgcuuucagggguagaaggagagggucugcacaaauuaggcuacauccugcgcgacauaagcaagaucccugggggaaauauguaugcugaugacacggccggcugggauaccagaauuacugaggacgauuugcagaacgaagcaaaaaucacagacauuauggagccagaacaugcucuccuggccaccuccaucuucaagcuaacuuaccaaaauaaaguugugcggguccagaggcccgcuaagaacgguacagugauggaugugauaagucgucgagaccagcgcgggucuggacaggucggcaccuauggccuuaauacauuuacuaacauggaggcccaacugauuagacagauggaaagcgaggggaucuucuccccuucagagcucgaaaccccaaaccuggcagagcggguuuuggauugguuagaaaaauacggaguggagaggcugaagcgcauggcgaucaguggugacgacuguguagugaagcccauugaugacagauuugccacggcucucaccgcccuuaaugauaugggcaaaguccggaaggacauaccgcagugggaaccuucuaaaggguggaacgauuggcagcaagugcccuucugcagccaccauuuucaccagcugaucaugaaggacggaagggagauuguugugccaugucgaaaucaggaugagcuagucggccgugcaagagugucccagggugcuggguggucacugcgcgaaacagccugccucggaaaaagcuaugcacaaauguggcaguugauguacuuccaccggagggaccugagacuugccgcgaacgcuaucuguucugccguaccuguugauugggugcccacuucccgcaccacauggaguauucaugcacaccaucaguggaugacuaccgaggacaugcugagcgucuggaaucggguguggaucgaagagaacccauggauggaagauaagacgcacauaucguccuggggcgacguucccuaccucggcaagagggaggaccaauggugcgggucuuuaaucggacugacagcccgagcuaccugggccacuaauauucagguggcaaucaaccaggucagacgguugauugguaaugagaacuaucuggauuacaugacaucaaugaaaagguuuaagaaugaaagcgacccugagggcgcucucugguga

SEQ ID NO: 14047 - RNA, 9879 nt, Artificial Sequence
  derived and/or modified CDS sequence (opt3) from DENV-1__EU482511__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaugucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagaucauucacgaaugguguugccgcaguuguacccucccuccacugcgguucagaggugaggacgggugcugguauggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgauggucccggaaaaugcugaugacugggacacuagcugucuucuuucugcucaucaugggacagcugaccuggaacgaucuuauucguuugugcaucauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauuggucugucauuggucgccaguguggaacugccaaacuccuuagaggaacucggggauggacuggcuaugggcauaaugauccuuaaacuguugaccgacuuucaaucucaucagcucugggcgacucugcuaagccugaccuucauuaagacaacuuuuucccuucacuaugccuggaaaaccauggcaaugguucucucaaucgugagccuguuccccuugugucugaguacgacaucucagaagaccacuugguuaccgguccuccugggcucccuugggugcaagccucugacaauguuuuugauugcugagaauaaaaucuggggaaggcgaagcuggccacucaacgaagguauaauggccguaggcaucgugucgauucugcuaucaucucugcuuaagaacgauguuccccucgccgggccucugaucgcuggaggcauguugauugcauguuacgugaucagugguuccagcgccgacuuaucucuggagaaagcggcugaggucagcugggaagaggaagccgagcauuccggggcaucacacaauauacucguggaaguacaggaugacggaaccaugaagauuaaagaugaggagcgcgacgauacucugacaauccuucugaaggccaccuugcuagcugugaguggcgucuauccccugagcaucccagcaacacucuucguuugguacuucuggcagaagaagaagcagcggucuggcgugcugugggacacuccuucacccccagaaguggagagagccguccuugaugacgggauuuauaggauaaugcagcguggauuacugggucgcagccaggugggcguugggguauuucaagaaaacguguuccauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacagcaccaggaacuuuuaagacccccgaaggugaggucggcgccaucgcucuggauuucaagccugggacgucgggaagcccaauugugaaccgagaaggcaaaaucguuggucuuuaugggaauggaguggucacaacuucaggcaccuacguguccgccauagcacaggcuaaggccagucaggagggcccccugccugagaucgaagacgagguuuuucggaaacgcaacuugacaauuauggaucuacacccggggucuggaaagaccagaagguaucugccagcgaucgugcgggaagccauuaaacgaaagcucagaacuuuaauccuggcacccacccgcgucguggcuagcgagauggccgaagcucuuaaggguaugccuauaagguaccaaacaacggcaguaaaauccgagcauacuggcaaggagauuguggaccugaugugccacgccaccuucacaaugcgucucuugucaccaguucggguccccaauuauaacaugaucaucauggaugaagcccauuuuaccgacccuucuagcauugcugcgagaggguacaucaguacuagggugggaaugggcgaggcagccgcuauauucaugacagccaccccgcccgguuccguggaagcauuuccacagagcaaugccgucauucaggaugaggaacgcgacaucccugagcgaucuuggaacucaggguaugaguggauuacggauuuccccggaaaaacuguaugguuugugccauccaucaagaguggcaaugacauagcuaacugucugaggaaaaauggcaagcggguuauucagcucagcaggaagacauucgauaccgaauaccagaaaaccaagaacaacgacugggacuacguggucacuacagauaucucggagaugggggcgaauuuccgcgccgaccgugugaucgauccuagacggugccugaaacccguuauucuuaaggacggaccagaaagggugauccuagcagguccgaugccugucaccguggcuucugccgcacagcgccgaggcagaauugggcggaaccacaauaaagagggagaucaguauauauacaugggccagccccugaacaaugacgaggaucaugcccacuggacagaagcuaagauguuguuagacaacaucaauacuccagaggguauuauccccgcccuguuugaaccugagagggaaaaguccgcggcaaucgauggggaguaucgccucagaggcgaggccaggaaaacguucguagaacugaugcggcguggagaccuuccaguguggcugagcuacaagguugcuucagagggcuuucaauauagugaucgccgauggugcuucgacggggaaagaaacaaucagguccucgaggaaaacauggauguggagauuuggaccaaagagggagaaaggaagaaauugcggccccgcuggcuggacgccagaacauacucugacccucuagcucugagggaguuuaaggaguucgcagccggucggcgauccgugagcggcgaucucauacuugagaucgggaaacugccgcagcacuuaacucagagagcucaaaaugccuuggacaaccuggucaugcuccauaauucagaacagggaggccgcgcauauaggcacgcgauggaggagcugccagauaccauugaaacacuuaugcugcucgccuugaucgcuguucugaccgguggggugacuuuauuuuuccuaaguggccggggacugggcaagacgagcauugggcuccuuuguguaauggccuccucugugcuguuguggauggcaagcgucgagccccauuggaucgcugccuccauaauccuggaauuuuuccucauggugcugcuuauuccugagcccgaccgucagagaaccccacaggauaaccaacucgcauacguugugaucggacuguuguuuaugauucugacagucgccgcuaaugagauggguuuacuagaaacuaccaagaaagaccugggcaucgggcacguagcgguggagaaccaccaucacgccgcaaugcucgauguugaccuucauccugcuucagccuggacacuguacgccguggcaaccacuauaauuacacccaugaugaggcacacgaucgaaaacaccacugcuaauauuucuuugacagccaucgcgaaccaggcugccauacugaugggacucgauaagggcuggccaaucaguaaaauggacauuggugucccucugcuugcauuagggugcuauagccaggugaauccgcugacccucaccgccgcugucuugaugcugguggcacauuacgccaucauuggccccggacuacaagcgaaggcuacacgcgaggcccagaaacggacugcagccggcaucaugaagaacccaacgguugaugggauaguggcuauugaccuggauccuguaguguaugacgccaaguucgaaaaacagcucggacagaucaugcuucugaucuuguguaccagccaaauucugcucaugcgaacaacuugggcacugugcgaguccaucaccuuagcuacaggcccccuuaccacucugugggaggguucuccagggaaguuuuggaauacgacaauagccgucucaauggcgaacauuuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguaucauggagguugaccguuccgaagcaaaagaggggcugaagaggggagagacaacuaaacacgcugugagucggggcaccgccaaguugcgcugguucgucgaacgaaaucuggugaaaccugaggguaagguaauugaucucggcugugggagaggaggcuggagcuacuauugcgccggguuaaagaaagugacagaaguuaagggauacacgaaaggcggucccgggcacgaggaaccgaucccaauggcgaccuacggauggaaccuggugaaacuucauucuggcaaagacgucuuuuucauaccucccgagaagugugauacucugcuaugcgacaucggcgaguccucaccaaaucccacaauugaagaggggaggacccuccgggugcugaaaauggucgaaccuugguugcgcggaaaccaauuuuguaucaagauucugaauccguauaugcccagcgugguugagacucucgagcagaugcagagaaagcacgguggcaugcuuguaaggaacccacugucgcgaaauucuacacaugaaauguacugggugaguugcgggaccggaaacaucgucuccgcugugaauaugacgagccggauguuacugaaccguuucaccauggcacacagaaaaccuacauaugagcgcgauguugacuugggcgccgguacuaggcacguggcugucgaacccgagguggccaaccucgauauuaucgggcagcggauagaaaauauuaagcaugagcacaaaucaaccuggcauuacgacgaggauaacccuuauaagacaugggcauaccacggauccuaugaaguaaaaccaucuggcagcgccaguuccauggugaauggcguugucaagcugcuaacuaagcccugggacgugaucccuauggugacccaaaucgcuaugacagauaccacuccauuugggcagcagagagucuucaaagagaagguugacacgcgcacacccaaagcgaagaggggaaccgcccaaauuauggaagugacugcaaaauggcuuugggguuuucugagccgaaacaagaagccgcggauauguaccagagaggaguucacaaggaaaguacgcucuaaugcugccaucggcgcaguguuugucgacgagaaccaguggaacucagccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggagucgcgcaauuugguacauguggcugggagcccgauuccucgaguucgaagcucuuggcuuuaugaaugaggaucacugguucucccgggaaaacagccugucuggcgucgagggggagggauuacauaaacuggguuauaucuugagagacauuucgaagaucccuggcgggaauauguacgccgaugacaccgcaggaugggauacuaggauaacagaagacgaucuccagaacgaggcucgcaucaccgacauuauggaaccagagcacgcccugcuagcuaaaucaaucuuuaaacuuacuuaucaaaauaaagugguaagaguucagcggcccgccaagaacggcacagugauggaugucauuagcaggcgugaccagcgagguuccggacaggugggaaccuacggccugaauacauucacuaacauggaagcacaacucauccgccagauggagagugagggcauauuuucuccuagcgaacuggagaccccaaacuuggcgaagagaguguuagauuggcuggaaaaauauggggucgagcggcucaagaggauggccauuuccggagacgacuguguugugaaacccaucgaugaccgcuucgcuacggcccuuaccgcacugaaugauauggguaagguaagaaaagacaucccgcagugggaaccuucaaagggcuggaacgauuggcagcaagugcccuuuugcagucaucacuuccaccagcuaauuaugaaggacgggcgggagauagucgugccauguaggaaucaggaugagcugguuggacgagcucgugugucucagggcgccgguuggagccucagagaaacagcaugcuuggggaaauccuacgcccaaauguggcagcugauguauuuucaucgccgggaccuuaggcuggcggcuaacgccaucuguucagcagucccuguggauuggauucccacuagcagaaccacauggucuauccacgcccaucaccaguggaugacuaccgaggacaugcucuccguauggaaucgcguuuggauugaagagaacccauggauggaagauaagacgcauaucaguagcuggggagacgugcccuacuuaggcaaacgggaggaccaauggugcggcucgcugauaggguugacagcuagggccaccugggcaacuaauauccaggucgcuauuaaccaggugcgaagacugaucggaaaugagaacuaccucgauuauaugacauccaugaagcgguucaaaaaugaaucugacccugagggugcccuuugguga

SEQ ID NO: 14048 - RNA, 9879 nt, Artificial Sequence
  derived and/or modified CDS sequence (opt3) from DENV-1__EU482513__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaauaaaauauggggaaggcgaagcuggccacucaacgaagguaucauggccguaggcauugugucgauccugcuaucaucucugcuuaagaacgauguuccccucgccgggccucugauugcuggaggcauguugaucgcauguuacgugauaagugguuccagcgccgacuuaucucuggagaaagcggcugaggucagcugggaagaggaagccgagcauuccggggcaucacacaauauucucguggaaguacaggaugacggaaccaugaagaucaaagaugaggagcgcgacgauacucugacaauccuucugaaggccaccuugcuagcugugaguggcgucuauccccugagcauuccagcaacacucuucguuugguacuucuggcagaagaagaagcagcggucuggcgugcugugggacacuccuucacccccagaaguggagagagccguccuugaugacgggauauauaggaucaugcagcguggauuacugggucgcagccaggugggcguugggguauuucaagaaaacguguuccauaccauguggcacgucacacggggagcggugcucauguaccagggcaaaagauuggagccgaguugggcuagcguuaagaaagaccugauuuccuacggugggggauggaggcuccagggcucuuggaauaccggcgaggaagugcaggucaucgccguggagccugggaagaaccccaaaaauguacaaacagcaccaggaacuuuuaagacccccgaaggugaggucggcgccauugcucuggauuucaagccugggacgucgggaagcccaaucgugaaccgagaaggcaaaauaguuggucuuuaugggaauggaguggucacaacuucaggcaccuacguguccgccaucgcacaggcuaaggccagucaggagggcccccugccugagauugaagacgagguuuuucggaaacgcaacuugacaaucauggaucuacacccggggucuggaaagaccagaagguaucugccagcgauugugcgggaagccaucaaacgaaagcucagaacuuuaauacuggcacccacccgcgucguggcuagcgagauggccgaagcucuuaaggguaugccuauuagguaccaaacaacggcaguaaaauccgagcauacuggcaaggagaucguggaccugaugugccacgccaccuucacaaugcgucucuugucaccaguucggguccccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccguggaagcauuuccacagagcaaugccgucauccaggaugaggaacgcgacauuccugagcgaucuuggaacucaggguaugaguggaucacggauuuccccggaaaaacuguaugguuugugccauccauaaagaguggcaaugacauugcuaacugucugaggaaaaauggcaagcggguuauccagcucagcaggaagacauucgauaccgaauaccagaaaaccaagaacaacgacugggacuacguggucacuacagauaucucggagaugggggcgaauuuccgcgccgaccgugugauugauccuagacggugccugaaacccguuauccuuaaggacggaccagaaagggugauucuagcagguccgaugccugucaccguggcuucugccgcacagcgccgaggcagaauagggcggaaccacaauaaagagggagaucaguauaucuacaugggccagccccugaacaaugacgaggaucaugcccacuggacagaagcuaagauguuguuagacaacauuaauacuccagaggguaucauccccgcccuguuugaaccugagagggaaaaguccgcggcaauugauggggaguaucgccucagaggcgaggccaggaaaacguucguagaacugaugcggcguggagaccuuccaguguggcugagcuacaagguugcuucagagggcuuucaauauagugaucgccgauggugcuucgacggggaaagaaacaaucagguccucgaggaaaacauggauguggagauauggaccaaagagggagaaaggaagaaauugcggccccgcuggcuggacgccagaacauacucugacccucuagcucugagggaguuuaaggaguucgcagccggucggcgauccgugagcggcgaucucauccuugagauugggaaacugccgcagcacuuaacucagagagcucaaaaugccuuggacaaccuggucaugcuccauaauucagaacagggaggccgcgcauauaggcacgcgauggaggagcugccagauaccaucgaaacacuuaugcugcucgccuugauugcuguucugaccgguggggugacuuuauuuuuccuaaguggccggggacugggcaagacgagcaucgggcuccuuuguguaauggccuccucugugcuguuguggauggcaagcgucgagccccauuggauagcugccuccaucauucuggaauuuuuccucauggugcugcuuaucccugagcccgaccgucagagaaccccacaggauaaccaacucgcauacguugugauuggacuguuguuuaugauccugacagucgccgcuaaugagauggguuuacuagaaacuaccaagaaagaccugggcauagggcacguagcgguggagaaccaccaucacgccgcaaugcucgauguugaccuucauccugcuucagccuggacacuguacgccguggcaaccacuauuaucacacccaugaugaggcacacgauugaaaacaccacugcuaauaucucuuugacagccauagcgaaccaggcugccauccugaugggacucgauaagggcuggccaauuaguaaaauggacaucggugucccucugcuugcauuagggugcuauagccaggugaauccgcugacccucaccgccgcugucuugaugcugguggcacauuacgccauuaucggccccggacuacaagcgaaggcuacacgcgaggcccagaaacggacugcagccggcauaaugaagaacccaacgguugaugggauuguggcuaucgaccuggauccuguaguguaugacgccaaguucgaaaaacagcucggacagaucaugcuucugauuuuguguaccagccaaauccugcucaugcgaacaacuugggcacugugcgaguccauaaccuuagcuacaggcccccuuaccacucugugggaggguucuccagggaaguuuuggaauacgacaauugccgucucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauuauggagguugaccguuccgaagcaaaagaggggcugaagaggggagagacaacuaaacacgcugugagucggggcaccgccaaguugcgcugguucgucgaacgaaaucuggugaaaccugaggguaagguaaucgaucucggcugugggagaggaggcuggagcuacuauugcgccggguuaaagaaagugacagaaguuaagggauacacgaaaggcggucccgggcacgaggaaccgauaccaauggcgaccuacggauggaaccuggugaaacuucauucuggcaaagacgucuuuuucaucccucccgagaagugugauacucugcuaugcgacauuggcgaguccucaccaaaucccacaaucgaagaggggaggacccuccgggugcugaaaauggucgaaccuugguugcgcggaaaccaauuuuguauuaagauccugaauccguauaugcccagcgugguugagacucucgagcagaugcagagaaagcacgguggcaugcuuguaaggaacccacugucgcgaaauucuacacaugaaauguacugggugaguugcgggaccggaaacauugucuccgcugugaauaugacgagccggauguuacugaaccguuucaccauggcacacagaaaaccuacauaugagcgcgauguugacuugggcgccgguacuaggcacguggcugucgaacccgagguggccaaccucgauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcugcuaacuaagcccugggacgugaucccuauggugacccaaauugcuaugacagauaccacuccauuugggcagcagagagucuucaaagagaagguugacacgcgcacacccaaagcgaagaggggaaccgcccaaauaauggaagugacugcaaaauggcuuugggguuuucugagccgaaacaagaagccgcggaucuguaccagagaggaguucacaaggaaaguacgcucuaaugcugccauuggcgcaguguuugucgacgagaaccaguggaacucagccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcgucgagggggagggauuacauaaacuggguuauauuuugagagacaucucgaagauaccuggcgggaauauguacgccgaugacaccgcaggaugggauacuaggaucacagaagacgaucuccagaacgaggcucgcauuaccgacaucauggaaccagagcacgcccugcuagcuaaaucaauuuuuaaacuuacuuaucaaaauaaagugguaagaguucagcggcccgccaagaacggcacagugauggaugucaucagcaggcgugaccagcgagguuccggacaggugggaaccuacggccugaauacauucacuaacauggaagcacaacucauacgccagauggagagugagggcauauuuucuccuagcgaacuggagaccccaaacuuggcggaaagaguguuagauuggcuggagaaguauggggucgaacggcucaaaaggauggccaucuccggagacgacuguguugugaagcccaucgaugaccgcuucgcuacggcccuuaccgcacugaaugauauggguaaaguaagaaaggacauuccgcagugggagccuucaaaaggcuggaacgauuggcagcaagugcccuuuugcagucaucacuuccaccagcuaauaaugaaggacgggcgggagaucgucgugccauguaggaaucaggaugaacugguuggacgagcucgugugucucagggcgccgguuggagccucagagagacagcaugcuuggggaaguccuacgcccaaauguggcagcugauguauuuucaucgccgggaccuuaggcuggcggcuaacgccauuuguucagcagucccuguggauuggauccccacuagcagaaccacauggucuauucacgcccaucaccaguggaugacuaccgaagacaugcucuccguauggaaucgcguuuggaucgaggaaaacccauggauggaggauaaaacgcauauaaguagcuggggagacgugcccuacuuaggcaagcgggaggaccaauggugcggcucgcugaucggguugacagcuagggccaccugggcaacuaauauucaggucgcuaucaaccaggugcgaagacugauuggaaaugaaaacuaccucgauuauaugacauccaugaaacgguucaagaaugagucugacccugaaggugcccuuugguga

SEQ ID NO: 14049 - RNA, 9879 nt, Artificial Sequence
  derived and/or modified CDS sequence (opt3) from DENV-1__EU482515__SS-prME
agcgugaccacacugcucaugcuuaugcccacugcccuggcuuuccacuugacgaccagaggaggggaaccucauaugaucgucuccaagcaggaaaggggaaaaucuuuacuguuuaagacaucagccgguguuaauaugugcacuuuaauugccauggaccucggcgagcugugugaagauaccaugacauacaaaugcccacggauaaccgagacugaaccggacgauguggacuguuggugcaaugcgacagauaccuggguaacguaugggacuuguagucaaaccggagagcaccgccgagacaagcguagcguggcucuugcaccccaugucggccuggguuuggagacaagaacugaaaccuggauguccucugagggggcauggaaacagauccagaggguggaaacaugggcccuccggcacccuggauucaccguuauugcucuguuucuggcacaugccaucggcacgucgauuacucagaagggcaucauauucauccucuuaaugcuggugacaccaucaauggcuaugcgcugcgucgggauuggaagcagagauuuuguggagggucuuaguggcgccaccuggguagacguuguguuggagcacggguccugugucacuacaauggcgaaggauaaacccacccuggacaucgaacugcucaagacggaggugaccaacccugcagugcugaggaaacuuugcauugaagccaagaucucuaauacaacuaccgauagccgguguccaacacaaggagaggcuacucuggucgaagaacaggacgccaacuucguuugccgccgaaccuuuguggauagaggcugggguaauggguguggauuguucggcaaaggcucccucauaacaugcgcaaaguuuaagugcguaaccaaacuggaggggaagauugugcaguacgaaaacuuaaaauauucagucaucgugacuguucacacgggagaccagcaucaaguggguaaugagaguacagaacacggcaccacugcuaccauuacaccccaggccccuaccacugagauccagcugacagacuacggggcgcucacgcuugauuguagcccaaggaccggacuggacuucaacgaaauggucuugcuaacuaugaaggagaaaucuuggcuggugcauaagcagugguuucucgaucugccgcuucccuggacauccggcgccucaaccagccaagagacauggaaucggcaggaccuguugguaacuuucaaaaccgcacacgcuaagaagcaggaaguugugguccucgguagucaagagggggccaugcacacggcucugaccggcgccacagaaauccagacuucuggaaccacaacuauuuuugcaggccauuuaaaaugccgucugaagauggauaaacuaacccucaaggggauguccuaugugauguguacggggucguucaaacuggagaaggaacuugccgagacacagcacgguaccgucuuggugcagauaaaguacgagggcacugacgcuccuugcaaaaucccauucucgacacaagaugaaaaggggguuacccagaacggacgccugauuacugcgaaucccaucgugaccgacaaagagaagccuguaaacauagaagcagagccacccuuuggcgagucuuauauugucaucggugccggggaaaaagcucucaagcuguccugguucaagaaaggcucaaguaucggaaagauguuugaggccacagcaagaggcgccaggcggauggcuauucuuggggauacggccugggacuucggaagcaucgguggcguguuuaccuccguugggaaacuggugcaucagauuuucggaacugcauacggcgucuuguuuucuggugugagcuggacaaugaagauagggaucggcguacuccugaccugguuaggacuaaauucacgaaguacaucccuaagcaugacuuguauugcggugggccucguuacccuguaccuuggggucauggugcaggcugauucuggaugcgugaucaacuggaaaggccgcgaauugaagugugguucagggaucuucgucacgaaugagguucacacauggaccgaacaauauaaguuucaggccgacaguccgaaaagacugagcgcagccauuggaaaggcuugggaggagggcgugugcgguauaagguccgccacucggcucgaaaacaucauguggaaacagauuucuaacgagcugaaucauaucuuacuggaaaacgacaugaaguucaccgugguagucggcgauguggcagggauucuugcucagggcaaaaagaugauccgcccucaacccauggaguacaaauauucguggaaaagcuggggcaaggccaaaauaaucggggcggacguucagaauacaacuuuuauuaucgauggaccaaacaccccugaaugucccgacgaucagagagccuggaauauuugggagguggaggacuacggcuucgguaucuuuacaacgaacauaugguugaagcucagggauuccuauacccaggucugcgaccaccgucugaugucagcugcaauuaaagauaguaaggccgugcacgcugacaugggguacuggaucgaaucugagaaaaaugaaacuuggaagcuagcccgggcauccuucauugagguuaagacauguaucuggccaaaaucccauacccuguggucaaacggagugcucgaaagcgagaugauaauccccaagauuuauggcgguccuaugucucaacacaauuaccgaccaggcuacuucacucagacagcggggccguggcaucugggaaaacuugaguuggauuuugaccugugcgaaggcaccacgguagucguggaugagcacugcgggaacagaggacccuccuuaaggacuaccacagugaccggcaagaucauucacgaaugguguugccgcaguuguacucucccuccacugcgguucagaggugaggacgggugcugguauggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgaugguccaaaaagaugcugaugacagggacccuagcugucuucuuucugcucaucaugggacagcugacauggaacgaucuuauucgguugugcaucauggugggcgccaaugcaucugaccguauggggaugggaacuaccuaccuggcuuuaauggccacguucaaaaugagaccuauguuugcaguuggccuccuguucaggcgccuuacaagccgggaggugcugcuacucaccauuggucugucauuggucgccaguguggaacugccaaacuccuuagaggaacucggggauggacuggcuaugggcauaaugauccuuaagcuguugacugacuuucaaucucaucagcucugggcgacccugcuaagccugacauucauuaaaacuaccuuuucccuucacuaugccuggaagacgauggcaaugguucucucaaucgugagccuguuccccuugugucugaguacaaccucucagaagacuacaugguuaccgguccuccugggcucccuugggugcaaaccucugaccauguuuuugauugcugagaauaagaucuggggaagaaggagcuggccacucaacgaagguauaauggccguaggcaucgugucgauucugcuaucaucucugcuuaaaaacgauguuccccucgccgggccucugaucgcuggaggcauguugauugcauguuacgugaucagugguuccagcgccgacuuaucucuggagaaggcggcugaggucagcugggaagaggaagccgagcauuccggggcaucacacaauauacucguggaaguacaggaugacggaacuaugaaaauuaaggaugaggagcgagacgauacacugaccauccuucugaaagccacguugcuagcugugaguggcgucuauccccugagcaucccagcaacucucuucguuugguacuucuggcaaaagaagaaacagcgcucuggcgugcugugggacaccccuucacccccagaaguggagcgggccguccuugaugacgggauuuauagaauaaugcagaggggauuacugggucguagccaggugggcguugggguauuucaagaaaacguguuccauacaauguggcacgucacccgcggagcggugcucauguaccagggcaagcgguuggagccgaguugggcuagcguuaaaaaggaccugaucuccuacggugggggauggagacuccagggcucuuggaauacaggcgaggaagugcaggucauugccguggagccugggaaaaaccccaagaauguacaaacugcaccaggaaccuuuaagacgcccgaaggugaggucggcgccaucgcucuggauuucaaaccugggacaucgggaagcccaauugugaacagggaaggcaagaucguuggucuuuaugggaauggaguggucacuaccucaggcacauacguguccgccauagcacaggcuaaagccagucaggagggcccccugccugagaucgaagacgagguuuuucgaaagcggaacuugaccauuauggaucuacacccggggucuggaaaaacucgcagauaucugccagcgaucgugagggaagccauuaagcggaagcuccgaaccuuaauccuggcacccacaagagucguggcuagcgagauggccgaagcucuuaaagguaugccuauacgcuaccaaacgacugcaguaaaguccgagcauaccggcaaagagauuguggaccugaugugccacgccacauucaccaugaggcucuugucaccaguucguguccccaauuauaacaugaucaucauggaugaagcccauuuuacugacccuucuagcauugcugcgcggggguacaucaguacaagagugggaaugggcgaggcagccgcuauauucaugaccgccacgccgcccgguuccguggaagcauuuccacagagcaaugccgucauucaggaugaggaaagggacaucccugagcgcucuuggaacucaggguaugaguggauuacugauuuccccggaaagacaguaugguuugugccauccaucaaaaguggcaaugacauagcuaacugucugcgaaagaauggcaagagaguuauucagcucagccggaaaaccuucgauaccgaauaccaaaagacuaaaaacaacgacugggacuacguggucacaaccgauaucucggagaugggggcgaauuucagggccgaccgcgugaucgauccucguagaugccugaagcccguuauucuuaaagacggaccagaacgggugauccuagcagguccgaugccugucacaguggcuucugccgcacagaggcgcggccgaauugggagaaaccacaauaaggagggagaucaguauauauacaugggccagccccugaacaaugacgaggaucaugcccacuggacugaagcuaagauguuguuagacaacaucaauacgccagaggguauuauccccgcccuguuugaaccugagcgggaaaaauccgcggcaaucgauggggaguauaggcuccgcggcgaggccagaaagaccuucguagaacugaugaggcggggagaccuuccaguguggcugagcuacaaaguugcuucagagggcuuucaauauagugaucgucgcuggugcuucgacggggaacgaaacaaucagguccucgaggaaaacauggauguggagauuuggacaaaggagggagaaaggaaaaaguugaggccccgguggcuggacgcccgcacuuacucugacccucuagcucugagagaguuuaaagaguucgcagccgguaggcgguccgugagcggcgaucucauacuugagaucgggaagcugccgcagcacuuaacccagcgagcucaaaaugccuuggacaaccuggucaugcuccauaauucagaacagggaggcagagcauaucgccacgcgauggaggagcugccagauacaauugaaacccuuaugcugcucgccuugaucgcuguucugacugguggggugacguuauuuuuccuaaguggcaggggacugggcaagaccagcauugggcuccuuuguguaauggccuccucugugcuguuguggauggcaagcgucgagccccauuggaucgcugccuccauaauccuggaauuuuuccucauggugcugcuuauuccugagcccgaccggcagcguacaccacaggauaaccaacucgcauacguugugaucggacuguuguuuaugauucugacugucgccgcuaaugagauggguuuacuagaaaccaccaaaaaggaccugggcaucgggcacguagcgguggagaaccaccaucacgccgcaaugcucgauguugaccuucauccugcuucagccuggacccuguacgccguggcaacuacaauaauuacgcccaugaugagacacaccaucgaaaacacuacagcuaauauuucuuugaccgccaucgcgaaccaggcugccauacugaugggacucgauaaaggcuggccaaucaguaagauggacauuggugucccucugcuugcauuagggugcuauagccaggugaauccgcugacccucacagccgcugucuugaugcugguggcacauuacgccaucauuggccccggacuacaagcgaaagcuacuagggaggcccagaagcgcacggcagccggcaucaugaagaacccaaccguugaugggauaguggcuauugaccuggauccuguaguguaugacgccaaauucgaaaagcagcucggacagaucaugcuucugaucuuguguacaagccaaauucugcucaugcggacuaccugggcacugugcgaguccaucacauuagcuaccggcccccuuacuacgcugugggaggguucuccagggaaauuuuggaauacaaccauagccgucucaauggcgaacauuuuccgaggaagcuaccucgccggcgcaggucuagcuuucucccugaugaagaguuugggcgggggaagaaggggcacuggggcccagggagaaacccugggcgagaaauggaagcgccagcucaaucagcuuucuaagagcgaauuuaacacauauaaacggucagguaucauggagguugacagauccgaagcaaaggaggggcugaaacguggagagacuaccaagcacgcugugaguaggggcacagccaaauugcggugguucgucgaacgcaaucuggugaagccugaggguaagguaauugaucucggcugugggcgaggaggcuggagcuacuauugcgccgggcuaaagaaggugacggaaguuaaaggauacaccaagggcggucccgggcacgaggaaccgaucccaauggcgacuuacggauggaaccuggugaaacuucauucuggcaaggacgucuuuuucauaccucccgagaaaugugauacacugcuaugcgacaucggcgaguccucaccaaaucccaccauugaagaggggagaacucucagggugcugaagauggucgaaccuugguugcggggaaaccaauuuuguaucaagauucugaauccguauaugcccagcgugguugagacacucgagcagaugcagcgcaaacacgguggcaugcuuguaagaaacccacugucgagaaauucuacccaugaaauguacugggugaguugcgggacgggaaacaucgucuccgcugugaauaugaccagccgaauguuacugaaccgguucacaauggcacaccguaagccuacuuaugagagagauguugacuugggcgccgguacccgccacguggcugucgaacccgagguggccaaccucgauauuaucgggcagaggauagaaaauauuaaacaugagcacaagucaacauggcauuacgacgaggauaacccuuauaaaacuugggcauaccacggauccuaugaaguaaagccaucuggcagcgccaguuccauggugaauggcguugucaagcugcuaaccaaacccugggacgugaucccuauggugacacaaaucgcuaugaccgauacuacgccauuugggcagcagcgggucuucaaggagaaaguugacacaagaacccccaaggcgaaacgcggaacugcccaaauuauggaagugaccgcaaaguggcuuugggguuuucugagcaggaacaagaaaccgcgaauauguacacgggaggaguucacgagaaagguaaggucuaaugcugccaucggcgcaguguuugucgacgagaaccaguggaacucagccaaagaggcuguggaagaugagcgcuucugggaccucguucaucgugaacgggagcugcacaagcaggggaaaugcgccacaugcguguacaacaugaugggaaagagagaaaagaaauugggcgaguuugguaaggcgaaagggaguagggcaauuugguacauguggcugggagcccgcuuccucgaguucgaagcucuuggcuuuaugaaugaggaucacugguucucccgagaaaacagccugucuggcgucgagggggagggauuacauaagcuggguuauaucuugcgggacauuucgaaaaucccuggcgggaauauguacgccgaugacacugcaggaugggauacaagaauaaccgaagacgaucuccagaacgaggcuaggaucacugacauuauggaaccagagcacgcccugcuagcuaagucaaucuuuaaacuuacauaucaaaauaaggugguacgcguucagagacccgccaagaacggcaccgugauggaugucauuagccggagggaccagcgugguuccggacaggugggaacauacggccugaauacuuucaccaacauggaagcacaacucauccgacagauggagagugagggcauauuuucuccuagcgaacuggagacgccaaacuuggcgaaacgcguguuagauuggcuggaaaaguauggggucgagagacucaaacggauggccauuuccggagacgacuguguugugaagcccaucgaugacagguucgcuaccgcccuuacagcacugaaugauauggguaaaguacgcaaggacaucccgcagugggaaccuucaaagggcuggaacgauuggcagcaagugcccuuuugcagucaucacuuccaccagcuaauuaugaaagacgggagagagauagucgugccaugucggaaucaggaugagcugguuggaagggcucgagugucucagggcgccgguuggagccuccgugaaacugcaugcuuggggaaguccuacgcccaaauguggcagcugauguauuuucauagacgcgaccuucggcuggcggcuaacgccaucuguucagcagucccuguggauuggauucccaccagcaggacaacuuggucuauccacgcccaucaccaguggaugaccacggaggacaugcucuccguauggaauagaguuuggauugaagagaacccauggauggaagauaaaacacauaucaguagcuggggagacgugcccuacuuaggcaagcgcgaggaccaauggugcggcucgcugauaggguugaccgcucgggccacuugggcaacaaauauccaggucgcuauuaaccaggugaggcgacugaucggaaaugagaacuaccucgauuauaugaccuccaugaaaagauucaagaaugaaucugacccugagggugcccuuugguga

SEQ ID NO: 14050 - RNA, 9879 nt, Artificial Sequence
  derived and/or modified CDS sequence (opt3) from DENV-1__EU482516__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacucugucccuucacuaugccuggaaaaccauggcaauggugcucucaauugucagccuguuucccuugugucugaguacgacaucucagaagaccacuugguuaccgguacuccugggcucccuugggugcaagccucugacaauguucuugaucgcugagaauaaaauauggggaaggcgaagcuggccacucaacgaagguaucauggccgugggcauuguuucgauccugcuaucaucucugcuuaagaacgaugugccccucgccgggccucugauugcuggaggcauguugaucgcauguuacgucauaagugguuccagcgccgacuuaucucuggagaaagcggcugaggugagcugggaagaggaagccgagcauuccggggcaucacacaauauucucguagaagugcaggaugacggaaccaugaagaucaaagaugaggagcgcgacgauacucugacaauccuucugaaggccaccuugcuagcugucaguggcguuuauccccugagcauuccagcaacgcucuuugugugguacuucuggcagaaaaagaagcagcggucuggcgugcugugggacacuccuucacccccagaagucgggagagccgugcuugaugacggaauauauaggaucaugcagcgugguuuacugggccgcagccagguugggguaggaguguuccaagagaacgucuuucauaccauguggcacgugacacggggcgcgguucucauguaccaggguaaaagauuggaaccgaguugggcuagcgugaagaaagaccugauuuccuacgggggaggcuggaggcuccagggcucuuggaauaccggggaggagguccaggugaucgccguagaaccuggaaagaaccccaaaaauguccaaacagcaccagguacuuucaagacccccgagggcgaagugggggccauugcucuggauuuuaagccuggaacgucgggcagcccaaucguuaaccgagaggguaaaauaguggggcuuuauggaaauggcgucgugacaacuucaggcaccuacguuuccgccaucgcacaggcuaaggccagucaggaagggccccugccugagauugaggacgaaguguuccggaaacgcaacuugacaaucauggaucuacacccgggaucugguaagaccagaagguaucugccagcgauuguccgggaggccaucaaacgaaagcucagaacuuuaauacuggcacccacccgcgugguagcuagcgaaauggccgaggcucuuaagggcaugccuauuagguaccaaacaacggcagugaaauccgaacauacugggaaggagaucguugaccugaugugccacgccaccuuuacaaugcgucucuugucaccaguccgggugcccaauuauaacaugaucauuauggaugaggcccauuucaccgacccuucuagcaucgcugcgagaggauacauaaguacuagggugggcaugggugaagcagccgcuauuuuuaugacagccaccccgcccggguccgucgaggcauucccacagagcaaugccguaauccaggaugaagaacgcgacauuccugaacgaucuuggaacucaggauaugaguggaucacggauuuucccggcaaaacugugugguucguuccauccauaaagaguggcaaugacauugcuaacugucugaggaaaaaugggaagcgggugauccagcucagcaggaagacauuugauaccgaguaccagaaaaccaagaacaacgacugggacuacgucgugacuacagauaucucggaaaugggagcgaauuuccgcgccgaccguguuauugauccuagacggugccugaaacccgugauccuuaaggacgguccagagagggucauucuagcaggcccgaugccugugaccguagcuucugccgcacagcgccgagggagaauaggacggaaccacaauaaagaaggcgaucaguauaucuacaugggucagccccugaacaaugacgaggaucaugcccacuggacagaggcuaagauguuguuagacaacauuaauacuccagaagggaucauccccgcccuguucgagccugaaagggagaaguccgcggcaauugauggcgaauaucgccucagaggagaggccaggaaaacguuuguggagcugaugcggcguggcgaccuuccaguuuggcugagcuacaaggucgcuucagaaggguuccaauauagugaucgccgauggugcuuugacggagagagaaacaaucaggugcucgaagagaacauggauguggaaauauggaccaaagagggugagaggaagaaauugcggccccgcuggcuggacgccagaacauacucugacccucuagcucugagggaguucaaggaguuugcagccggccggcgauccgucagcggggaucucauccuugaaauuggaaaacugccgcagcacuuaacucagagagcucaaaaugccuuggacaaccugguuaugcuccauaauucagagcagggcggucgcgcauauaggcacgcgauggaggaacugccagauaccaucgagacacuuaugcugcucgccuugauugcugugcugaccgggggcguaacuuuauucuuucuaaguggacggggccuggggaagacgagcaucggacuccuuugugugauggccuccucuguccuguuguggauggcaagcguggaaccccauuggauagcugccuccaucauucuggaguucuuucucaugguucugcuuaucccugaacccgaccgucagagaaccccacaggauaaccaacucgcauacguggucauuggucuguuguucaugauccugacaguagccgcuaaugagaugggcuuacuagagacuaccaagaaagaccuggggauaggacacguggcgguugaaaaccaccaucacgccgcaaugcucgauguggaccuucauccugcuucagccuggacacuguacgccgucgcaaccacuauuaucacacccaugaugaggcacacgauugagaacaccacugcuaauaucucuuugacagccauagcgaaccaggcugccauccugaugggccucgauaaggguuggccaauuaguaaaauggacaucggggugccucugcuugcauuaggcugcuauucgcaggucaauccgcugacccucaccgccgcuguguugaugcugguugcacauuacgccauuaucggacccggccuacaagcgaaggcuacacgcgaagcccagaaacggacugcagccgggauaaugaagaacccaacgguggauggaauuguagcuaucgaccuggauccuguggucuaugacgccaaguuugagaaacagcucggccagaucaugcuucugauuuuguguaccagccaaauccugcucaugcgaacaacuugggcacugugcgaauccauaaccuuagcuacagguccccuuaccacucugugggaggggucuccaggaaaguucuggaauacgacaauugccguuucaauggcgaacaucuuuagaggcagcuaccucgccggugcaggccuagcuuucucccugaugaaaagucuagggggaggcaggcgcgggaccggagcccagggcgagacucugggugaaaaguggaaacggcagcucaaucagcuuucuaagagcgaguucaacaccuauaagagaucagggauuauggaaguggaccguuccgaggcaaaagaaggacugaagaggggcgagacaacuaaacacgcugucagucgggguaccgccaaguugcgcugguuuguggagcgaaaucugguaaaaccugaaggcaaggugaucgaucucggguguggaagaggcggguggagcuacuauugcgccggauuaaagaaaguuacagaggugaagggcuacacgaaaggugggcccggacacgaggaaccgauaccaauggcgaccuacggcuggaaccuggucaaacuucauucuggcaaagacguguucuuuaucccucccgaaaagugugauacucugcuaugcgacauuggggaguccucaccaaaucccacaaucgaggaaggaaggacccuccggguccugaaaaugguggagccuugguugcgcgguaaccaauucuguauuaagauccugaauccguauaugcccagcguuguagaaacucucgagcagaugcagagaaagcacggcgggaugcuugugaggaacccacugucgcgaaauucuacacaugagauguacugggucaguugcggaaccggcaacauuguguccgcuguuaauaugacgagccggauguuacugaaccguuuuaccauggcacacagaaaaccuacauaugaacgcgauguggacuugggugccgggacuaggcacgucgcuguggagcccgaaguagccaaccucgauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcugcuaacuaagcccugggacgugaucccuauggucacccaaauugcuaugacagauaccacuccauucggacagcagagaguuuuuaaagaaaagguggacacgcgcacacccaaagcgaagagggguaccgcccaaauaauggagguaacugcaaaauggcuuuggggcuuccugagccgaaacaagaagccgcggaucuguaccagagaagaguuuacaaggaaagugcgcucuaaugcugccauuggggcagucuucguggacgaaaaccaguggaacucagccaaggaggcuguugaggaugaacguuuuugggaccucgugcaucgggagagagaacugcacaaacagggaaagugcgccacgugcgucuacaacaugaugggcaaaagggagaagaaguugggugaguucgggaaagcgaagggaagucgcgcaaucugguacauguggcugggcgcccgauuucucgaguucgaggcucuuggcuucaugaaugaagaucacugguuuucccgggagaacagccugucugggguggaaggagaggguuuacauaaacugggcuauauuuugagagacaucucgaauauaccugggggaaacauguacgccgaugacaccgcaggcugggauacuaggaucacagaggacgaucuccagaaugaagcucgcauuaccgacaucauggagccagaacacgcccugcuagcuaagucaauuuucaaacuuacuuaucaaaacaagguaguuagagugcagcggcccgccaaaaaugguacagucauggaugugaucagcaggcgugaccagcgaggguccggacaggugggcaccuacggccugaacacauuuacuaacauggaggcacaacucauacgccagauggaaagugaggggauuuucucuccuagcgagcuggaaaccccaaauuuggcggagagagucuuagauuggcuggaaaaguauggaguugagcggcucaagaggauggccaucuccggugacgacugugugguaaaacccaucgaugaccgcuuugcuacggcccuuaccgcacugaacgauaugggcaaggugagaaaagacauuccgcagugggaaccuucaaagggguggaaugauuggcagcaaguccccuucugcagucaucacuuucaccagcuaauaaugaaagacggacgggagaucgugguuccauguaggaaccaggaugagcuggugggccgagcucgugucucucagggugccggguggagccucagagaaacagcaugcuugggaaaguccuacgcccaaauguggcagcugauguauuuccaucgccgggaccuuaggcuggcggcuaaugccauuuguucagcagugccuguagauuggauccccacuagcagaaccacauggucuauucacgcccaucaccaguggaugacuaccgaggacaugcucuccguuuggaaccgcguguggaucgaagagaauccauggauggaagauaagacgcauauaaguagcuggggcgacguccccuacuuaggcaaacgggaggaccaauggugcgggucgcugaucggauugacagcuagggccaccugggcaacuaacauucagguggcuaucaaucagguucgaagacugauugguaacgagaauuaccucgauuauaugacauccaugaagcgguuuaaaaacgaaucugacccugagggcgcccuuugguga

SEQ ID NO: 14051 - RNA, 9879 nt, Artificial Sequence
  derived and/or modified CDS sequence (opt3) from DENV-1__EU482517__SS-prME
agcgugaccaugcugcucaugcuuaugcccaccgcacuggcuuuccacuugacuacgagaggcggggaaccucauaugaucgucuccaagcaggaaaggggaaaaucuuuacuguuuaagaccucagccgguguuaauaugugcacgcuaauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaacacugcacacgcuaaaaagcaggaaguugugguccucgguagucaagagggggccaugcacaccgcucugacgggcgccaccgaaauccagacaucuggaacuaccacaauuuuugcaggccauuuaaagugccgucugaaaauggauaagcuaacucucaaagggauguccuaugugauguguaccgguagcuucaagcuggagaaagaacuugccgagacgcagcacggaacagucuuggugcagauaaaguacgagggcaccgacgcuccuugcaagaucccauucucgacucaagaugaaaaagggguuacacagaauggacgccugauuaccgcgaaccccaucgugacugacaaggagaaaccuguaaauauagaagcagagccacccuuuggcgagucuuauauugucaucggugccggggaaaaggcucucaaacuguccugguucaagaagggcucaaguaucggaaaaauguuugaggccaccgcaagaggcgccaggcggauggcuauucuuggggauacagccugggacuucggaagcaucgguggcguguuuacguccguugggaagcuggugcaucagauuuucggaaccgcauacggcgucuuguuuucuggugugagcuggacuaugaaaauagggaucggcguacuccugacaugguuaggacugaacucacgaaguaccucccuaagcaugacauguauugcggugggccucguuacucuguaccuuggggucauggugcaggcugauucuggaugcgugaucaauuggaagggccgcgaauugaaaugugguucagggaucuucgucaccaacgagguucacacguggacagaacaauauaaguuucaggccgacaguccgaagagacugagcgcagccauuggaaaggcuugggaggagggcgugugcgguauaagguccgccacccggcucgaaaacaucauguggaagcagauuucuaaugagcugaaccauaucuuacuggaaaaugacaugaaauucacugugguagucggcgauguggcagggauucuugcucagggaaagaaaaugauccgcccucaacccauggagcacaaguacucguggaaaagcuggggcaaggccaagauaaucggggcggacguucagaacaccacauuuauuaucgauggaccaaauacuccugaaugucccgacgaucagagagccuggaacauuugggagguggaggacuauggcuucgguaucuuuaccacaaauauaugguugaaacucagggauuccuacacgcaggucugcgaccaccgucugaugucagcugcaauuaaggauaguaaagccgugcaugcugacaugggguauuggaucgaaucugagaagaacgaaaccuggaaacuagcccgggcauccuucauugagguuaagacuuguaucuggccaaagucccacacacuguggucaaauggagugcucgaaagcgagaugauaauccccaaaauuuacggcgguccuaucucucaacauaacuaucgaccaggcuacuucacccagacugcggggccguggcaccugggaaaacuugaguuggauuuugaccugugcgaaggcacaaccguagucguggaugagcacugcgggaauagaggacccuccuuaaggacgacuaccgugacaggcaaaauuauccaugaaugguguugccgcaguuguacccucccuccacugcgguucagaggugaggacgggugcugguacggaauggagauaaggcccgucaaggaaaaagaggaaaaccuuguuaagagcauggugucugccggcuccggugagguagacucauuuagucugggcuugcucuguauuagcaucaugaucgaagaggugaugcgcucgcgauggucccggaagaugcugaugacugggacacuagcugucuucuuucugcucauuaugggacagcugaccuggaaugaucuuauccguuugugcauuauggugggcgccaacgcaucugacagaauggggaugggaacaacuuaucuggcuuuaauggccaccuucaaaaugaggccuauguuugcaguuggccuccuguuccgccggcuuacgagcagagaggugcugcuacucacaauaggucugucauuggucgccaguguggaacugccaaauuccuuagaggaacucggggauggacuggcuaugggcaucaugauucuuaagcuguugaccgacuuucaaucucaccagcucugggcgacucugcuaagccugaccuucaucaaaacaacuuuuucccuucauuacgccuggaagaccauggcaaugguucucucaauugugagccuguuccccuugugucugaguacgacaucucagaaaaccacuugguuaccgguccuccugggcucccuugggugcaagccucugacaauguuuuugaucgcugagaacaagauauggggaaggcgaagcuggccacucaacgaagguaucauggccguaggcauugugucgauccugcuaucaucucugcuuaaaaaugauguuccccucgccgggccucugauugcuggaggcauguugaucgcauguuaugugauaagugguuccagcgccgacuuaucucuggagaaggcggcugaggucagcugggaagaggaagccgagcacuccggggcaucacauaacauucucguggaaguacaggaugacggaaccaugaaaaucaaggaugaggagcgcgacgauacucugacaauccuucugaaagccaccuugcuagcugugaguggcgucuacccccugagcauuccagcaacacucuucguuugguauuucuggcaaaagaaaaagcagcggucuggcgugcugugggacacuccuucacccccagaaguggagagagccguccuugaugacgggauauacaggaucaugcagcguggauuacugggucgcagccaggugggcguugggguauuucaagaaaauguguuccacaccauguggcacgucacacggggagcggugcucauguaucagggcaagagauuggagccgaguugggcuagcguuaaaaaggaccugauuuccuacggugggggauggaggcuccagggcucuuggaacaccggcgaggaagugcaggucaucgccguggagccugggaaaaaucccaagaacguacaaacagcaccaggaacuuuuaaaacccccgaaggugaggucggcgccauugcucuggauuucaagccugggacgucgggaagcccaaucgugaaucgagaaggcaagauaguuggucuuuacgggaacggaguggucacaacuucaggcaccuauguguccgccaucgcacaggcuaaagccagucaggagggcccccugccugagauugaagacgagguuuuucggaagcgcaauuugacaaucauggaucuacauccggggucuggaaaaaccagaagguaccugccagcgauugugcgggaagccaucaagcgaaaacucagaacuuuaauacuggcacccacccgcgucguggcuagcgagauggccgaagcucuuaaggguaugccuauuagguaucaaacaacggcaguaaaguccgagcacacuggcaaagagaucguggaccugaugugccaugccaccuucacaaugcgucucuugucaccaguucggguccccaacuacaauaugaucauuauggaugaagcccacuuuaccgacccuucuagcaucgcugcgagaggguauauaaguacuagggugggaaugggcgaggcagccgcuauuuucaugacagccaccccgcccgguuccgcagaagccuuuccacagagcaacgcugugauccaggaugaggaacgcgacauuccugagcgaucuuggaacucaggguacgaguggaucacggauuuccccggaaagacugucugguuuguaccauccauaaaaaguggcaacgacauugcgaauugucugagaaagaacggcaaacgggugauccagcucagcaggaagacauucgauaccgaauaucaaaagaccaaaaacaaugacugggacuacguugugacuacagauaucucggagaugggggccaacuuccgcgcagaccgugucauugauccuagacggugccugaagcccgugauccuuaaagacggaccagaaaggguuauucuagcugguccgaugccugugaccgucgccucugcagcccagcgccgaggcagaauagggcggaaucauaacaaggagggagaucaguacaucuauaugggccagccccugaauaacgacgaggaucacgcucacuggacagaagccaaaauguuguuagacaauauuaacacuccagaggguaucauccccgcgcuguuugaaccugagagggaaaaguccgcagccauugauggggaguaccgccucagaggcgaggcuaggaagacguucguggaacugaugcggcguggagaccuuccaguauggcugagcuauaaaguggccucagagggcuuucaauacagugaucgccgauggugcuucgacggggaaagaaauaaccagguucucgaggaaaauauggaugucgagauauggaccaaggagggagaaaggaaaaaguugcggccccgcuggcuggacgcuagaacauauucugacccucuagcacugagggaguuuaaagaguucgccgcuggucggcgauccgugagcggcgaucucauccuugagauugggaagcugccgcagcauuuaacucagagagcccaaaacgcauuggacaaucuggugaugcuccacaacucagaacagggaggccgcgcguacaggcaugccauggaggagcugccagauaccaucgaaacacuuaugcugcucgcuuugauugccguccugaccggugggguuacuuuauuuuuccuaaguggccggggacugggcaaaacgagcaucgggcuccuuugugugauggcauccucuguacuguuguggauggcuagcguggagccccacuggauagccgcauccaucauucuggaauuuuuccucaugguccugcuuaucccugagcccgaccgucagagaaccccacaggauaaucaacucgccuaugugguuauuggacuguuguuuaugauccugacaguggcugcgaacgagauggguuuacuagaaacuaccaagaaggaccugggcauagggcacgucgccguagagaaccaucaccaugcagcuaugcucgauguggaccuucacccugccucagccuggacacuguacgcaguugcuaccacuauuaucacacccaugaugaggcauacgauugaaaauaccacugccaacaucucuuugacagcgauagcuaaucaggccgcaauccugaugggacucgauaaaggcuggccaauuaguaagauggacaucggugugccucugcuugccuuagggugcuacucgcaggucaacccgcugacccucaccgcugcaguguugaugcuggucgcccacuaugcgauuaucggccccggacuacaagcuaaagccacacgcgaggcacagaagcggacugccgcuggcauaaugaaaaauccaacgguggaugggauuguugccaucgaccuggauccugugguauacgacgcaaaguucgaaaagcagcucggacagaucaugcuucugauuuuguguaccagccaaauccugcucaugcgaacaacuugggcucugugcgaguccauaaccuuagccacaggcccccuuaccacucugugggaggguucuccagggaaauuuuggaacacgacaauugcggugucaauggccaauaucuucagaggaagcuaucucgcaggcgcuggucuagccuucucccugaugaagaguuugggcgggggaaggcgcggcaccggggcacagggagaaacucugggcgagaaauggaagcggcagcucaaccagcuuucuaaaagcgaauuuaauaccuacaagagaucagguauuauggaggucgaccguuccgaagcuaaggaggggcugaaaaggggagagacaacuaagcacgccguuagucggggcaccgccaaauugcgcugguucguggaacgaaaccuggucaagccugaggguaaagugaucgaucucggcugugggagaggaggcuggagcuauuacugcgcgggguuaaagaagguaacagaagugaaaggauauacgaagggcggucccgggcaugaggaaccgauaccaauggcuaccuacggauggaaucugguuaaacuucacucuggcaaggacguguuuuucaucccucccgagaaaugugauacucugcuaugcgacauuggcgaguccucaccaaaccccacaaucgaagaggggaggacccuccggguccugaagaugguggaaccuugguugcgcggaaaucaauuuuguauuaaaauccugaacccguacaugcccagcgucguggagacucucgagcagaugcagagaaagcaugguggcaugcuuguuaggaauccacugucgcgaaacucuacacacgaaauguauuggguaaguugcgggaccggaaauauuguguccgcagucaacaugacgagccggauguuacugaaccguuucaccauggcccacagaaagccuacauacgagcgcgauguggacuugggcgcugguacuaggcauguugccguggaacccgaggucgcaaaucucgauaucauagggcagcggauugaaaacaucaaacacgagcauaagucaaccuggcacuaugacgaggauaauccuuacaaaacaugggccuaucauggauccuacgaagugaagccaucuggcagcgcuaguuccaugguaaacggcgugguuaaacugcuaacuaagcccugggacgucaucccuauggugacccaaauugcgaugacagauaccacuccauuugggcagcagagaguguucaaggagaaagucgacacgcgcacacccaaggccaaaaggggaaccgcacaaauaauggaaguuacugcuaaguggcuuugggguuuucugagccgaaauaaaaagccgcggaucuguaccagagaggaguucacaaggaaggugcgcucuaacgccgcaauuggcgccguauuuguggacgagaaucaguggaacucagcuaaagaggccgucgaagaugagcguuucugggaccucgugcaccgggaaagagagcugcacaagcaggggaaaugcgcgacgugcguuuauaauaugaugggaaagagggagaaaaaguugggcgaguuugguaaggcaaaagggagucgcgccaucugguacauguggcugggagcucgauuccucgaguucgaagcccuuggcuuuaugaacgaggaucauugguucucccgggaaaauagccugucuggcguggagggggagggauuacacaagcuggguuacauuuugagagacaucucgaaaauaccuggcgggaacauguaugcagaugacaccgcuggaugggauacuaggaucacagaagacgaucuccagaaugaggcccgcauuaccgacaucauggaaccagagcaugcucugcuagccaagucaauuuuuaaacuuacuuaccaaaacaaggucgugagaguacagcggcccgccaaaaauggcacaguuauggaugugaucagcaggcgugaccagcgagguuccgggcaggucggaaccuauggccugaacacauucacuaacauggaagcgcaacucauacgccagauggauagugagggcauauuuucuccuagcgagcuggaaaccccaaauuuggccgagagaguguuagacuggcuggaaaaguacgggguggagcggcucaagaggauggcuaucuccggagacgauugugucguuaaacccaucgacgaucgcuucgccacggcacuuaccgcucugaacgacauggguaaggugagaaaagauauuccgcagugggaaccuucaaagggcuggaaugacuggcagcaaguacccuuuugcagucaccacuuccaucagcuaauaaugaaagaugggcgggagaucguggucccauguaggaaccaggacgagcuggugggacgagcccguguuucucagggcgcagguuggagccucagagaaacagccugcuuggggaaguccuaugcgcaaauguggcagcugauguacuuucaccgccgggaucuuaggcuggcugccaaugcaauuuguucagccgugccugucgacuggauccccacuagcagaaccacauggucuauucaugcucaccaucaguggaugacuaccgaggauaugcucuccguguggaaccgcguauggaucgaagagaauccauggauggaagacaagacgcacauaaguagcuggggagacguucccuauuuaggcaaacgggaggaucaauggugcggcucgcugaucggguugacagccagggcaaccugggcuacuaacauucagguggccaucaaucagguccgaagacugauuggaaacgagaauuaccucgacuacaugacauccaugaagcgguucaaaaacgaaucugauccugagggugcgcuuugguga

SEQ ID NO: 14052 - RNA, 9879 nt, Artificial Sequence
  derived and/or modified CDS sequence (opt3) from DENV-1__EU482519__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggaucaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauggcacuguuucuggcccaugcuauuggcaccucuaucacgcagaagggcauuaucuucauacucuuaaugcuggugacuccaucgauggccaugcgcugcgucgggaucggaucaagagauuuuguggagggucuuagcggcgcgacauggguugacguuguguuggagcacgggaguugugucaccacuauggcaaaggauaaacccacacuggacauugaacuacucaagaccgaggugacgaacccugccgugcugaggaaacuuugcaucgaagcuaagauuuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagguagugcaguacgaaaacuuaaaauauuccgucauagugaccguucacacuggagaccagcaucaaguggguaaugagucaacggaacacggcacaaccgccacuauuacaccccaggcgccuacaagugagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauucagaccucuggaacaacuaccaucuuugccggccauuuaaaaugccgucugaagauggauaaacuaacacucaaggggauguccuaugugauguguacuggaucguucaaacuggagaaggaagucgcugagacccagcacgguacggugcuuguucagaucaaguacgagggcacagacgcgccuugcaaaauuccauucucgacccaagaugaaaagggggugauacagaacggacgcuugaucacugcaaaucccauuguaacagacaaagagaagccugucaacaucgaagccgagccacccuuuggcgagucuuauauagugauugguguuggggaaaaagcucugaagcucuccugguucaagaaaggcucaaguaucggaaagauguuugaggccaccgcaagaggcgccaggcggauggcuauccugggggauacugccugggacuucggaagcauugguggcguguuuaccuccgucgggaaacuugugcaucagaucuucggaacagcauacggcguacuguuuucuggugugagcuggacgaugaagauugggauaggcguuuugcucaccuggcugggauuaaauucacgaaguacuucccugagcaugacauguaucgcggucggccuagugacccucuaccugggggugaugguccaggcugauucuggaugcguuauuaacuggaaaggccgcgaacuuaagugugguucagggaucuucgugacaaaugaggugcacacuuggaccgaacaauauaaguuucaggccgacaguccgaaaagauugagcgcagccaucggaaaggcuugggaggagggcguaugcgguauuagguccgccacgcggcuggaaaacauaauguggaaacagaucucuaacgagcucaaucauauucuguuagaaaacgacaugaaguucacagucgugguuggcgauguggucgggauccuggcacagggcaaaaagaugauucgcccucaacccauggagcacaaauacucguggaaaagcuggggcaaggcuaagaucauaggggccgacgugcagaauaccacuuuuaucauugauggaccaaacaccccugaaugucccgacgaucagagagcguggaauaucugggagguugaggacuauggcuucgguauuuuuacaacuaacaucuggcuuaaguugagggauuccuacacccaggccugcgaccaccgucucaugucagcugcaauaaaagauaguaaggccgugcaugcugacaugggguauuggauugaaucugagaaaaaugaaacauggaagcuggcccgggcauccuucaucgagguaaagacguguauuuggccaaaaucccacacccuauggucaaacggaguccuggaaagcgagauggugauccccaagauauacggcgguccuaucucucaacauaauuaucgaccaggcuacuucacucagacagcggggccguggcaccucggaaaacuggagcuugauuuugacuugugcgaaggcaccacuguggucguugaugagcacugcgggaacagaggacccucccugaggacaaccacggugacuggcaagauuauccaugaaugguguugccgcaguuguaccuuaccuccacuccgguucaaaggugaggacgggugcugguacggaauggagauuagacccguaaaggaaaaggaggaaaaucuggugaaaagcauggucucugccggcuccggugagguggacucauuuagucuuggccuguuguguaucagcauaaugauugaagagguuaugaggucgcgcuggucccgaaagaugcucaugacagggacccuggcuguguuccuacugcucaucaugggacagcugacuuggaacgaucuuacacgguugugcaucauggucggcgccaaugcaucugaccguauggggaugggaaccacauaucuggcuuuaauggccacuuuuaaaaugagaccuauguucgcagugggccuccuguuuaggcgccuuaccagccgggagguucugcuacucacgauuggucugucauugguggccagugucgaacugccaaacuccuuagaggaacucggggauggacuggcuaugggcaucaugauucuuaagcuguugacagacuuccaaucucaccagcucugggcgacccugcuaagccugacuuuuauaaaaaccacacuuucccuccauuacgccuggaagacuauggcaaugguacugucaaucgugagcuuguucccccuguguuuaaguaccacgucucagaagacaaccuggcucccgguucugcuuggcucccuggggugcaaaccuuugacuauguuucucauugcugagaauaagaucuggggaagaaaaagcuggccacugaacgaagguauuauggccgugggcgucgugucgauccuacugucaucucuucucaagaacgauguaccccuggccgggccuuugauagcuggaggcauguuaaucgcauguuaugugauuagugguuccagcgccgaccugucucucgagaaagcggcugaggucagcugggaagaggaagccgagcacuccggggcaucacauaauauccugguugaagugcaggaugacggaacaaugaagauuaaagaugaggagagggacgauacccuuacuauccuguugaaggccacacuacuggcugugaguggcgucuacccccucagcauaccagcaacccuguucgugugguauuuuuggcaaaagaaaaagcagcgaucuggcguucuuugggacacgccuucacccccagaaguagagcgcgccguguuagaugacgggauuuaccggaucaugcagagaggacugcucgguaggagccaggucggcguggggguuuuccaagaaaacguguuccacacuauguggcacgucacccguggagcgguguugauguaucagggcaaacgccuggagccgaguugggcuagcguaaagaaagaccucaucuccuacggugggggauggcggcugcagggcucuuggaauacaggcgaggaaguccaggugauugccguugagccugggaagaaccccaagaaugugcaaaccgcaccaggaacauuuaaaacucccgaaggugaggucggcgccauagcucuugauuucaagccugggaccucgggaagcccaaucgugaacagagaaggcaaaauuguuggucuguacgggaauggaguggucacgacaucaggcacuuauguguccgccaucgcacaggcuaaggccagucaggagggccccuugccugagauugaagacgagguauuuaggaaacgaaaccuaaccaucauggaucugcauccggggucuggaaagacacggcgcuaccucccagcgauagugagagaagccaucaagaggaaauuacggacccugauucuugcacccacucgaguugucgcuagcgagauggccgaagcucugaaggguaugccuaucagauaucaaaccacagcagugaaauccgagcacacgggcaaggagauuguggaccucaugugccaugccacuuucaccaugcgcuugcugucaccagucaggguacccaauuacaacaugaucauaauggaugaagcccacuuuacagacccuucuagcauugcugcgcguggguauaucaguacccgggugggaaugggcgaggcagccgcuaucuucaugacugccacaccgcccgguuccguugaagcauuuccacagagcaaugccgugauucaggaugaggaaagagacaucccugagaggucuuggaacucaggguacgaguggauaaccgauuuccccggaaaaacggucugguuugugccauccauuaagaguggcaaugacaucgcuaacugucuccgcaagaauggcaaacgaguuauucagcugagcagaaagacuuucgauacagaauaucagaaaaccaagaacaacgacugggacuacguggucaccacugauaucucggagaugggggcgaauuuucgggccgacagggugauagauccucgccguugccuuaaacccguaauucuaaaggacggaccagaaagagugauccuggcagguccgaugccuguuacagucgcuucugccgcacagcggaggggccgcaucgggcgaaaccauaauaaggagggagaucaguacauuuauaugggccagcccuugaacaaugacgaggaucacgcccacuggaccgaagcuaaaauguuacuggacaacaucaauacaccagaggguauuauacccgcccucuucgaaccugagagagaaaaguccgcggcaaucgauggggaguaccggcugaggggcgaggcccgcaaaacuuucguggaacuuaugagaaggggagaccugccaguguggcucagcuauaaggucgcuucagagggcuuucaauacagugaucggcguuggugcuucgacggggaacgcaacaaucagguuuuggaggaaaacauggauguggagauuuggacgaaagagggagaacgaaagaaacugagacccagguggcuagacgcccggaccuauucugacccucuggcucuccgcgaguuuaaggaguucgcagccgguagaagguccguaagcggcgaucuuauccuggagaucgggaaguuaccgcagcauuugacacagcgggcucaaaaugcccuggacaaccucgugaugcugcacaauucagaacagggaggccgagcauacagacaugcgauggaggagcuuccagauacuauugaaacccugaugcucuuggcccugauagcugucuuaacagguggggugacccuauuuuuccugaguggccgcggacucggcaaaacuagcaucgggcuucuguguguuauggccuccucuguguugcuguggauggcaagcgucgagccccacuggauugcugccuccaucauucucgaauuuuuccugaugguacuucucaucccugagcccgacaggcagcggacgccacaggauaaccaacuggcauaugugguuauaggauugcuguuuaugaucuuaaccguggccgcuaaugagaugggucuacuggaaacaacuaagaaagaccucggcauugggcacgucgcgguggagaaccaucaccaugccaccaugcuugaugucgaccugcacccugcaucagcuuggacauuguacgccguggccaccacuaucauuacacccaugaugcgucauacgaucgaaaacaccacugcaaauauaucucugacagcuauugccaaccaggcggcuauccucaugggacuggauaagggcuggccaauuaguaaaauggacaucgguguuccucuuuuagcccuggggugcuacagccaggugaauccgcucaccuugaccgcagccguacugaugcuaguggcucacuaugcaauaaucggccccggacugcaagccaaggcgacaagagaggcucagaagaggacugccgcaggcauuaugaaaaacccaacggucgaugggaucguugccauugaccucgauccuguggucuacgacgcuaaguucgaaaaacagcuuggacagaucaugcuguugauacuguguaccagccaaauucuccugaugcgcacaacuugggccuuaugcgaguccaucacccuugcaacaggcccccugaccacucucugggaggguucuccagggaaguuuuggaauacgacaaucgcugugucaauggccaacauuuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacaucuacaagcgcucagguauaauggagguagaccgguccgaagccaaagagggguugaagagaggagagaccacacgucacgcagugaguaggggcacugcuaaacugcggugguucguugaacgcaaucucgugaagccugaggguaaggucauugauuuaggcugugggcgaggaggcuggagcuauuacugcgccgggcugaaaaaggugaccgaagucaaaggauauacaaagggcggucccgggcaugaggaaccgaucccaauggccacguacggauggaaccuugugaaacugcacucuggcaaggacguauuuuucaccccucccgagaaaugugauacucuacucugcgacauuggcgaguccucaccaaaucccacaaucgaagaggggagaacccugaggguauugaagaugguggaaccuuggcugcggggaaaccaauuuuguauaaagauccucaauccguacaugcccagcgucguggagacucuugagcagaugcagcgcaaacaugguggcaugcugguuagaaacccauuaucgagaaauucuacacacgaaauguauugggugaguugcgggaccggaaacauugucuccgcggugaauaugacgagccgaaugcuguugaaccgguucaccauggcucaccguaagccuacauacgagagagauguagaccucggcgcagguacucgccauguggccguugaacccgaggucgcuaaccuggauaucauugggcagaggaucgaaaauauuaaacacgagcauaagucaaccuggcacuaugacgaggauaacccuuacaaaacaugggccuaucauggauccuacgaagugaagccaucuggcagcgcaaguuccauggugaauggcgucguuaagcuacuuacuaaacccugggacgugaucccuaugguaacccaaauagccaugacagauaccacuccauuugggcagcagcggguguucaaggagaaagucgacacgagaacacccaaggcuaaacgcggaaccgcgcaaauuauggaagugacugccagguggcugugggguuuucucagccgaaacaagaagccgcggaucuguaccagagaggaguucacaaggaaaguucgcucuaaugcagcuaucggcgccguguuugucgacgagaaccaguggaacucagcaaaggaggccguggaagaugagcguuucugggaccugguacagaaagaacgggaguugcacaagcaggggaaaugcgcuacgugcguuuauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguggagggggagggacugcauaaguuggguuacauacuccgggacaucucgaaaauuccuggcgggaauauguaugcugaugacaccgccggaugggauacuagaaucacagaagacgaucugcaaaacgaggcaaagauuaccgacaucauggaaccagagcacgcucuacuugccacuucaauauuuaaacugacauaccagaauaaggucgugagggugcagcgccccgcuaagaacggcaccgucauggauguuaucagcagacgggaccagagggguuccgggcaagugggaacauauggccucaauacuuucaccaacauggaagcccagcugauucgucagauggagagugagggcaucuuuuugccuucugaauuagagacgccaaaccuggcagaacgaguacucgauuggcuugagaaacaugggguggaacgccugaagagaauggcgauuagcggagacgacugugucgugaaacccaucgaugaccgguucgccaccgcucuaacagcccugaaugauauggguaagguuaggaaagacauaccgcagugggagccuuccaagggcuggaacgauuggcaacaggugcccuuuugcucacaccacuuccaucagcucauuaugaaggacgggcgcgagaucgucgugccauguagaaaucaggaugaauugguaggacgggcaaggguuagucaaggcgcugguuggucucugcgagagacugccugccuugggaaaagcuacgcacagauguggcagcugauguauuuucaccguagagaccuccgcuuagccgcgaacgcuaucuguuccgccgugccugucgauugggugcccaccucacggacaacuuggagcauucaugcacaccaucaauggaugaccacggaagacaugcugucuguuuggaauaggguguggauagaggaaaacccauggauggaggauaagacacacgucuccaguuggggagacgugcccuacuugggcaaaagagaggaccaguggugcggcagccugaucgggcucaccgcccgcgcuacuugggccucgaauauucagguagcaaucaaccaggugcggaggcuuauuggaaaugaaaacuaucuggauuacaugacauccaugaagcgauucaaaaaugagggugacccugaaggcgcucuaugguga

SEQ ID NO: 14053 - RNA, 9879 nt, Artificial Sequence
  derived and/or modified CDS sequence (opt3) from DENV-1__EU482520__SS-prME
agcgugaccaugcugcucaugcuuaugcccaccgcccuggcuuuccacuugacuacgaggggaggggaaccucauaugaucgucuccaagcaggaaaggggaaagucuuuacuguuuaagaccucagccgguguuaauaugugcacgcuaauugccauggaccucggcgaacugugugaagauacuaugaccuacaagugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagccgggauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauaggggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugcgggagaagucuuggcuggugcauaaacagugguuucucgaucugccgcuucccuggacuuccggcgccucaacaagccaagagaccuggaaucgucaggaccuguugguaacauucaagacugcacacgcuaaaaagcaggaaguugugguccucgguagucaagagggggccaugcacaccgcucugacgggcgccaccgaaauccagacaucuggaacuaccacaauuuuugcaggccauuuaaagugccgccugaaaauggauaagcuaacucucaaagggauguccuaugugauguguaccgguagcuucaagcuggagaaagaagucgccgagacgcagcacggaacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugggcacugcggaaacaggggccccucccugcgcacgacuaccgucacagguaaaauuauccacgagugguguugccggaguuguaccuuaccuccacucagauucagaggggaagacggaugcugguauggcauggagauacgccccguuaaggagaaagaagagaaucugguaaagagcaugguaucugccgguuccggcgaaguggacucauuuagucuugggcuguuguguauuagcaucaugaucgaggaagucaugcgaucgcgguggucccguaagaugcucaugacuggcauucuggcuguguucuuucuacugaucaugggccagcucacauggaacgaucugauuagacuuugcauaaugguuggggccaaugcaucugacaggaugggaaugggcaccacauacuuggcucugauggccacuuucaaaaugcgcccuauguuugcaguggguuuacucuuccggagacugaccagcagggagguccuucugcuaacgaucgggcucucacugguggccaguguugaguugccaaacucccuggaagaguuaggagauggccucgcuaugggcauuaugauccugaaacuucugacagacuuucaaucucaucaguugugggcgacccuccugagccuaacuuucauuaaaaccacauuuucccugcacuaugccuggaagacuauggcaauggugcuuucaaucgucagccucuucccccuguguuugaguaccacgucucagaaaacaaccuggcugccgguauuacucgggucccugggaugcaagccucuuacuauguuucugauagcugaaaauaagaucuggggucgacgcagcuggccauugaacgagggcauuauggccguggggaucguuucgauucuccugucaucucuacugaaaaacgaugugccccuugccggaccucucaucgcuggcgguaugcugauagcauguuacgucauuaguggguccagcgccgacuugucuuuagaaaaggcggcugaggugagcugggaggaagaggccgaacauuccggagcaucacacaauauccugguagaggugcaggaugacggcacaaugaaaaucaaggaugaagaacgggacgauacccucacuauucugcuuaaagccacacuguuggcugucaguggcguuuauccccuaagcauaccagcaacccuguucgugugguacuucuggcaaaagaaaaagcagagaucuggggugcucugggacacgccuucacccccagaggucggaagggccgugcuggaugacgguaucuaucguauuaugcagcgcggccuuuuagggcggagccagguuggaguaggcguguuucaagaaaacgucuuccauacuauguggcacgugaccagaggugcgguucugauguaccaggggaagaggcucgagccgaguugggcuagcgugaaaaaggacuugaucuccuacggaggcggcuggcgacugcaggggucuuggaauacaggagaagagguccaggugauugccguagagccugguaaaaaccccaagaauguccaaaccgcaccaggcacauuuaaaacucccgaaggggaggugggagccaucgcucucgauuucaagccuggcaccucggguagcccaauaguuaaccgggaagggaagaucgugggacuguauggcaauggcgucgugacgacaucagggacuuacguuuccgccauugcacaggcuaaagccagucaggagggaccccuuccugaaaucgaggacgagguguuucgcaagagaaaccugaccauuauggauuugcacccggguucuggcaaaacaaggcgguaucuaccagcgaucguccgagaagccauaaagagaaaacugcgcacccucauuuuagcacccacuagggugguagcuagcgagauggccgaagcucugaaggggaugccuauccguuaccaaaccacagcagugaaguccgagcauacgggaaaagaaaucguugaccuuaugugccacgccacuuucaccaugcggcugcucucaccagucagagugcccaauuauaacaugauuaucauggaugaggcccauuuuacagacccuucuagcauagcugcgaggggcuacauuaguacccgcguggguaugggggaggcagccgcuaucuucaugacugccacaccgcccggauccgucgaagcauuuccacagagcaaugccguaauucaggaugaggaacgagacaucccugagagaucuuggaacucaggcuaugaauggauaaccgauuuccccggcaagacggugugguuuguuccauccauuaaaagugggaaugacaucgcuaacuguuugcggaagaauggaaaaagggugauccagcugagccgcaagacuuucgauacagaguaccaaaagaccaaaaacaacgacugggacuacgucgugaccacugauauuucggagaugggugcgaauuuccgugccgacagaguuaucgauccucggaggugccucaagcccgugauucugaaagacggcccagaacgcgucauacuugcagggccgaugccugugacaguagcuucugccgcacagcgaagaggacggaucggcaggaaccacaauaaggagggugaucaguauauuuacauggggcagccccuaaacaaugacgaagaucaugcccacuggaccgaggcuaaaaugcuguuggacaacaucaauacaccagagggcaucauucccgccuuauuugaaccugagcgcgaaaaguccgcggcaauagauggagaguauagacugaggggcgaagcccggaagacuuucguggagcucaugcgucgcggggaccugccaguuuggcuuagcuacaaagucgcuucagagggauuucaauauagugaucgaagauggugcuucgacggugaaaggaacaaucaggugcuggaggaaaacauggauguggagaucuggacgaaggaaggcgagcggaaaaagcuccgccccagaugguuggacgccaggaccuacucugacccucuggcucuacgggaguuuaaagaguucgcagccgggcgaagauccgucagcggagaucugauucucgagaucggcaaacuuccgcagcaccugacacagcgcgcucaaaaugccuuagacaacuugguuaugcugcauaauucagaacagggugggagggcauaucggcacgcgauggaggaacucccagauacuauugagacccugaugcuucuggcccucaucgcuguguugacaggcggaguaacccuguuuuucuuaaguggccgugggcuaggaaaaacuagcauaggucugcucugugugauggccuccucuguccuucuguggauggcaagcguggagccccauuggaucgcugccuccauuaucuuggaauuuuuccugaugguucuccugauuccugagcccgacagacagaggacgccacaggauaaccaacuugcauacguggucaucggccuccuguuuaugauauugaccguagccgcuaaugaaauggggcuguuagagacaacuaagaaggaccuaggaauuggccacguggcgguugagaaccaccaucacgccgcaaugcuggauguggaccuccauccugcuucagccuggacccuuuacgccgucgcaacaaccaucauuacucccaugaugcgccacacaaucgaaaacacgaccgcuaauauaucucugacugccaucgcgaaccaggcugccauuuugaugggucuggauaaaggguggccaaucaguaagauggacauuggcgugccucuccuggcacuuggaugcuauucgcaggucaauccguuaacacugaccgccgcugugcucauguugguugcacauuacgccaucauaggccccgggcugcaagcgaaagcuacccgggaggcccagaagcgaacagcagccggaauuaugaaaaacccaacuguggauggcaucguagcuaucgaccuagauccuguggucuaugacgccaaguucgaaaagcagcugggucagauuaugcuccuuauccuguguacgagccaaauauugcugaugagaaccacaugggcacucugcgaguccauuacucuggcuaccgggcccuuaacaacccuuugggaaggaucuccaggcaaauuuuggaauacuacgaucgccguuucaauggcgaacauuuucagggguagcuaccuggccggcgcagggcucgcuuucucccuaaugaagagucugggaggcgggcgccggggaacaggcgcccagggugagaccuugggggagaaauggaagagacagcugaaucagcucucuaaaagcgaauuuaacacuuauaagcguucaggaaucauggagguggacagguccgaagcaaaggagggccuuaaacggggugaaaccacaaagcacgcugucagucgcggcacugccaaacugcgaugguucguggagagaaauuugguaaagccugaggggaaagugauagaucugggauguggcagagggggauggagcuacuauugcgccggccucaagaagguuaccgaagugaaagguuacacaaaagggggacccggccacgaggaaccgaucccaauggcgacguacggcuggaacuuagucaaacugcauucugggaaggacguguuuuucauuccucccgagaaaugugauacccuucugugcgacaucggagaauccucaccaaaucccacuauugaggagggucggacacuacgcguccucaagaugguggaaccuuggcugagaggcaaccaauuuuguaucaaaauuuugaauccguauaugcccagcguuguagagacccuggaacagaugcagaggaagcacgggggaaugcucgugcgaaacccacuuucgagaaauucuacucaugagauguacugggucaguugcggcacagguaacaucguguccgcuguuaauaugaccagccguaugcuguuaaacagauucacgauggcacaccgcaagccuaccuaugagagggauguggaccugggggccggaacacggcacgucgcuguggaacccgagguagccaacuuggauauaauuggccagagaaucgaaaauaucaaacaugagcacaagucaacuuggcauuacgacgaagauaacccuuauaaaaccugggcauaccacggcuccuaugaggugaagccaucugggagcgccaguuccaugguuaauggagucgugaaacuccugacaaagcccugggacgugauuccuauggucacucaaauagcuaugaccgauacaaccccauuuggucagcagcgcguuuucaaggagaaaguggacacuaggacgcccaaggcgaaacgaggcacagcccaaaucauggaaguaaccgcaaaguggcuauggggguuucuuagccggaacaaaaagccgagaauuuguacuagggaggaguucacccgcaaggugcguucuaaugcugccaucggagcagucuuuguggacgagaaccaguggaacucagccaaagaagcuguugaggaugagcgguucugggaccuggugcauagagaaagggagcuccacaagcagggcaaaugcgccacaugcgucuacaacaugauggguaagcgcgagaagaagcugggggaguuuggaaaggcgaaaggcagucgagcaauuugguacaugugguugggcgcccgguuccuggaguucgaggcucucggguuuaugaaugaggaucacugguucuccagagaaaacagccuuucuggaguggagggugaaggccugcauaaguuaggguauauccugagggacauaucgaauaucccuggaggcaacauguacgccgaugacacggcagguugggauacccgcauuacugaggacgauuugcagaaugaggcuagaaucacagacauuauggaaccagagcacgcccuccuggcuaaaucaaucuuuaagcuaaccuaucaaaacaaaguaguucgggugcagaggcccgccaagaaugggacugucauggaugugauaagccgucgagaccagcgcggauccggccaggugggcacauacgggcuuaacaccuucacaaacauggaagcacaacugauuagacagauggagagugaaggaaucuuuucuccuagcgagcucgagacuccaaaucuggcggaacgggucuuggauugguuagagaaauaugguguugaaaggcugaagcgcauggccaucuccggcgacgacugugugguaaagcccauugaugacagauucgcuaccgcccucacggcacuuaacgauauggggaaagugcggaaggacauaccgcagugggagccuucaaaaggauggaaugauuggcagcaaguccccuuuugcagucaucacuuccaccagcugaucaugaaggacggcagggaaauugugguuccaugucgaaaccaggaugagcuagugggucgugcuagagucucucagggggccggauggagccugcgcgagaccgcaugccucggcaaauccuacgcccaaauguggcaguugauguauuuucaucggagggaccugagacuugcggcuaaugccaucuguucagcagugccuguagauuggauucccacaagccgcacuaccuggucuauccacgcccaucaccaguggaugacaacugaagacaugcuguccguuuggaaccggguguggauagaggaaaauccauggauggaggauaagacccauaucaguagcuggggcgacguccccuaccucgggaagagggaagaccaauggugcggaucguuaauuggucugacggcucgagccacaugggcaaccaacauccagguggcuauuaaucagguuagacgguugaucggcaacgagaauuaccuggauuauaugacuuccaugaaaagguucaagaacgagucugacccugaaggggcccucugguga

SEQ ID NO: 14054 - RNA, 9879 nt, Artificial Sequence
  derived and/or modified CDS sequence (opt3) from DENV-1__EU482521__SS-prME
uccgugaccaugcugcucaugcuuaugcccacagcacuggcuuuccacuugacuacgagaggcggggagccucauaugaucgucuccaagcaggaaaggggaaagucuuuacuguuuaagaccucagccgguguuaauaugugcacacugauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguagcuucaaacuggagaaggaaguggcugagacccagcacggaacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaagaauguuugaggcaacugccaggggcgcucggcgaauggccauccugggggauaccgcaugggacuucggaagcauugguggcguguuuacauccguugggaaacuugugcaucagauauucggaacggcguacggcguccuguuuucuggugugagcuggaccaugaaaaucgggauuggcguauugcucacuuggcugggauuaaauucacgcaguacauccuucagcaugaccuguaucgcugugggccugguuacacuauaccucggggucauggugcaggccgauucuggaugcgugaucaacuggaagggcagagaacugaaaugugguucagggauuuuugucacuaaugagguucacaccuggacggaacaauauaaguuccaggcagacaguccgaagaggcuuagcgccgcuauaggaaaagccugggaggagggcgugugcgguauccgguccgcaacacgcuuggaaaacauuauguggaagcagaucucuaacgagcugaaucauauucuccuggaaaacgacaugaaauuuaccgugguagucggcgauguggcugggaucuuagcccagggaaagaaaaugauaagaccucaacccauggaguacaaguauucguggaggagcuggggcaaagcgaagaucauuggggccgacguucagaauacuaccuucaucauugauggaccaaacacaccugaaugucccgacgaucagcgugcuuggaauaucugggagguggaggacuacggcuuugguauauucacuaccaacauuuggcugaaacuucgggauuccuauacacaggucugcgaccaccgauugaugucagcagccaucaaagauaguaaggcugugcacgccgacaugggguacuggauugaaucugagaaaaaugaaacguggaagcucgcaagagcgagcuucaucgagguuaaaaccuguauauggccaaagucccauacucuguggucaaacggagugcuagaaagcgagaugaucauucccaagaucuauggcgguccuauuucucaacacaauuacaggccaggcuacuuuacacagaccgccgggccguggcaucugggaaaacucgagcuggauuucgaccuuugcgaaggcacuacaguagucguggaugagcacugcgggaaccgcggacccuccuugcggaccacgacugugaccggcaagaucauacacgaaugguguugcagaaguuguacacugccuccauuaagguuucgcggugaggacgggugcugguauggaauggagauucgacccgucaaagaaaaggaggaaaaucucguuaaaagcauggugucugcuggcuccggugagguagacucauucagucugggccuucuguguaucagcaucaugauugaagaggugaugcggucgcguugguccagaaagauguugaugaccgggacucucgccgucuuucugcuacugaucaugggacagcucacauggaacgaucugauuaggcuuugcauaauggugggcgcaaaugcuucugaccgcauggggaugggaaccacauacuuggcccugauggcaacuuucaagaugcggccuauguuugccguuggcuuacucuucagaaggcugaccagccgagaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaagaccacauuuucccugcacuaugcauggaaaacuauggcuaugguucuuucaaucgugagccucuucccccuguguuugaguaccacgucucagaagacaaccuggcugccggucuuacucggcucccuggggugcaaaccucuuacuauguuucugauagccgagaauaagaucuggggacgccggagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaagcugccgaggucagcugggaagaggaagcagagcauuccggggccucacacaauauccugguggaaguacaggaugacggaacaaugaagaucaaagaugaggagagagacgauacccucacuauucugcuuaaggcuacacuguuggcagugaguggcgucuauccccuaagcauaccagccacccuguucguuugguacaucuggcagaagaagaaacagaggucuggcgugcucugggacacgccuucacccccagaaguggagcgugcgguccuggaugacgggauuuaucgcaucaugcagcggggacuuuuagguagaagccaggugggcguugggguauuccaagaaaacguguuucauacuauguggcacgucaccaggggagcugugcugauguaccagggcaagcgacucgagccgaguugggccagcguuaagaaagacuugauuuccuacggugggggauggcggcugcagggcucuuggaauacaggcgaggaagugcaggucaucgcaguggagccugggaagaaccccaaaaauguacaaaccgccccaggaacauucaagacucccgaaggugaggucggcgcuauagcccucgauuuuaaaccugggaccucgggaagcccaaucgugaaccgcgaaggcaagauuguuggucuguaugggaauggaguggucacgacaucaggcacuuacguguccgcaaucgcucaggccaaggcgagucaggagggcccccuuccugagauugaagacgagguuuucagaaaaaggaaccugaccaucauggauuugcacccggggucuggaaagacacggcgauaucuaccagccauagugagagaagcaauuaaacgcaagcugaggacccucaucuuagcucccacucgugucguggccagcgagauggcugaagcacugaaagguaugccuauccgguaccaaaccacagccguaaaguccgagcauacgggcaaggagauuguggaccuuaugugccacgccacuuuuaccaugagacugcucucaccaguuaggguccccaauuauaacaugaucauaauggaugaagcucauuucacagacccuucuagcauugcggcacgcggguacaucaguacccgagugggaaugggcgaggccgcugccauuuuuaugacugcaacaccgcccgguuccguggaagccuucccacagagcaaugcugucauccaggaugaggaaagagacauaccugagcggucuuggaacucaggguaugaguggauuaccgauuuucccggaaaaacgguaugguucgugccauccaucaagaguggcaaugacaucgcgaacuguuugaggaaaaauggcaagcgcguuauucagcugagccguaaaacuuuugauacagaauaccaaaagaccaagaacaacgacugggacuacguggucaccacugauaucucggagaugggggccaauuucagagcagaccgggugauugauccuaggcgcugccucaaacccguuauacugaaggacggaccagaacgagugauccuugcugguccgaugccugucacaguggccucugcagcccagagacggggcaggauugggcgcaaccacaauaaagagggagaucaguauaucuacaugggccagccccuaaacaaugacgaggaucaugcucacuggaccgaagccaagaugcuguuggacaacaucaauacaccagaggguauuauacccgcguuauucgaaccugagagagaaaaauccgcagccaucgauggggaguauaggcugcggggcgaggcucguaagacuuuuguagaacucaugcgccgaggagaccugccaguguggcuuagcuacaagguugccucagagggcuuccaauauagugauagaagguggugcuuugacggggaacggaacaaucagguccuggaggaaaacauggauguggagauuuggacgaaagagggagaacgcaagaaacucagacccaggugguuggacgcucggaccuacucugacccucuggcacuacgagaguucaaggaauuugccgcugguagacgcuccgugagcggcgaucugauccucgagauugggaaacuuccgcagcaccugacacagagggcccaaaaugcauuagacaacuuggucaugcugcauaauucagaacagggaggccgggcguaucgucacgccauggaggagcucccagauacuaucgaaacccugaugcuucuggcucucauagccguuuugacagguggggugacccuguucuuuuuaaguggcagaggacuaggcaagacuagcaucgggcugcucuguguaauggcauccucugugcuucuguggauggcuagcgucgagccccauuggauugccgcauccaucauuuuggaguucuuucugauggugcuccugaucccugagcccgacaggcagcgcacgccacaggauaaccaacuugccuacguugugauaggacuccuguucaugauuuugaccgucgcugcgaaugagaugggucuguuagaaacaacuaaaaaggaccuaggcaucgggcacguagccgugggaaaccaccaucacgcagcuaugcuggauguugaccuccauccugccucagccuggacccuuuacgcaguggcuacaaccauuaucacucccaugaugcggcacacaauagagaacacgaccgccaauaucucucugacugcgauugcuaaccaggccgcaaucuugaugggccuggauaaggguuggccaauuaguaaaauggacaucggggucccucuccuggcccuuggcugcuauucgcaagugaauccguuaacacugaccgcugcaguccucauguugguggcccauuacgcgauaauuggacccggccugcaagcuaaggccacccgagaagcacagaaaagaacagccgcugggaucaugaagaacccaacuguugauggaaucguggccauugaccuagauccuguaguguaugacgcaaaauuugagaagcagcugggccagaucaugcuccuuauacuguguacgagccaaauuuugcugaugaggaccacaugggcucucugcgaauccaucacucuggccaccggucccuuaacaacccuuugggaggggucuccaggaaaguucuggaauacuacgauugcggucucaauggccaacaucuuucgcggcagcuaccuggccggugcuggccucgccuucucccuaaugaaaagucuagggggaggccggagagggacaggagcacagggcgagaccuugggugaaaaguggaaacgucagcugaaucagcucucuaagagcgaguucaacacuuauaaaaggucagggauaauggaaguugaccgguccgaggcuaaggaaggacuuaagcgcggcgagaucaccaaacacgccgugagucgagguacagccaagcugagaugguuugucgagaggaauuuggugaaaccugaaggcaagguaauugaucugggguguggacggggcggguggagcuacuauugcgcgggacucaaaaaggugacugagguuaagggcuacaccaaaggugggcccggacacgaagaaccgaucccaauggcuacauacggcuggaacuuagugaagcugcauucuggcaaagacgucuucuuugugccucccgaaaagugugauacgcuucugugcgacauuggggaguccucaccaaaucccaccaucgaggaaggacgcacucuaagaguccucaaaaugguggagccuuggcugagggguaaccaauucuguauuaagaucuugaauccguauaugcccagcguuguagaaacacuggagcagaugcagcgaaaacacggcgggaugcucgugcggaacccacuuucgcguaauucuacccaugagauguacugggucaguugcggaacuggcaacauaguguccgcaguuaauaugacaagcagaaugcuguuaaaccgcuuuaccauggcccacaggaagccuacguaugaacgggauguggaccugggugcugggaccagacacgucgccguggagcccgaaguagcaaacuuggauauuaucggacagcgcaucgagaauauuaagcaugaacacaaaucaacauggcauuacgacgaggauaacccuuauaagacuugggccuaccacggcuccuaugaggugaaaccaucuggcagcgcuaguuccaugguuaauggggucgugaagcuccugaccaaacccugggacgugauaccuauggucacacaaaucgcgaugacugauaccacaccauucggacagcagaggguuuuuaaggaaaagguggacacccgaacucccaaagccaagcgggguacggcacaaauuauggagguaacagcuaaauggcuauggggcuuccuuagcagaaacaagaaaccgaggaucuguacccgcgaagaguuuacucguaaggugcggucuaaugccgcaauuggggccgucuucguggacgaaaaccaguggaacucagcuaaggaggccguugaggaugaaagauuuugggaccuggugcauagggagcgcgaacuccacaaacagggaaagugcgcgaccugcgucuacaacaugaugggcaaacgagagaagaaacugggugaguucgggaaggcaaagggaagucgggccaucugguacaugugguugggcgcuagauuucuggaguucgaggcccucggcuucaugaaugaagaucacugguuuuccagggagaacagccuuucugggguggaaggagagggucugcauaaauuaggcuauauacugcgcgacaucucgaagauuccugggggaaauauguacgcagaugacacagcuggcugggauacgagaaucaccgaggacgauuugcagaacgaagcccggauuacugacaucauggagccagaacacgcucuccuggccaaaucaauauucaagcuaacauaucaaaauaaaguaguuagggugcagcgucccgcaaagaacgguaccgucauggaugugauuagccgacgcgaccagagaggguccggacaggugggcacuuacggccuuaauacauuuaccaacauggaggcgcaacugauccggcagauggaaagugaggggaucuucucuccuagcgagcucgaaacaccaaaccuggccgagagggucuuggauugguuagaaaaauauggaguugagcgccugaagagaauggcuauuuccggugacgacugugugguaaagcccauagaugaccgguuugccacugcacucaccgcucuuaaugauaugggcaaagugaggaaggacaucccgcagugggaaccuucaaaaggguggaacgauuggcagcaaguccccuucugcagucaucacuuucaccagcugauuaugaaggacggacgagagaucgugguuccaugucguaaucaggaugagcuagugggcagagcccgcgucucucagggugcaggguggagccugcgggaaacggccugccucggaaaauccuacgcgcaaauguggcaguugauguauuuccauaggagagaccugcgccuugcugccaacgcaauuuguucagccgugccuguagauuggauccccaccagccggacaacuuggucuauacacgcucaucaccaguggaugaccacagaggacaugcuguccguuuggaauaggguguggaucgaagagaacccauggauggaagauaagacucauauuaguagcuggggcgacguccccuaccucggcaagcgagaggaccaauggugcgggucguuaaucggacugaccgccagagcaacgugggcuacaaauauucagguggccaucaaccagguucggagguugauugguaaugagaacuaccuggauuauaugaccuccaugaaacgcuuuaagaaugaaucugacccugagggcgcgcucugguga

SEQ ID NO: 14055 - RNA, 9879 nt, Artificial Sequence
  derived and/or modified CDS sequence (opt3) from DENV-1__EU482523__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugaugggacuggauaaaggcuggccaauuaguaagauggacaucggugugccucuccuggcccuugggugcuauucgcaggucaauccguuaacacugaccgcugcagugcucauguugguugcccauuacgcgauuaucggccccggacugcaagcuaaagccacccgggaggcacagaagcgaacagccgcuggcauaaugaaaaacccaacuguggaugggauuguagccaucgaccuagauccuguggucuaugacgcaaaguucgaaaagcagcugggacagaucaugcuccuuauucuguguacgagccaaaucuugcugaugagaaccacaugggcucucugcgaguccauaacucuggccaccggccccuuaacaacccuuugggaggguucuccagggaaauuuuggaauacuacgauugcgguuucaauggccaacaucuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguauuauggagguggacagguccgaagcuaaggaggggcuuaaacggggagagaccacaaagcacgccgucagucgcggcacugccaaacugcgaugguucguggaaagaaauuugguaaagccugaggguaaagugaucgaucugggcugugggaggggaggcuggagcuacuauugcgcggggcucaagaagguuaccgaagugaaaggauacacaaagggcggucccgggcacgaggaaccgauaccaauggcuacguacggauggaacuuagucaaacugcauucuggcaaggacguguuuuucaucccucccgagaaaugugauacccuucugugcgacauuggcgaguccucaccaaaucccacuaucgaagaggggcggacacuacgcguccucaagaugguggaaccuuggcugagaggaaaccaauuuuguauuaaaaucuugaauccguauaugcccagcguuguagagacccuggagcagaugcagaggaagcacgguggcaugcucgugcgaaacccacuuucgagaaauucuacucaugaaauguacugggucaguugcgggacaggaaacauuguguccgcaguuaauaugaccagccguaugcuguuaaacagauucacgauggcccaccgcaagccuaccuaugagagggauguggaccugggcgcugguacacggcacgucgccguggaacccgagguagcaaacuuggauaucauagggcagagaauugaaaauaucaaacaugagcacaagucaacuuggcauuacgacgaggauaacccuuauaaaaccugggccuaccacggauccuaugaagugaagccaucuggcagcgcuaguuccaugguuaauggcgucgugaaacuccugacaaagcccugggacgugaucccuauggucacucaaauugcgaugaccgauacaaccccauuugggcagcagcgcguuuucaaggagaaaguggacacuaggacgcccaaggccaaacgaggaacagcacaaauaauggaaguaaccgcuaaguggcuaugggguuuucuuagccggaacaaaaagccgagaaucuguacuagggaggaguucacccgcaaggugcguucuaaugccgcaauuggcgccgucuuuguggacgagaaccaguggaacucagcuaaagaggccguugaagaugagcgguucugggaccuggugcauagagaaagggagcuccacaagcaggggaaaugcgcgacaugcgucuacaacaugaugggaaagcgcgagaagaagcugggcgaguuugguaaggcaaaagggagucgagccaucugguacaugugguugggagcucgguuccuggaguucgaagcccucggcuuuaugaaugaggaucacugguucuccagagaaaacagccuuucuggcguggagggggagggacugcauaaguuagguuauauucugagggacaucucgaaaauaccuggcgggaauauguacgcagaugacacggcuggaugggauacccgcaucacugaagacgauuugcagaacgaggccagaauuacagacaucauggaaccagagcacgcucuccuggccaagucaauuuuuaaacuaaccuaucaaaauaagguaguucgggugcagaggcccgccaaaaauggcacugucauggaugugaucagccgucgagaccagcgcgguuccggacaggugggaacauacggccuuaauaccuucacaaacauggaagcgcaacugauaagacagauggagagugagggcauauuuucuccuagcgaacucgagacuccaaaccuggccgaacgggucuuggauugguuagagaaguaugggguugaaaggcugaagcgcauggcuaucuccggagacgacugugugguaaaacccaucgaugacagauucgccaccgcacucacggcucuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugccagagucucucagggcgcagguuggagccugcgcgagaccgccugccucgggaaguccuacgcgcaaauguggcaguugauguauuuucaucggagggaccugagacuugcugccaacgcaauuuguucagccgugccuguagauuggauccccacaagccgcacuaccuggucuauucacgcucaucaccaguggaugacaacugaagacaugcuguccguuuggaaucggguguggaucgaggaaaacccauggauggaggauaagacccauauaaguagcuggggagacguccccuaccucggcaaaagggaggaccaauggugcggcucguuaaucgggcugacggcccgagcaacaugggcuaccaauauucagguggccaucaaccagguuagacgguugauuggaaaugaaaacuaccuggauuauaugacuuccaugaagagguucaaaaaugagucugacccugaaggugcgcucugguga

SEQ ID NO: 14056 - RNA, 9879 nt, Artificial Sequence
  derived and/or modified CDS sequence (opt3) from DENV-1__EU482525__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacauccuucagcaugaccuguauugcuguuggccuggucacacuauaccucggggugauggugcaggccgauucuggaugcgucaucaacuggaaaggccgcgaacugaagugugguucagggaucuuuguuacuaaugaggugcacaccuggacggaacaauauaaguuccaggcagacaguccgaaaagacuuagcgccgcuauuggaaaggccugggaggagggcgugugcgguauaagguccgcaacacgguuggaaaacaucauguggaaacagauuucuaacgagcugaaucauauccuccuggaaaacgacaugaaguuaaccguagucgugggcgauguugcugggauucugggacagggcaaaaagaugauccgcccucaacccauggaguacaaauauucguggaaaagcugggggaaggccaagauaaucggagcggacgcccagaauacuaccuuuauuaucgauggcccaaacacaccugaaugucccgacgaucagagagcuuggaauauuugggagguggaggacuacgguuucgggaucuuuacuaccaacauauggcuuaaguugagggauuccuauacacaggucugcgaccaccgucucaugucagcagccauuaaagauaguaaggcugugcacgccgacaugggauacuggaucgaaucugagaaaaaugaaacguggaagcuggcacgggcgagcuucauugagguuaagaccuguaucuggccaaaaucccauacucuauggucaaacggcgugcuggaaagcgagaugauaauccccaagauuuaugguggcccuaucucucaacacaauuaccgaccaggguacuucacacagaccgccggaccguggcaucucggcaaacuggagcuugauuuugacuugugcgaagggacuacaguagucguggaugagcacugcggaaacagaggccccucccugaggaccacgacugugaccgguaagauuauccacgaaugguguugccgcaguuguacauuaccuccacuccgguucagaggggaggacggaugcugguauggcauggagauaaggcccgucaaagaaaaggaggaaaaucugguuaagagcauggugucugcugguuccggcgagguagacucauuuagucuugggcuguuguguauuagcaucaugaucgaagaggugaugcgcucgcgauggucccggaaaaugcucaugaccggaacucuggccgucuucuuucuacugauuaugggccagcucacauggaacgaucugauccgucuuugcauuauggugggggcaaaugcuucugacagaaugggaaugggcaccacauacuuggcccugauggcaacuuucaagaugaggccuauguuugccguugguuuacucuuccgccggcugaccagcagagaggugcuucugcuaacgauagggcucucacuggucgcuaguguggaauugccaaacucccuggaggaauuaggagauggccucgcgaugggcaucaugauucugaaacuucugacagacuuucaaucucaucaguugugggccacccuccugagccuaacuuucaucaagaccacauuuucccugcacuaugcauggaaaacuauggcuaugguucuuucaauugugagccucuucccccuguguuugaguaccacgucucagaagacaaccuggcugccggucuuacucgggucccugggaugcaagccucuuacuauguuucugaucgccgagaauaaaauaugggguaggaaguccuggccauugaacgaaggcaucauggccguagggauugugucgauccuccugucaucucuacugaaaaacgauguuccccuugcuggaccucucauugcaggcgguaugcugaucgccuguuacgugauaaguggguccagcgcggacuugucuuuagagaaggcugccgaggucagcugggaagaggaagcagagcauuccggagccucacacaauauucugguggaaguacaggaugacggcacaaugaaaaucaaggaugaggagcgagacgauacccucacuauccugcuuaaagcuacacuguuggcagugaguggcgucuauccccuaagcauuccagccacccuguucguuugguacuucuggcaaaagaagaaacagcgcucuggggugcucugggacacgccuucacccccagaaguggagcgggcgguccuggaugacggaauauauagaaucaugcagaggggucuuuuaggccguagccagguggggguuggaguauuucaagaaaacguguuccauacuauguggcacgucacccgcggcgcugugcugauguaccaggguaagcggcucgagccgaguugggccagcguuaaaaaggacuugauuuccuacgggggaggcuggagacugaggggcucuuggaauacaggggaggaagugcaggucaucgcaguggagccuggcaagaaucccaagaauguacagaccgccccagguacauuuaagacucccgaaggcgaggucggggcuauugcccucgauuucaaaccuggaaccucgggcagcccaaucgugaaccgagaagguaagauaguugggcuguauggaaauggcguggucacgacaucaggcacuuacguguccgcaaucgcucaagccaaagcgagucaggaggggccccuuccugagauugaagacgagguuuuucggaagcgcaaccugaccaucauggauuugcacccgggaucugguaaaacaagaagguaucuaccagccauugugcgggaagcaaucaagcgaaagcugagaacccucauauuagcucccacucgcgucguggccagcgagauggcugaagcacugaaaggcaugccuauuagguaccagaccacagccguaaaguccgagcauacggggaaagagaucguggaccuuaugugccacgccacuuucaccaugcgucugcucucaccaguucggguccccaauuauaacaugaucauuauggaugaagcucauuuuacagacccuucuagcaucgcggcaagaggauacauaaguaccagggugggcaugggugaggccgcugccauuuucaugacugcaacaccgcccggguccguggaagccuuuccacaaagcaaugcugucauccaggaugaggaacgcgacauuccugagcgaucuuggaacucaggauaugaguggaucaccgauuuccccggcaagacgguaugguuugugccauccauaaaaaguggcaaugacauugcgaacuguuugagaaagaaugggaagcggguuauccagcugagcaggaaaacuuucgauacagaauaccagaagaccaaaaacaacgacugggacuacguggucaccacugauaucucggagaugggagccaauuuccgcgcagaccgugugauugauccuagacggugccucaagcccguuauccugaaagacgguccagaaagggugauucuugcuggcccgaugccugucacaguggccucugcagcccaacgccgagggagaauaggacggaaccacaauaaggagggcgaucaguauaucuacaugggucagccccuaaacaaugacgaggaucaugcucacuggaccgaagccaagaugcuguuggacaacauuaauacaccagaggggaucauccccgcguuauuugaaccugagagggaaaaauccgcagccguagauggcgaguaucgccugagaggagaggcuaggaagacuuucguggaacucaugcggcguggcgaccugccaguuuggcuuagcuacaaagucgccucagagggguuucaguauagugaucgccgauggugcuucgacggagaaagaaacaaucaagugcuggaggaaaacauggauguggagauuuggacgaaggagggugaaaggaaaaagcuccggccccgcugguuggacgcuagaaccuacucugacccucuggcacuaagggaguuuaaagaguucgccgcuggccggcgauccgucagcggggaucugauacucgagaucggaaaacuuccgcagcaccugacacagagagcccagaaugcauuagacaacuugguuaugcugcauaauucagaacaaggcggucgcgcguauaggcacgccauggaggagcucccagauacuauugaaacccugaugcuucuggcucucaucgccguguugacagggggcguaacccuguuuuucuuaaguggacggggccuagggaagacuagcauuggacugcucugugugauggcauccucuguccuucuguggauggcuagcguggagccccauuggaucgccgcauccauaaucuuggaauuuuuccugaugguucuccugauuccugagcccgaccgucagagaacgccacaggauaaccagcuugccuacguggucaucggucuccuguuuaugauuuugaccguagcugcgaaugagaugggccuguuagaaacaacuaaaaaggaccuagggaucggacacguggccguugagaaccaccaucacgcagcuaugcuggauguggaccuccauccugccucagccuggacccuuuacgcagucgcuacaaccauaauuacucccaugaugaggcacacaaucgaaaacacgaccgccaauauuucucugacugcgaucgcuaaccaagccgcaauauugaugggccuggauaaagguuggccaaucaguaagauggacauuggggugccucuccuggcccuuggcugcuauucgcaggucaauccguuaacacugaccgcugcagugcucauguugguugcccauuacgcgaucauuggacccggccugcaggcuaaagccacccgcgaggcacaaaagcggacagccgcugggaucaugaagaacccaacuguggauggaauaguagccauugaccuagauccuguggucuaugacgcaaaauucgaaaagcagcugggccagaucaugcuccuuauccuguguacgagccagauuuugcugaugcgaaccacaugggcucucugcgaguccaucacucuggccaccggucccuuaacaacccuuugggaggggucuccaggaaaauuuuggaauacuacgauagcgguuucaauggccaacauuuucagaggcagcuaccuggcaggagcuggccucgccuucucccuaaugaagagucuagggggaggcaggcgcgggacaggagcacaaggcgaaaccuugggugagaaauggaagcggcagcugaaucagcucucuaagagcgaauuuaacacuuauaaaagaucagggaucauggagguggaccguuccgaagcuaaggagggacuuaaaaggggcgagaccacaaagcacgccgucagucgggguacugccaaacugcgcugguucguggaacgaaauuugguaaagccugagggcaaggugauugaucugggguguggaagaggcggguggagcuacuauugcgcgggacucaaaaagguuaccgaagugaaaggcuacacaaagggugggcccggacacgaggaaccgaucccaauggcuacguacggcuggaacuuagucaaacugcauucuggcaaggacguguuuuucauaccucccgagaaaugugauacccuucugugcgacaucggggaguccucaccaaaucccacuauugaagagggaaggacacuacggguccucaagaugguggaaccuuggcugcgcgguaaccaguuuuguaucaagauuuugaauccguauaugcccagcguuguagagacccuggagcaaaugcagagaaaacacggcgggaugcucgugaggaacccacuuucgcgaaauucuacucaugaaauguacugggucaguugcggaacaggcaacaucguguccgcaguuaauaugaccagccggaugcuguuaaaccguuucacgauggcccacagaaagccuaccuaugagcgcgauguggaccuggguacagggacuaggcacgucgcuguggaacccgagguagccaacuuggauauuaucggacagcggauagaaaauauuaaacaugagcacaagucaaccuggcauuacgacgaggauaacccuuauaaaacaugggcauaccacggcuccuaugaagugaagccaucuggcagcgccaguuccaugguuaauggggucgugaagcuccugacuaaacccugggacgugaucccuauggucacccagaucgcuaugacagauaccacuccauuuggacaacagagaguuuucaaggagaaaguggacacgcgcacacccaaggcgaaaagggguaccgcccagauuauggaaguaacugcacgauggcuauggggcuuucuuagccggaacaagaagccgagaauauguaccagggaggaguucacacgcaaagugcguucuaaugcugccaucggggcagucuuuguggacgagaaccaauggaacucagccaaggaggcuguugaagaugagcgguucugggaccuggugcauagagaaagggagcuccacaaacagggaaagugcgccacgugcgucuacaacaugaugggcaaacgcgaaaagaagcugggugaguuugggaaagcgaagggaagucgagcaauuugguacaugugguugggcgcccgguuccuggaguucgaagcucucggcuuuaugaaugaggaucacugguucuccagagaaaacagccuuucugggguggagggagagggucugcauaaauuaggcuauauccugagggacauuucgaagaucccugggggaaauauguacgccgaugacaccgcaggcugggauacucgcauaacagaagacgauuugcagaacgaggcuaaaaucaccgacauuauggaaccagagcacgcccuccuggcuaaggccaucuuuaaacuaacuuaucagaauaagguaguuagagugcaacggcccgcaaagaacgguacagucauggaugugauuucaaggcgugaccagcgagggagcggacaggugggcaccuacggccuuaauacauucacuaacauggaagcgcagcugauccgccaaauggaguccgaggggauauuuaguccuucugaacucgagaccccaaaccuggccgaaagagcuuuggauugguuagagaaauauggaauugaacggcugaagaggauggccaucagcggugacgacugugucguuaaacccaucgaugaccgcuucgcaacggcucucaccgcccuuaaugauaugggcaaggugagaaaagacauuccgcagugggagccuuccaagggguggaacgauuggcagcagguacccuuuugcucacaucacuuccaccaacugauaaugaaggacggacgggagaucguggucccauguaggaaucaggaugagcuggugggccgagcacguguuagucagggugccggguggucucugagagagacagcgugccucggaaaaagcuacgcucagauguggcaauugauguauuuucaucgccgggaccugaggcuugccgcaaacgccauuuguuccgcugugccugucgauugggugcccacuucaagaaccacauggagcauccacgcccaucaccaguggaugacuaccgaagacaugcugucuguauggaaucgcguuuggauugaggaaaacccauggauggaggauaagacgcauaucuccaguugggaggacgugcccuaccucggcaaacgggaagaccaguggugcggcagcuuaauagggcugacagcaagggcuaccugggccacuaauauccaagucgcgauuaaccaggugcgaagauugaucggaaaugagaacuaccuggauuauaugacaucgaugaagcgguucaaaaaugaaaccgacccugagggugcucucugguga

SEQ ID NO: 14057 - RNA, 9879 nt, Artificial Sequence
  derived and/or modified CDS sequence (opt3) from DENV-1__EU482526__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguacccccucagcaucccagcaacccuguucgugugguauuuuuggcaaaagaaaaagcagcgaucuggcguccuuugggacacgccuucacccccagaaguggagcgcgccguuuuagaugacgggauuuaccggauaaugcagagaggacugcucgguaggagccagguaggcgugggggucuuccaagaaaacguguuccacacuauguggcacguuacccguggagcgguguugauguaucagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauuuaaaacucccgaaggugagguuggcgccaucgcucuugauuucaagccugggaccucgggaagcccaauugugaacagagaaggcaaaaucgucggucuguacgggaauggagugguuacgacaucaggcacuuauguguccgccauagcacaggcuaaggccagucaggagggccccuugccugagaucgaagacgaggucuuuaggaaacgaaaccuaaccauuauggaucugcauccggggucuggaaagacacggcgcuaccucccagcgaucgugagagaagccauuaagaggaaauuacggacccugauccuugcacccacucgaguaguggcuagcgagauggccgaagcucugaaggguaugccuauaagauaucaaaccacagcaguuaaauccgagcacacgggcaaggagauugucgaccucaugugccaugccacuuucaccaugcgcuugcugucaccagugagggugcccaauuacaacaugaucaucauggaugaagcccacuuuacagacccuucuagcauugcugcgcguggguauaucaguacccgggucggaaugggcgaggcagccgcuauauucaugacugccacaccgcccgguuccguagaagcauuuccacagagcaaugccgugauucaggaugaggaaagagacaucccugagaggucuuggaacucaggguacgaguggauuaccgauuuccccggaaaaacgguuugguuugugccauccaucaagaguggcaaugacauagcuaacugucuccgcaagaauggcaaacgagucauucagcugagcagaaagacuuucgauacagaauaucagaaaaccaagaacaacgacugggacuacgugguuaccacugauaucucggagaugggggcgaauuuucgggccgacagggugaucgauccucgccguugccuuaaacccgucauucuaaaggacggaccagaaagagugauccuggcagguccgaugccuguaacaguggcuucugccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaaguccgcggcaaucgauggggaguaccggcugaggggcgaggcccgcaaaacuuucguugaacuuaugagaaggggagaccugccagucuggcucagcuauaagguggcuucagagggcuuucaauacagugaucggcguuggugcuucgacggggaacgcaacaaucagguguuggaggaaaacauggaugucgagauuuggacgaaagagggagaacgaaagaaacugagacccagguggcuagacgcccggaccuauucugacccucuggcucuccgcgaguuuaaggaguucgcagccgguagaagguccguuagcggcgaucuuauacuggagaucgggaaguuaccgcagcauuugacacagcgggcucaaaaugcccuggacaaccucgugaugcugcacaauucagaacagggaggccgagcauacagacaugcgauggaggagcuuccagauacuauugaaacccugaugcucuuggcccugaucgcuguauuaacagguggggugacccuauuuuuccugaguggccgcggacucggcaaaacuagcauugggcuucugugugucauggccuccucuguguugcuguggauggcaagcguugagccccacuggaucgcugccuccauaauccucgaauuuuuccugauggugcuucucauuccugagcccgacaggcagcggacgccacaggauaaccaacuggcauaugucguaaucggauugcuguuuaugauuuuaaccguggccgcuaaugagaugggucuacuggaaacaacuaagaaagaccucggcaucgggcacguugcgguggagaaccaucaccaugccaccaugcuugaugucgaccugcacccugcaucagcuuggacauuguacgccguggccaccacuauaauuacacccaugaugcgucauacgaucgaaaacaccacugcaaauauuucucugacagcuaucgccaaccaggcggcuauacucaugggacuggauaagggcuggccaaucaguaaaauggacauuggugucccucuuuuagcccuggggugcuacagccaggugaauccgcucaccuugaccgcagccguucugaugcuaguggcucacuaugcaaucauuggccccggacugcaagccaaggcgacaagagaggcucagaagaggacugccgcaggcaucaugaaaaacccaacgguagaugggauaguggccauugaccucgauccugucguuuacgacgcuaaguucgaaaaacagcuuggacagaucaugcuguugauccuguguaccagccaaauucuccugaugcgcacaacuugggccuuaugcgaguccaucacccuugcaacaggcccccugaccacucucugggaggguucuccagggaaguuuuggaauacgacaauagcugugucaauggccaacauuuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacaucuacaagcgcucagguauuauggaggucgaccgguccgaagccaaagagggguugaagagaggagagaccacacgucacgcagugaguaggggcacugcuaaacugcggugguucguagaacgcaaucucgugaagccugaggguaagguuaucgauuuaggcugugggcgaggaggcuggagcuauuacugcgccgggcugaaaaaggugaccgaagucaaaggauauacaaagggcggucccgggcaugaggaaccgauaccaauggccacguacggauggaaccuugugaaacugcacucuggcaaggacgucuuuuucaccccucccgagaaaugugauacucuacucugcgacaucggcgaguccucaccaaaucccacaauugaagaggggagaacccugaggguguugaagaugguugaaccuuggcugcggggaaaccaauuuuguaucaagauucucaauccguacaugcccagcguaguggagacucuugagcagaugcagcgcaaacaugguggcaugcuggucagaaacccauuaucgagaaauucuacacacgaaauguauugggugaguugcgggaccggaaacaucguuuccgcggugaauaugacgagccgaaugcuguugaaccgguucaccauggcucaccguaagccuacauacgagagagaugucgaccucggcgcagguacucgccauguggccguagaacccgagguggcuaaccuggauauuaucgggcagaggauagaaaauauuaaacacgagcauaagucaaccuggcacuaugacgaggauaacccuuacaaaacaugggccuaucauggauccuacgaaguuaagccaucuggcagcgcaaguuccauggucaauggcguggugaagcuacuuacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcugugggguuuucucagccgaaacaagaagccgcggauauguaccagagaggaguucacaaggaaaguccgcucuaaugcagcuaucggcgccguguuuguugacgagaaccaguggaacucagcaaaggaggccguggaagaugagcguuucugggaccugguccagaaagaacgggaguugcacaagcaggggaaaugcgcuacgugcguguauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguagagggggagggacugcauaaguuggguuacauccuccgggacauuucgaaaaucccuggcgggaauauguaugcugaugacaccgccggaugggauacuagaauaacagaagacgaucugcaaaacgaggcaaagaucaccgacauuauggaaccagagcacgcucuacuugccacuucaaucuuuaaacugacauaccagaauaagguugugaggguccagcgccccgcuaagaacggcaccgugauggaugugauuagcagacgggaccagagggguuccgggcaagucggaacauauggccucaauacuuucaccaacauggaagcccagcugauccgucagauggagagugagggcauauuuucuccuagcgaauuggagauuccaaacuuagcagaacgaguucuggauuggcucgagaaauacgggguggaacgccuuaagagaauggcgaucuccggagacgacuguguagugaaacccaucgaugaccgguucgccacggcucugaccgcccuaaaugauauggguaaggucaggaaagacgugccgcagugggagccuucaaagggcuggaacgauuggcaacagguucccuuuugcagucaucacuuccaccagcugauuaugaaggacgggcgcgagauaguggucccauguagaaaucaggaugaacucgugggacgggcaaggguaucucaaggcgcugguuggagcuugcgagagacagccugccuggggaaauccuaugcacagauguggcagcuuauguacuuucaucguagagaccugcgccucgccgcgaacgcuaucuguucagccguuccuguggauuggguccccacuagccggaccacauggucuauucacgcacaucaccaauggaugacuaccgaagacauguuauccguguggaauaggguuuggaucgaggaaaacccauggauggaggauaagacgcaugugaguagcuggggagacguccccuaucugggcaaaagagaggaccaguggugcggcucguugauugggcugacagcccgcgcuaccugggccuccaauauccagguggcaauaaaccagguacggaggcucaucggaaaugaaaacuaccuugauuacaugacuucuaugaagcgauucaaaaaugagggugacccugaaggcgcucugugguga

SEQ ID NO: 14058 - RNA, 9879 nt, Artificial Sequence
  derived and/or modified CDS sequence (opt3) from DENV-1__EU482527__SS-prME
agcgugacaaugcugcuaaugcuuaugcccacagcacuggcuuuccacuugacuacgcgaggcggggagccucauaugaucgucuccaagcaggaaaggggaaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguuccguggcacuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugggaaaggagugacccaaaacggccgccuuauuacugcaaaucccaucguaacagacaaggaaaaaccugucaacauagaggccgaaccacccuucggugaguccuauauugugaucggggcuggcgagaaggccuugaagcugucaugguuuaaaaagggaaguagcaucggcaaaauguucgaagcaaccgccagaggggcuaggcggauggccauucucggagauacugcaugggacuuugguuccaucggcgggguuuucaccucugugggaaagcugguccaucagauuuuuggcacagcguacggugugcuuuucagcgggguaucauggacgaugaaaauaggcaucggagugcuguugaccuggcucggccugaauagucgauccacuagcuuaucuaugacauguauugcuguugggcuggucacccuauaccucggagugauggugcaggccgauucaggcugcgucaucaacuggaagggucgcgagcugaagugugggaguggaaucuuuguuacaaaugaagugcacacuuggaccgagcaguauaaauuccaagcagacagcccgaagagacuuuccgccgcuauuggcaaagccugggaagagggugugugcggcauaaggucugcaacgcgguuggagaacaucauguggaagcagauuucgaacgaacugaaucauauccuccuggagaacgacaugaaauuuacaguagucgugggggauguugcuggaauuuuagcccagggcaagaaaaugauccgcccucagcccauggaauacaaguauagcuggaaguccugggggaaagcgaagauaaucggagccgacgugcaaaauaccacuuucauuaucgauggcccaaacaccccugagugucccgacgaucagagagcuuggaauauuugggaagucgaggacuacgguuuugggaucuucacaacuaacauauggcugaaacuuagggauucauauacccaggugugcgaccaccguuugaugagugcagccauuaaggauucuaaagcuguucacgccgacaugggauacuggaucgagagcgaaaagaaugagacauggaagcucgcacgggcguccuucauugaagugaaaacguguaucuggccaaagucacauacccuguggagcaacggcguacuagagucugaaaugauaauccccaaaauuuaugguggcccuaucucccagcacaauuaccgaccaggguacuuuacucaaacagccggaccguggcaucugggcaagcucgagcuggauuucgaccuuugcgaggggaccacugucgugguggaugaacacugcggaaacagaggccccaguuugaggacaaccacggucacugguaaaauuauccacgagugguguugccgcagcuguacccugccuccauuacgguuuaagggggaagacggaugcugguauggcauggagauaagacccguuaaggagaaagaagagaaucucgugaagucuaugguauccgcugguucaggcgaaguggacaguuucagccuggggcuucuguguauuucgaucaugaucgaggaagucaugaggucccgcuggucucgaaaaauguugaugacaggaacccucgccguguuuuuccugcuaauuaugggccagcugacuuggaacgaucucauccggcugugcauuaugguuggggcaaaugcuagcgaccguaugggaaugggcacaaccuaccuugccuugauggcaacauuuaagaugagaccuauguucgccgugggucuguuauuuaggcgccucacuucacgggagguccugcuucugaccauagggcuaagucucguggcuuucguugagcugccaaacuccuuggaggaacugggagauggcuuagcgaugggcaucaugauucucaaacugcuuacggacuuucagucucaucaacugugggccacauugcucagccugaccuucaucaagacuaccuuuucccuacacuaugcauggaagacaauggcuauggugcugucaauugucagccuuuucccccucugucugaguacuaccucucagaaaacgacaugguugccgguacuguuagggucccucggaugcaagccucugaccauguuccuuaucgccgaaaauaaaauaugggguagaaagagcuggccacugaacgagggcaucauggccguggggauuguuucgaucuugcucucaucucugcucaagaacgaugugccccuggcuggaccucuuauugcaggcgguaugcucaucgccuguuacgucauaaguggguccagcgcggaccugucuuuggaaaaggcugccgaggugagcugggaggaagaggcagaacauuccggagccucacacaauauuuuaguagaggugcaggaugacggcacuaugaaaaucaaggaugaagagagggacgauacacugaccauccuccugaaggcuacucuucuggcagucaguggcguuuaucccuugagcauuccagccacacuauuugugugguacuucuggcagaaaaagaaacaacgaucuggggugcugugggacaccccuucacccccggaggucgaacgcgcggugcucgaugacggaauauaucggaucaugcagagaggucugcuuggcaggagccagguugggguaggaguguuucaggagaacgucuuccauacgauguggcacgugacucguggcgcuguuuuaauguaccaagguaagcgccuggaaccgaguugggccagcgugaaaaaggaccucauuuccuacgggggaggcuggcgguugcagggcucuuggaauaccggggaggagguccaggugaucgcaguagaaccuggaaagaaccccaaaaauguccagacagccccagguaccuuuaagacaucggagggcgaagugggggcuauugcccuggauuucaaacccggaacuagcggcucaccuaucguuaacagagaggguaagauaguggggcucuauggaaauggcgucgugaccacguccggcacauacguuagugcaaucgcucaagccaaagcgucucaggaagggccacugcccgagauugaggacgaaguguuuaggaagcgaaaccuuacuaucauggaucugcacccuggaagcgguaagacccggcgcuauuugccggccauugucagagaggcaaucaaaaggaagcuacggacacugauacucgcuccaacccgagugguagccuccgaaauggcugaggcauuaaaaggcaugcccauuagauaccagacuaccgccgugaagucagaacauacagggaaagagaucguugaccugaugugccacgccacguucacuaugcgccuucugucuccugucagggugccaaauuauaacaugaucauuauggaugaggcucauuuuaccgaccccagcaguaucgcggcacguggauacauauccacacgggugggcaugggugaagccgcugccauuuucaugaccgcaacuccuccggggagcgucgaggccuuuccccaaucuaaugcuguaauccaggaugaagagagagacauuccagaaaggucauggaacuccggauaugaguggaucacagauuucccuggcaagaccgugugguucguucccaguauaaagagcggcaaugacauugcgaacugucuccgcaaaaaugggaagcgagugauccaguugucgagaaaaacguuugauacugaguaccagaagaccaaaaacaacgacugggacuacgucgugaccaccgauaucucugaaaugggagccaauuuccgggcagacaggguuauugauccacgccguugccugaagccugugauccucaaggacggucccgagagagucauucuggcuggcccaaugccggugacuguagccuccgcagcccaacggagggggcgcauaggacgaaaccacaauaaagaaggcgaucaguauaucuacaugggucagccucuuaacaaugacgaggaucaugcucacuggacagaggccaagaugcuacuggacaacauuaauacccccgaagggaucaucccagcguuguuugagcccgaaagagagaaaagcgcagccauugauggcgaauaucgguuaaggggagaggcucgcaagacauucguggagcugaugagaaggggcgaccucccuguuuggcugucauacaaagucgccagugaaggguuucaguauucugaucggcguuggugcuucgacggagagcgcaacaaucaagugcuugaagagaacauggauguggaaauauggacuaaggagggugagaggaaaaagcugagaccaagauggcucgacgcucggacguacuccgaccccuuggcacugcgcgaauuuaaggaguucgccgcuggcagaaggagcgucucaggggaucuaauccuggaaauuggaaaacucccucagcaccuuacccagcgggcccagaaugcacuggacaacuuaguuauguugcauaauagugagcaaggcggucgagcguauagacacgccauggaggaacugccggauacaaucgagacucucaugcugcuugcucugauugccgugcucaccgggggcguaacauuguuuuuccugagcggacgcggcuuagggaagaccuccaucggacuacugugugugauggcaucuagcguccuccuuuggauggcuuccguggaaccacauuggauagccgcaucaaucauucuggaguuuuucuugaugguucugcucauccccgaaccugacaggcagcggacuccccaggauaaccagcuggccuacguggucauuggucuucucuuuaugauccugacgguagcugcgaaugagaugggcuugcuggagaccaccaaaaaggacuuagggauaggacacguggccguugaaaaccaccaucacgcagcuaugcuagauguggaccugcauccagccucugccuggacucucuacgcagucgcuaccacaauuaucaccccuaugaugcgucacacuauugagaacacaacggccaauaucagucuuaccgcgauagcuaaccaagccgcaauccugaugggcuuggauaaagguuggcccauuucgaagauggacaucggggugccacugcucgcccugggcugcuauagccaggucaauccucuuacuuuaacagcugcagugcugaugcucguugcccauuacgcgauuaucggaccgggcuugcaggcuaaggccaccagagaagcacagaaaaggaccgccgcugggauaaugaagaaccccacaguggauggaauuguagccaucgaccuggauccaguggucuaugacgcaaaauucgagaagcagcuaggccagaucaugcugcucauucuuuguacuucccagauccuguugaugcgcacgaccugggcucugugcgaaucuauaacacucgccacugguccucugaccacauuaugggaggggucacccggaaaauucuggaauaccacuauugcgguuagcauggccaacaucuuucggggcuccuaccuugccggugcuggccuggccuucagucucaugaagucucuagggggaggccgaagagggacgggagcacaaggcgagacacugggugaaaaguggaaaaggcaguugaaucagcugagcaagucagaguuuaacaccuauaaacgcuccgggauuauggaaguggaccggagugaggcuaaggaaggacucaaaagaggcgagacuaccaagcacgccgucagccgugguacagccaaacuuaggugguucguggagcggaaucugguaaaaccagaaggcaaggugaucgauuugggguguggacgcggcggguggucuuacuauugcgcgggacugaaaaagguuacugaggugaaaggcuacaccaagggugggccuggacacgaggaacccauaccgauggcuacauacggcuggaaccucgucaaauuacauuccggcaaggacguguuuuucaucccaccugaaaagugugauacgcugcuuugcgacauuggggagucaagccccaauccaaccaucgaggaaggacgaacucugagaguccuaaaaaugguggagcccuggcucagggguaaccaguuuuguauuaagauccugaauccuuauaugccgucgguuguagaaacauuggagcaaaugcagcggaaacacggcgggaugcuggugcgcaacccccucucuagaaauaguacccaugagauguacugggucuccugcggaacuggcaacauugugagcgcaguuaauaugacaucaaggaugcuucugaaccgauucaccauggcccaccggaagccaacguaugaacgugauguggacuuaggugcugggaccagacacgucgccguggagccugaaguagcaaaccuggauaucauaggacagcgcauugagaauaucaaacaugaacacaaguccacauggcauuacgacgaggauaaccccuauaagacuugggccuaccacggcucuuaugaggugaaaccuagcggcagugcuuccagcaugguuaauggggucgugaaguugcucaccaaaccaugggacgugauccccauggucacacagauugcgaugacugauaccacaccuuuuggacaacagaggguuuucaaggaaaaaguggacacccggacuccaaaggccaagagagguacggcacagauaauggagguaacagcuaaauggcuguggggcuuucuaucucgcaacaagaaacccaggaucuguacccgagaagaguucacucggaaggugagaucaaaugccgcaauuggggccgucuuuguggacgaaaaccaauggaauagugcuaaagaggccguugaggaugaaagguucugggaccuugugcaucgcgagcgugaacugcacaagcagggaaagugcgcgaccugcgucuacaacaugaugggcaaacgggagaagaaacucggugaguucgggaaggcaaaaggauccagagccaucugguacauguggcugggcgcuagguuuuuggaguucgaggcccugggcuuuaugaaugaagaucacugguucagccgcgagaacucucucucggggguggaaggagagggucuucauaagcugggcuauauuuuacgagacaucucaaaaauaccagggggaaauauguacgcagaugacacagcuggcugggauacgcggaucaccgaggacgaucugcagaacgaagccaagauuacugacaucauggagccugaacacgcuuugcucgccaagagcauuuuuaaacugacauaucagaauaagguaguuagagugcaaaggccagccaaaaacgguaccgucauggaugugaucucccgcagagaccagcgggggaguggacaggugggcacuuacggccuaaauacauucaccaacauggaggcgcagcuuauaaggcaaauggaaucugaggggauuuuuagccccuccgagcuggaaacaccuaaccucgccggacguguccuggauugguuggagaagcaugguguugaacgauuaaaacgcauggcuaucucaggcgacgacugugugguaaagccaaucgaugacagauucgccacugcacugaccgcucucaaugauauggggaaggugcggaaagacauuccccagugggagccgaguaagggauggaacgauuggcagcaggucccuuuuugcucucaccacuuccaucaacuuauaaugaaagacggcagggaaaucgugguucccugucgcaaucaggaugagcugguggguagagcccgggucagccagggggcaggauggucccuaagggagacggccugccugggcaagucauaugcgcagauguggcaacucauguacuuucaccgacgugacuugagacuggcugccaacgcaauuuguagcgccgugccaguagauuggguuccuaccucucgcacaacuugguccauccaugcucaccaucaguggaugaccacagaagacaugcuuaguguguggaaucgggucuggauugaggaaaaccccuggauggaggauaaaacucacaucagcucguggggcgacgugccauaucuggggaagagggaagaccaguggugcggaucccucauagguuuaaccgccagagcaacgugggcuacaaauauccaaguugccauuaaccaggugcgccggcugaucggcaaugagaacuacuuggauuacaugaccucuaugaagagguucaaaaaugagucagaccccgaaggggcgcugugguga

SEQ ID NO: 14059 - RNA, 9879 nt, Artificial Sequence
  derived and/or modified CDS sequence (opt3) from DENV-1__EU482528__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggccauggugcaggcagauucaggaugcgugauuaacuggaagggccgcgaacugaagugugguagugggaucuuugucacuaaugagguucacaccuggacggaacaguauaaauuccaagccgacagcccgaagagacuuuccgcugccaucggaaaagcaugggaggagggcgugugcgguauuaggucugcuacacgguuggaaaacauaauguggaagcagaucucgaacgagcugaaucauauucuccuggaaaacgacaugaaauuuaccgugguagucggcgauguggccgggaucuuagcgcagggaaagaaaaugauucgcccucagcccauggaguacaagcacagcuggaaguccuggggcaaagccaagaucauaggggcugacguucaaaauacuaccuucaucauugauggaccaaacacaccugaaugucccgacgaucagagagcauggaauaucugggagguggaggacuauggcuuugguauuuucacuaccaacaucuggcugaaacuuagggauucauacacacaggucugcgaccaccguuugaugagugccgcuauaaaggauucuaaagccgugcaugcagacaugggguauuggauugaaagcgagaagaaugaaacguggaagcucgcgcgggccuccuucaucgagguuaaaaccuguauuuggccaaagucacacacucuguggagcaacggagugcuagaaucugagaugaucauacccaaaaucuacggcgguccuauuucccagcauaauuaucgaccaggcuacuuuacacaaaccgcugggccguggcaccugggaaagcucgagcuggauuucgaccuuugcgaaggcacuacaguagucguggaugagcacugcgggaacagaggacccaguuugaggaccacgacugugaccggcaaaaucauucaugaaugguguugccgcagcuguacacugccuccauuacgguuuaagggugaggacgggugcugguacggaauggagaucagacccgucaaggaaaaagaggaaaaucucguuaagucuaugguguccgccggcucaggugagguagacaguuucagccugggccuucuguguauaucgauuaugaucgaagaggugaugaggucccgcuggucucgaaaaauguugaugaccgggacucucgcagucuuuuuccugcuaaucaugggacagcugacauggaacgaucucauucggcugugcaucauggugggcgcuaaugccagcgaccguauggggaugggaaccacauaucuugcauugauggccacuuuuaagaugagaccuauguucgcuguuggccuguuauuuaggcgccucaccucacgggaggugcugcuucugacgauuggucuaagucucgucgcguccguggaacugccaaacucuuuggaggaacugggggauggauuagccaugggcauaaugauccucaaacugcuuacagacuuccagagccaccaacugugggcaaccuugcucucccugacuuuuauuaagaccacauucucacuacauuacgcuuggaagacuauggccaugguucugagcaucgugagucuuuuuccccucugucugucuaccacgucccagaaaacaaccugguugccgguccuguuaggcagccucgggugcaagccucugacuauguuccuuauugccgagaauaaaaucuggggaagaaagucguggccacugaacgaagguauaauggcuguaggcaucgugucaauuuugcucucuagucugcucaagaaugauguuccccuggcagggccucuuaucgccggaggcaugcucauugcguguuaugugaucuccgguagcucugcugaccugagcuuggagaaggccgcagaggucuccugggaagaggaagccgagcacucaggggcuagucauaauauauuaguggaaguacaggaugacggaacaaugaaaauuaaggaugaggagagggacgauacccugacuauccuccugaaggcaacacuucuggccgugagcggcgucuaccccuugucuaucccagcgacccuauucguuugguauuuuuggcagaaaaagaaacaacgauccggcgugcugugggacacgccuucacccccagaaguggagcgcgcuguccucgaugacgggauuuaccggauaaugcagagaggacugcuugguaggagucaggugggcguugggguauuccaggaaaacguguuucacacuauguggcacgucacccguggagccguguuaauguaucaaggcaagcgccuggagccgagcugggcauccguuaaaaaggaccucaucucuuacggugggggauggcgguugcagggcucguggaauacaggcgaggaagugcaggucauugccguggagccugggaagaaccccaaaaauguacagaccgcuccaggaacauucaagacuagcgaaggugaggucggcgccaucgcacuggauuuuaaacccgggaccucaggauccccuauugugaacagagaaggcaagaucguuggucucuacgggaauggaguggucacgacaaguggcacuuaugugucugcuauagcccaagcgaaagccagccaggagggcccacugcccgagaucgaagacgagguuuucaggaagcgaaaccuuaccauuauggaucugcauccuggguccggaaagacacggcgcuacuugccggcaaucgugagagaagcuauuaaaaggaagcuacggacccugauccucgccccaacucgagucguggcuucagagauggcagaagccuuaaaagguaugcccauaagauaucagaccacagccguaaagucugagcacacgggcaaagagauuguggaccugaugugccaugcuacuuuuaccaugcgccuucugagcccuguuagggucccaaauuacaacaugaucaucauggaugaagcgcacuucacagaccccaguuccauugcagcccguggguauaucagcacccgggugggaaugggcgaggcugccgcaauauuuaugacugccacaccuccggguucuguggaggcuuucccccaaucaaaugcggucauucaggaugaggaaagagacaucccagagagguccuggaacaguggguacgaguggauuaccgauuuuccuggaaagacgguaugguucgugcccagcaucaagucgggcaaugacauagccaacugucuccgcaaaaauggcaagcgaguuauucaguugucuagaaaaacuuucgauacagaauaucagaagaccaaaaacaacgacugggacuacguggucaccacugauaucuccgagaugggggcaaauuuucgggcugacagggugaucgauccacgccguugccugaagccuguuauucucaaggacggacccgaaagagugauccuggccgguccaaugccggucacaguggcaagcgccgcucaacggaggggccgcauugggcgaaaccauaauaaagagggagaucaguacauauauaugggccagccucuuaacaaugacgaggaucacgcccacuggaccgaagcgaagaugcuacuggacaacaucaauacacccgaggguauuaucccagcauuguucgaacccgagagagaaaaaucagccgcuaucgauggggaguaccgguuaaggggcgaggcccgcaagacuuuuguagaacugaugagaaggggagaccucccuguguggcugaguuauaaaguugcuucugagggcuuccaguacuccgaucggcguuggugcuuugacggggaacgcaacaaucaaguccuugaggaaaacauggauguggagauuuggacgaaggagggagaacgaaagaaacugagaccaagguggcucgacgcacggaccuauagcgaccccuuggcccugcgcgaguucaaagaauuugcugccgguagaaggucagugaguggcgaucuaauacuggagaucgggaaacucccucagcaucuuacacagcgggcacagaaugcgcuggacaacuuagucauguugcacaauagcgaacaaggaggccgagccuacagacaugcuauggaggagcugccggauacuauugaaacccucaugcugcuugcccugaucgcaguucucacagguggggugaccuuguucuuucuguccggccgcggauuaggcaagacuucuauugggcuacuguguguaauggcuagcuccgugcuccuuuggauggccucagucgagccacacuggaucgcagccucuauaauccuggaguucuuuuugauggugcugcucauucccgagccugacaggcagcggacgccccaggauaaccagcuggcuuauguugugaucggacuucucuucaugauucugaccgucgcggccaaugagauggguuugcuggaaacaacuaaaaaggacuuaggcaucgggcacguagcaguggagaaccaucaccaugcugccaugcuagauguugaccugcacccagccagugcauggacccucuacgcuguggccacaaccauaauuacuccuaugaugcgucauacaaucgaaaacacgaccgcgaauauuucgcuuacugcuaucgccaaccaagcagccauacugaugggauuggauaaaggcuggcccaucagcaagauggacauuggugucccacugcucgcucuggggugcuacucccaggugaauccucuuacauuaaccgcagccguccugaugcucguggcgcacuaugcuaucauuggcccgggauugcaggccaaggcaaccagagaggcccagaagaggacagcugccggcaucaugaagaaccccacuguugaugggauaguggcaauugaccuggauccaguaguguacgacgcuaaauuugaaaagcagcuaggacagaucaugcugcucauccuuuguacgucucagauucuguugaugcgcaccacaugggcccugugcgagucaaucacucucgcgaccggcccucugacaaccuuaugggaggguagccccgggaaauucuggaauacuacgauagccgucuccauggcaaacauuuuccggggaaguuaucuugcuggcgccggucuggcauuuucucucaugaaaagccuaggcgggggacgaagaggcacaggggcucaaggagaaacccugggcgagaaguggaaaaggcaguugaaucagcugucaaaguccgaguucaacacuuacaaacgcagugguaucauggagguugaccggagcgaagccaaggaggggcucaaaagaggagagaccacaaagcacgccgugucucguggcacugcgaaacuuaggugguuugucgaacggaaucuggugaaaccagaggguaagguaauugauuugggcugugggcgcggaggcugguccuauuacugcgcugggcugaaaaaggugaccgaaguuaaaggauauacaaagggcgguccugggcaugaggaacccaucccgauggcaacguacggauggaaccucgugaaauuacacucaggcaaggacgucuucuuuauaccaccugagaagugugauacccugcuuugcgacaucggcgagagcucgcccaauccaacuauugaagaggggcgaacacugagagugcuaaaaauggucgaacccuggcucaggggaaaccaguucuguaucaagauucugaauccuuacaugccgucugugguugagaccuuggagcaaaugcagcggaaacaugguggcaugcugguacgcaacccccucaguagaaauuccacucacgaaauguauugggugagcugcgggacaggaaacaucgucucagccgugaauaugaccuccaggaugcuucugaaccgauuuacgauggcucaccggaagccaaccuacgagcgugauguugacuuaggcgccgguacaagacauguggcagucgaaccugagguggccaaccuggauauuaucgggcagcgcauagaaaauauuaaacacgagcauaagucuacuuggcacuaugacgaggauaaccccuacaagaccugggcuuaucauggaagcuacgaaguaaaaccuaguggcuccgcgagcucuauggugaauggcguugucaaguugcucacaaaaccaugggacgugauccccauggugacucagaucgccaugaccgauacaaccccuuucgggcaacagagggucuuuaaggagaaaguugacacucggacgccaaaggcaaagagaggaacagcucagauuauggaagugaccgccaaauggcugugggguuuccuaucacgcaacaagaaacccaggauauguacucgagaggaauuuacccggaagguaagaaguaaugcagccaucggcgcuguguucgucgacgagaaccaauggaacuccgccaaagaggcgguggaagaugagagguuuugggaccuuguucaccgcgaacgugagcugcacaagcaggggaagugcgcaacaugcguguauaacaugaugggaaaacgggaaaagaaacucggcgaguucgguaaggccaaagggagcagagcuauuugguacauguggcugggagccagguucuuggaguuugaagcacugggcuucaugaaugaggaucauugguuuucucgcgaaaacucgcucucaggcgucgagggggagggacuucacaagcuggguuacaucuuacgagacauuagcaaaaucccgggcgggaauauguaugcugaugacacggccggaugggauacccggauaacugaagacgaucugcagaacgaggcuaagaucacagacauuauggaaccugagcaugccuugcucgcaaaguccaucuucaaacugaccuaccagaauaaggugguaagaguucaaaggccagcgaaaaacggcacugugauggaugucauuagucgcagagaccagcgggguucuggacaggugggaacauauggccuaaauaccuuuacaaacauggaagcccagcuuaucaggcaaauggagagcgagggcauauucucccccucagaacuggagacuccuaaccucgcugggcgugugcuggauugguuggaaaagcacggagucgagcgauuaaaacgcauggccauuaguggugacgacuguguugugaagccaaucgaugacagauuugcaaccgcucugacggcccucaaugauaugggcaagguacggaaagacaucccccagugggaaccgucuaagggguggaacgauuggcaacaggugccuuucugcagccaccauuuucaccaacuuauuaugaaagacggaaggggcauagucgugcccugucgcaaucaggaugagcugguugguagagcacgggugucccagggggccggauggucacuaagggagaccgcgugccugggcaagagcuacgcucagauguggcaacucauguauuuccaucgacgugacuugagacuggccgcaaacgccaucuguucugcugucccaguggauuggguaccuacaucccgcacuaccuggaguauucacgcccaucaccaguggaugacaacugaagacaugcuuagcguuuggaaucggguguggaucgaggaaaaccccuggauggaggauaaaacccacauuucguccuggggcgacgucccauaccuggggaagagggaagaccaguggugcggaucucucaucgguuuaacggcaagagcuacaugggccaccaauauacaaguggcgaucaaccagguucgccggcugauuggcaaugagaacuauuuggauuacaugacuucaaugaagagguuuaaaaaugagagcgaccccgaaggggcucugugguga

SEQ ID NO: 14060 - RNA, 9879 nt, Artificial Sequence
  derived and/or modified CDS sequence (opt3) from DENV-1__EU482529__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacacugcaagagaccuggaaucggcaggacuugcucguaacauucaaaacugcacacgcuaagaagcaggaaguugugguccuggguagccaagagggggccaugcacaccgcuuuaacgggcgccaccgaaauccagacaaguggaacuaccacaauuuuugcaggccaucugaaaugccgucuaaagauggauaaacucacucugaaggggaugucuuaugugauguguaccggauccuucaaacuugagaaggaagucgccgagacgcagcacgguacaguguugguucagauaaaguacgagggcaccgacgcuccuugcaaaaucccauucagcacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagccacacgcaggucugcgaccaccgucugauguccgcugcaaucaaagauucaaaggccgugcaugcugacaugggguauuggauugaaagugagaaaaaugaaaccuggaagcuagcccgggcaucuuucaucgagguuaagacuuguauauggccaaaaagccacacacugugguccaacggagugcucgaaucagagaugaucauucccaagaucuacggcgguccuauuagccaacauaauuaucgaccaggcuacuucacccagacugcggggccguggcaccugggaaaacuugaguuggauuuugaccugugcgaaggcacaaccguagucguggaugagcacugcgggaacagaggacccucuuuaaggacgacuaccgugacaggcaagaucauacaugaaugguguugccgcuccuguacccucccuccacugcgguucagaggugaggacgggugcugguacggaauggagauuaggcccgucaaagaaaaggaggaaaaucuuguuaagaguauggugagcgccggcucuggugagguagacuccuuuucacugggcuugcucuguaucaguaucaugauugaagaggugaugcgcagccgauggucgcggaaaaugcugaugacugggacacuagcugucuucuuucugcucaucaugggacagcugaccuggaacgaucuuauucguuugugcauaauggugggcgccaaugcauccgacagaauggggaugggaacaacuuaucuggcuuuaauggccaccuucaagaugaggccuauguuugcaguuggccuccuguuccgccggcuuacgucuagagaggugcugcuacucacaaucggucugagcuuggucgccucaguggaacugccaaacaguuuagaggaacucggggauggacuggcuaugggcauuaugauccuuaaacuguugaccgacuuucaaucccaccagcucugggcgacucugcuaucucugaccuucauuaagacaacuuuuagccuucauuacgccuggaaaaccauggcaaugguucucuccaucgugucacuguuccccuugugucugagcacgacaagucagaagaccacuugguuaccgguccuccugggcucucuugggugcaagccucugacaauguuuuugauagcugagaauaaaaucuggggaaggcgauccuggccacucaacgaagguauuauggccguaggcaucgugagcauucugcuaucgucacugcuuaagaacgauguuccccucgccgggccucugaucgcuggaggcauguugauagcauguuaugugauuucugguaguuccgccgacuuaagccuggagaaagcggcugaggucucuugggaagaggaagccgagcacagcggggcaucccauaauauccucguggaaguacaggaugacggaaccaugaagaucaaagaugaggagcgcgacgauacucugacaauucuucugaaggccaccuugcuagcugugucaggcgucuacccccugaguauaccagcaacacucuucguuugguauuucuggcagaagaagaagcagcggagcggcgugcugugggacacuccuucucccccagaaguggagagagccguccuugaugacgggaucuacaggauuaugcagcguggauuacugggucgcucccaggugggcguugggguauuucaagaaaacguguuccacaccauguggcacgucacacggggagcggugcucauguaucagggcaaaagauuggagccgucaugggcuaguguuaagaaagaccugaucagcuacggugggggauggaggcuccagggcuccuggaauaccggcgaggaagugcaggucauugccguggagccugggaagaaccccaaaaauguacaaacagcaccaggaacuuuuaagacccccgaaggugaggucggcgccaucgcucuggauuucaagccugggacgucuggaucgccaauagugaaccgagaaggcaaaaucguuggucuuuacgggaauggaguggucacaacuagcggcaccuaugugucagccauugcacaggcuaaggccucccaggagggcccccugccugagaucgaagacgagguuuuucggaaacgcaacuugacaauuauggaucuacauccggggaguggaaagaccagaagguaccugccagcgaucgugcgggaagccauaaaacgaaagcucagaacuuuaauucuggcacccacccgcgucguggcuucugagauggccgaagcucuuaaggguaugccuaucagguaucaaacaacggcaguaaaaagcgagcacacuggcaaggagaucguggaccugaugugccaugccaccuucacaaugcgucucuuguccccaguucggguccccaauuacaacaugauuaucauggaugaagcccacuuuaccgacccuucaucuauagcugcgagaggguauauuagcacuagggugggaaugggcgaggcagccgcuaucuucaugacagccaccccgcccgguaguguggaagcauuuccacaguccaaugccgucauucaggaugaggaacgcgacaucccugagcgaagcuggaacucuggguacgaguggauaacggauuuccccggaaaaacuguaugguuugugccaucaauuaaguccggcaaugacaucgcuaacugucugaggaaaaauggcaagcggguuauccagcucaguaggaagacauucgauaccgaauaucagaaaaccaagaacaacgacugggacuacguggucacuacagauauuagcgagaugggggcgaauuuccgcgccgaccgugugaucgauccuagacggugccugaaacccguuauucuuaaggacggaccagaaagggugauacuagcagguccgaugccugucaccguggcuucggccgcacagcgccgaggcagaaucgggcggaaccauaauaaagagggagaucaguacauuuauaugggccagccccugaacaaugacgaggaucacgcccacuggacagaagcuaagauguuguuagacaacaucaauacuccagaggguaucauucccgcccuguuugaaccugagagggaaaagucugcggcaauagauggggaguaccgccucagaggcgaggccaggaaaacguucguagaacugaugcggcguggagaccuuccaguguggcuguccuauaagguugcuagcgagggcuuucaauacucagaucgccgauggugcuucgacggggaaagaaacaaucagguccucgaggaaaacauggauguggagaucuggaccaaagagggagaaaggaagaaauugcggccccgcuggcuggacgccagaacauauagugacccucuagcucugagggaguuuaaggaguucgcagccggucggcgaucuguguccggcgaucucauucuugagaucgggaaacugccgcagcauuuaacucagagagcucaaaaugccuuggacaaccuggucaugcuccacaauagcgaacagggaggccgcgcauacaggcaugcgauggaggagcugccagauaccauugaaacacuuaugcugcucgccuugaucgcuguucugaccgguggggugacuuuauuuuuccuaucaggccggggacugggcaagacgaguauagggcuccuuuguguaauggccagcuccgugcuguuguggauggcaucugucgagccccacuggaucgcugccagcauuauccuggaauuuuuccucauggugcugcuuauuccugagcccgaccgucagagaaccccacaggauaaccaacucgcauauguugugaucggacuguuguuuaugauacugacagucgccgcuaaugagauggguuuacuagaaacuaccaagaaagaccugggcauugggcacguagcgguggagaaccaucaccaugccgcaaugcucgauguugaccuucacccugcuuccgccuggacacuguacgccguggcaaccacuaucauuacacccaugaugaggcauacgaucgaaaacaccacugcuaauauaucauugacagccaucgcgaaccaggcugccauucugaugggacucgauaagggcuggccaaucucuaaaauggacauuggugucccucugcuugcauuagggugcuacagucaggugaauccgcugacccucaccgccgcugucuugaugcugguggcacacuaugccaucauaggccccggacuacaagcgaaggcuacacgcgaggcccagaaacggacugcagccggcauuaugaagaacccaacgguugaugggaucguggcuaucgaccuggauccuguaguguacgacgccaaguucgaaaaacagcucggacagauuaugcuucugaucuuguguaccucgcaaauacugcucaugcgaacaacuugggcacugugcgagagcauuaccuuagcuacaggcccccuuaccacucugugggaggguuccccagggaaguuuuggaauacgacaaucgccgucucuauggcgaacauuuucagaggaucauaucucgccggcgcaggucuagcuuucagccugaugaaauccuugggcgggggaaggcgcggcaccggggcccagggagaaacucugggcgagaaguggaaacggcagcucaaucagcuuaguaagucugaauuuaacaccuacaagagaagcgguaucauggagguugaccguucagaagcaaaagaggggcugaagaggggagagacaacuaaacacgcugugucccggggcaccgccaaguugcgcugguucgucgaacgaaaucuggugaaaccugaggguaagguaauagaucucggcugugggagaggaggcuggaguuauuacugcgccggguuaaagaaagugacagaaguuaagggauauacgaaaggcggucccgggcaugaggaaccgaucccaauggcgaccuacggauggaaccuggugaaacuucacagcggcaaagacgucuuuuucauuccucccgagaagugugauacucugcuaugcgacaucggcgagucuuccccaaaucccacaauugaagaggggaggacccuccgggugcugaaaauggucgaaccuugguugcgcggaaaccaauuuuguaucaagauucugaauccguacaugcccucagugguugagacucucgagcagaugcagagaaagcaugguggcaugcuuguaaggaacccacugagccgaaauucgacacacgaaauguauugggugucuugcgggaccggaaacaucgucagugcugugaauaugacgucccggauguuacugaaccguuucaccauggcacacagaaaaccuacauacgagcgcgauguugacuugggcgccgguacuaggcauguggcugucgaacccgagguggccaaccucgauauaauugggcagcggaucgaaaauaucaagcacgagcauaaaagcaccuggcacuaugacgaggauaacccuuacaagacaugggcauaucauggaucauacgaaguaaaaccauccggcucugccagcaguauggugaauggcguugucaagcugcuaacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuuugggguuuucugucccgaaacaagaagccgcggauuuguaccagagaggaguucacaaggaaaguacgcagcaaugcugccaucggcgcaguguuugucgacgagaaccaguggaacucugccaaggaggcuguggaagaugagcguuucugggaccucguucaccgggaaagagagcugcacaaacaggggaagugcgccacgugcguguauaacaugaugggaaaaagggaaaagaaguugggcgaguuugguaaagcgaaggggucacgcgcaauuugguacauguggcugggagcccgauuccucgaguucgaagcucuuggcuuuaugaaugaggaucauugguucagucgggaaaacucccugagcggcgucgagggggagggauuacacaaacuggguuacaucuugagagacauaucuaagaucccuggcgggaauauguaugccgaugacaccgcaggaugggauacuaggauuacagaagacgaucuccagaacgaggcucgcaucaccgacauuauggaaccagagcaugcccugcuagcuaaaucgaucuuuaaacuuacuuaccaaaauaaagugguaagaguucagcggcccgccaagaacggcacagugauggaugucauaucaaggcgugaccagcgagguagcggacaggugggaaccuauggccugaauacauucacuaacauggaagcacaacucauucgccagauggaguccgagggcaucuuuaguccuucugaacuggagaccccaaacuuggcggaaagaguguuagauuggcuggagaaguacggggucgaacggcucaaaaggauggccaucagcggagacgacuguguugugaagcccauugaugaccgcuucgcuacggcccuuaccgcacugaaugauauggguaaaguaagaaaggacauaccgcagugggagccuuccaaaggcuggaacgauuggcagcaagugcccuuuugcucacaccacuuccaucagcuaaucaugaaggacgggcgggagauugucgugccauguaggaaucaggaugaacugguuggacgagcucgugugagucagggcgccgguuggucucucagagagacagcaugcuugggaaagagcuaugcccaaauguggcagcugauguacuuucaccgccgggaccuuaggcuggcggcuaacgccaucuguuccgcagucccuguggauuggauucccacuucaagaaccacauggagcauccaugcccaccaucaguggaugacuaccgaagacaugcucucuguauggaaucgcguuuggauagaggaaaacccauggauggaggauaaaacgcacaucuccaguuggggagacgugcccuauuuaggcaagcgggaggaccaauggugcggcagccugauuggguugacagcuagggccaccugggcaacuaauauccaggucgcuauuaaccaggugcgaagacugaucggaaaugaaaacuaccucgauuacaugacaucgaugaaacgguucaagaaugagggugacccugaaggcgcccuuugguga

SEQ ID NO: 14061 - RNA, 9879 nt, Artificial Sequence
  derived and/or modified CDS sequence (opt3) from DENV-1__EU482531__SS-prME
agcgugaccaugcugcucaugcuuaugcccacagcacuggcuuuccacuugacuacgagaggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaaaaagaugauacgcccucaacccauggagcacaaauacucguggaaaagcuggggcaaggcuaagaucauuggggccgacguccagaauaccacuuuuaucauugauggaccaaacaccccugaaugucccaaugaccagagagcguggaacaucugggagguggaggauuauggcuucgguauauuuacaacuaauauuuggcuuaaguugagggacuccuacacccaggccugcgaucaccgucucaugucagcugcaaucaaagacaguaaggccguucaugcugauaugggguauuggauugaaucugagaaaaacgaaacauggaagcuggcccgggcauccuucaucgaggugaagacguguauauggccaaaaucccacacccuauggucaaauggaguacuggaaagcgagauggucauccccaagauuuacggcgguccuaucucucaacauaacuaucgaccaggcuacuucacucagacagcggggccguggcaccucggaaaacuggagcuugacuuugauuugugcgaaggcaccacugugguggucgacgagcacugcgggaauagaggacccucccugaggacaaccacgguuacuggcaagauuauccaugaaugguguugccgcaguuguaccuuaccuccacuccgguucaaaggugaggaugggugcugguacggaauggagauaagacccgugaaggaaaaggaggaaaaccugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaaugaccuuauccgguugugcauuauggugggcgccaacgcaucugaucguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaauuccuuagaggaacucggggacggacuggcuaugggcaucaugauucuuaagcuguugacggauuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucgcugagaacaagauauggggaagaaaaagcuggccacugaacgaagguaucauggccguuggcguggucucgauucuacugucaucucuucucaagaaugacgugccccuggccgggccuuugaucgcuggaggcauguuaauugcauguuauguaaucagugguuccagcgccgaucugucucucgagaaagcggcugaggugagcugggaagaggaagccgagcacuccggggcaucacauaacauacuggucgaaguucaggacgauggaacuaugaagauuaaagacgaggagagggaugacacacuuaccauccuguugaaggccacucuacuggcugugaguggcguguacccccucagcaucccagcaacacuguucgucugguauuuuuggcaaaagaaaaagcagcgaucuggcgugcuuugggauaccccuucacccccagaaguugagcgcgccguauuagacgaugggauuuaccggauaaugcagagaggacugcucgguaggagccaggugggcgucgggguguuccaagaaaauguuuuccacacgauguggcacgugacucguggagcggucuugauguaucagggcaaacgccuggagccgaguugggcuagcgugaagaaagaccucaucuccuacggugggggauggcggcugcagggcucuuggaacaccggcgaggaaguacaggucauugccguggagccugggaagaaucccaagaacguucaaacagcaccaggaaccuuuaaaacacccgaaggugaggugggcgccaucgcucuugacuucaagccugggacuucgggaagcccaauugucaauagagaaggcaaaaucgugggucuguacgggaacggaguugugaccacgucaggcacauaugucuccgccauagcacaggcuaaggccagucaggagggccccuugccugagaucgaagaugagguguuuaggaaacgaaaucuaacuauuauggaccugcauccggggucuggaaagacccggcgcuaccucccagcgaucguaagagaagccauuaagaggaaauuacggacacugauccuugcacccacccgagugguugcuagcgagauggccgaagcucugaaggguaugccuauaagauaucaaacuaccgcagucaaauccgagcacacaggcaaggagauuguggaucucaugugccaugccacguucacuaugcgcuugcugucaccagugaggguccccaacuacaauaugaucaucauggacgaagcccacuuuaccgauccuucuagcauugcugcgcguggguauaucaguacacggguaggaaugggcgaggcagccgcuauauucaugaccgccacuccgcccgguuccguggaagcauuuccacagagcaacgccguuauucaggacgaggaaagagauaucccugagaggucuuggaacucaggguacgaguggauuacagacuuccccggaaaaaccgugugguuugucccauccaucaagaguggcaacgauauagcuaauugucuccgcaagaacggcaaacgagugauucagcugagcagaaagacguucgacacugaauaucagaaaaccaagaacaaugauugggacuacguugugaccaccgacaucucggagaugggggcgaacuuucgggccgauagggucaucgacccucgccguugccuuaaacccgugauucuaaaggauggaccagaaagaguaauccuggcagguccgaugccugugacuguugcuucugccgcacagcggaggggccgcauugggcgaaaucauaacaaggagggagaccaguacauauauaugggccagcccuugaauaacgaugaggaccacgcccacuggacagaagcuaaaauguuacuggauaauaucaacaccccagaggguauuauccccgcccucuucgaaccugagagagaaaaguccgcggcaaucgacggggaguaccggcugaggggcgaggcccgcaaaacauucgucgaacuuaugagaaggggagaucugccaguguggcucagcuauaagguggcuucagagggcuuucaauacagugaccggcguuggugcuucgauggggaacgcaauaaccaggucuuggaggaaaauauggacguugagauuuggacuaaagagggagaacgaaagaaacugagacccagguggcuagaugcccggacguauucugacccucuggcucuccgcgaguuuaaggaguucgcagccgguagaagguccgugagcggcgaccuuauacuggagaucgggaaguuaccgcagcauuugacccagcgggcucaaaacgcccuggauaaucucguaaugcugcacaacucagaacagggaggccgagcauacagacaugcgauggaggagcuuccagacacaauugaaacucugaugcucuuggcccugaucgcuguguuaaccgguggggucacacuauuuuuccugaguggccgcggacucggcaaaaccagcauugggcuucugugugugauggccuccucuguuuugcuguggauggcaagcguggagccccacuggaucgcugccuccauaauccucgaauuuuuccugaugguccuucucauuccugagcccgauaggcagcggacuccacaggacaaucaacuggcauauguagugaucggauugcuguuuaugauuuuaacgguugccgcuaacgagaugggucuacuggaaaccacaaagaaagaucucggcaucgggcacguggcggucgagaaccaucaccaugccacuaugcuugacguggaucugcacccugcaucagcuuggaccuuguacgccgucgccacaaccauaauuacucccaugaugcgucauacaaucgaaaauacgaccgcaaacauuucucugacugcuaucgccaaucaggcggcuauacucaugggacuggacaagggcuggccaaucaguaaaauggauauuggugugccucuuuuagcccuggggugcuacucgcagguuaacccgcucacauugaccgcagccgugcugaugcuaguagcucacuaugcaaucauuggccccggacugcaagccaaggcgaccagagaggcucagaagaggacagccgcaggcaucaugaaaaauccaacuguggacgggauagucgccauugaucucgacccuguuguguacgaugcuaaguucgaaaaacagcuuggacagaucaugcuguugauccuguguacgagccaaauucuccugaugcgcaccacaugggccuuaugcgaguccaucacucuugcaaccggcccccugacaacccucugggaggguucuccagggaaguuuuggaacacuacgauagcugucucaauggccaauauuuuccggggaagcuaucuagcgggcgccggucuggcauuuuccuugaugaaaagucugggcgggggacgaagaggcacaggggcucagggagaaacccucggcgagaaguggaagaggcagcuuaaccagcugucuaaaagcgaguucaauaucuacaagcgcucagguauuauggagguggaccgguccgaagccaaagagggguugaagagaggagagacuacccgucacgcaguaaguaggggcacagcuaaacugcggugguucguggaacgcaaccucguuaagccugaggguaaggugaucgacuuaggcugugggcgaggaggcuggagcuauuacugcgccgggcugaaaaaggucacugaagugaaaggauauaccaagggcggucccgggcaugaggaaccgauaccaauggccacauacggauggaaucuugucaaacugcacucuggcaaggauguguuuuucacgccucccgagaaaugugacacccuacucugcgauaucggcgaguccucaccaaaccccacuauugaagaggggagaacacugaggguuuugaagaugguagaaccuuggcugcggggaaaucaauuuuguaucaagauucucaacccguacaugcccagcguggucgagacccuugagcagaugcagcgcaaacaugguggcaugcuggugagaaauccauuaucgaggaacucuacucacgaaauguauuggguuaguugcgggacaggaaauaucguguccgcggucaacaugaccagccgaaugcuguugaaccgguucacgauggcucaccguaagccuaccuacgagagagacguggaucucggcgcagguacacgccauguagccguggaacccgagguugcuaaucuggacauuaucgggcagaggauagaaaacauuaaacacgagcauaagucaacuuggcacuaugaugaggacaauccuuacaaaaccugggccuaucauggauccuacgaagucaagccaucuggcagcgcaaguuccauggugaacggcguggucaagcuacuuacaaaacccugggauguuaucccuauggugacucaaaucgccaugaccgacacaaccccauuugggcagcagcggguauucaaggagaaaguggauacuagaacgcccaaggcuaaacgcggaacagcgcaaauuauggaagucaccgccagguggcugugggguuuucucagccgaaauaagaagccgcggauauguacuagagaggaguucaccaggaaagugcgcucuaacgcagcuaucggcgccguuuuuguggacgagaaucaguggaacucagcaaaggaggccgucgaagacgagcguuucugggaucuggugcagaaagaacgggaguugcacaagcaggggaaaugcgcuacaugcguauauaauaugaugggaaagagagaaaagaaacugggcgaguuugguaaggccaaagggaguagggcgauuugguacauguggcucggagcacgcuuccuugaguuugaagcccugggcuucaugaacgaggaccacugguucucccgagaaaauagcuuaucuggcguugagggggagggacugcauaaguuggguuacauccuccgggauauuucgaaaaucccuggcgggaacauguaugcugacgauacggccggaugggacaccagaauaacugaagaugaccugcaaaaugaggcaaagaucacagauauuauggaaccagagcacgcucuacuugccaccucaaucuuuaaacugacuuaccagaacaagguggucagggugcagcgccccgcuaagaauggcacagugauggacgucauuagcagacgggaucagagggguuccgggcaaguuggaaccuauggccucaacacauucacuaacauggaagcccagcugauccgucagauggagagugagggcauauuuuugccuucugaauuagagaccccaaaucuggcagaacgagugcucgacuggcuugagaaacaugggguagaacgccugaagagaauggcgauuagcggagaugacuguguggucaaacccaucgacgaucgguucgccacggcucuaaccgcccugaacgacauggguaaggugaggaaagauaucccgcagugggagccuuccaagggcuggaaugacuggcaacagguucccuuuugcucacaccacuuccaucagcucauuaugaaggaugggcgcgagauaguggucccauguagaaaccaggacgaauuggugggacgggcaaggguaagucaaggcgcugguuggucucugcgagagacagccugccuugggaaaagcuacgcacagauguggcagcugauguauuuucaccguagagaucuccgcuuagccgcgaaugcuaucuguuccgccguuccuguggacuggguccccacuucacggaccacauggagcauucaugcacaccaucaauggaugacuaccgaagauaugcugucuguguggaacaggguuuggaucgaggaaaauccauggauggaggacaagacgcacguguccaguuggggagauguccccuacuugggcaaaagagaggaccaguggugcggcagccugauugggcucacagcccgcgcuaccugggccucgaacauccagguggcaauaaaucagguacggaggcuuaucggaaacgaaaauuaucuggacuacaugacuuccaugaagcgauucaaaaacgagggugauccugaaggcgcucuaugguga

SEQ ID NO: 14062 - RNA, 9879 nt, Artificial Sequence
  derived and/or modified CDS sequence (opt3) from DENV-1__EU482532__SS-prME
agcgugaccaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuugggugacauaugggaccuguagucagacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucuacgacacgguuggaaaacaucauguggaagcagauuucgaacgagcugaaucauauccuccuggaaaacgacaugaaauuuaccguagucgugggcgauguugcagggauuuuagcucagggaaagaaaaugauccgcccucagcccauggaguacaaguauagcuggaaguccuggggcaaagccaagauaaucggggcggacgugcaaaauacuaccuucauuaucgauggaccaaacacaccugaaugucccgacgaucagagagccuggaauauuugggaggucgaggacuacggcuuugguaucuucacuaccaacauauggcugaaacuuagggauucacacacacaggugugcgaccaccguuugaugagugcugcaauuaaggauucuaaagccguucaugcugacaugggguauuggaucgaaagcgagaagaaugaaacguggaagcucgcccgggcauccuucauugaggugaaaaccuguaucuggccaaagucacacacucuguggagcaacggaguacuagaaucugagaugauaauccccaaaauuuacggcgguccuaucucccagcauaauuaucgaaguggcuacuuuacacaaaccgcggggccauggcaccugggaaagcucgagcuggauuucgaccuuugcgaaggcacuacagucgugguggaugagcacugcgggaacagaggaccgagcuugaggaccacgacugucaccggcaaaauuauccaugaaugguguugccgcucuuguacacugcccccuuuacgguuuaagggugaggacgggugcugguacggaauggagauaagaccaguuaaggaaaaagaggaaaaucucgugaaguccaugguaucagccggcaguggugagguggacagcuucucgcugggccuucuguguauuuccaucaugaucgaagaggucaugaggucucgcuggagccgaaaaauguugaugaccgggacucucgcuguguuuuuccugcuaauuaugggacagcugacauggaacgaucucauccggcugugcauuaugguuggcgccaaugcaucagaccguauggggaugggaaccacauaucuugcuuugauggccacuuuuaagaugagacccauguucgcagugggccuguuauuuaggcgccucaccagucgggagguccugcuucugacgauaggucuaucccucguggccucuguugaacugccuaacagcuuggaggaacugggggauggauuagcuaugggcaucaugauucucaaacugcuuacagacuuccagucccaccaacugugggcgaccuugcucucacugacuuuuaucaagaccacauucagccuacauuacgccuggaagacuauggcaauggugcugaguauugucucucuuuuuccacucugucuguccaccacgagccagaaaacaaccugguugcccguacuguuaggcucgcucgggugcaagccgcugacuauguuccuuaucgcugagaauaaaauauggggaagaaagucauggccucugaacgaagguaucauggccgugggcauuguuucuaucuugcucaguucccugcucaagaacgaugugccacuggccgggccccuuauugcuggaggcaugcucaucgcauguuaugucauaagcgguucuagcgccgaccuguccuuggagaaggcggcugaggugucaugggaagaggaagccgagcacaguggggcaagccauaauauuuuaguagaagugcaggaugacggaacaaugaaaaucaaggaugaggagagggacgauacccugacuauccuccugaaggccacacuucuggcugucucuggcguuuacccuuuguccauucccgcaacccuauucgugugguauuuuuggcagaaaaagaaacaacgaucaggcgugcugugggacacgccaaguccucccgaagucgagcgcgccgugcucgaugacgggauauaccggaucaugcagagaggacugcuugguaggagccagguuggcguagggguguuccaggaaaacgucuuucacacuauguggcacgugacccguggagcgguuuuaauguaucaaggcaagcgccuggagccauccugggcuucugugaaaaaggaccucauuucguacggugggggauggcgguugcagggcagcuggaauacaggcgaggaaguccaggugaucgccguagagccggggaagaacccuaaaaauguccagaccgcacccggaacauucaagacuucagaaggugaggugggcgccauugcucuggauuuuaaaccagggaccuccggaagucccaucguuaacagagaaggcaagauagugggucucuacgggaauggagucgugacgacaucuggcacuuauguuagcgccaucgcacaagcuaaagccucccaggagggcccucugccagagauugaagacgagguguucaggaagcgaaaccuuaccaucauggaucugcaucccgggucaggaaagacacggcgcuacuugccugcgauugucagagaagccaucaaaaggaagcuacggacccugauacucgcaccgacucgagugguagcuucugagauggccgaggcuuuaaaagguaugccaauuagauaucagaccacagcaguaaagagcgagcacacgggcaaagagaucguugaccugaugugccaugccacuuuuaccaugcgccuucugagucccgucagggugccuaauuacaacaugaucauuauggaugaagcccacuucacagacccauccagcaucgcugcgcguggguauauaucuacccgggugggaaugggcgaggcagccgcuauuuuuaugacugccacacccccugguucagucgaagcauucccgcaauccaaugccguaauccaggaugaggaaagagacauucccgagaggaguuggaacagcggguacgaguggaucaccgauuuuccaggaaagacggugugguucguuccuucgauaaagucuggcaaugacauugcuaacugucuccgcaaaaauggcaagcgagugauccaguuguccagaaaaacuuucgauacagaauaucagaagaccaaaaacaacgacugggacuacgucgugaccacugauaucagcgagaugggggcgaauuuucgggccgacaggguuauugauccccgccguugccugaagccagugauccucaaggacggaccugaaagagucauucuggcaggucccaugccagugacaguagcuucagccgcacaacggaggggccgcauagggcgaaaccauaauaaagagggagaucaguacaucuauaugggccagccgcuuaacaaugacgaggaucacgcccacuggaccgaagcuaagaugcuacuggacaacauuaauacaccugaggguaucauccccgccuuguucgaaccagagagagagaaaagugcggcaauugauggggaguaccgguuaaggggcgaggcccgcaagacuuuuguggaacugaugagaaggggagaccuccccguuuggcugucuuauaaagucgcuuccgagggcuuccaguacagcgaucggcguuggugcuuugacggggaacgcaacaaucaagugcuugaggaaaacauggauguggagauauggacgaaggagggagaaaggaaaaagcugagaccuagauggcucgacgcccggaccuauucagacccauuggcucugcgcgaguucaaggaauuugcagccgguagaaggagugucagcggcgaucuaauccuggagauugggaaacucccccagcaucuuacacagcgggcucagaaugcccuggacaacuuaguuauguugcacaauuccgaacaaggaggccgagcauacagacaugcgauggaggagcugccugauacuaucgaaacccucaugcugcuugcccugauugcugugcucacaggugggguaaccuuguucuuucugucuggccgcggauuaggcaagacuagcaucgggcuacugugugugauggccuccucaguccuccuuuggauggcaucuguggagccgcacuggauagcugccaguaucauucuggaguucuuuuugaugguucugcucaucccagagcccgacaggcagcggacgccucaggauaaccagcuggcauauguggucauuggacuucucuucaugauccugaccguagccgcuaaugagauggguuugcuggaaacaacuaaaaaggacuuaggcauagggcacguggcggccgagaaccaucaccaugcagcuaugcuagauguugaccugcaccccgccucggccuggacccucuacgcaguggcuacaaccauuaucacuccaaugaugcgucauacaauugaaaacacgaccgccaauaucagccuuacugcgauagcuaaccaagccgcaauccugaugggauuggauaaaggcuggccuauuuccaagauggacaucggugucccccugcucgcccuggggugcuacucucaggugaauccacuuacauuaaccgcugcaguccugaugcucguggcccacuaugcgauuaucggcccuggauugcaggcuaaggccaccagagaggcacagaaaaggacagccgcuggcauaaugaagaacccgacuguugaugggauuguggccaucgaccuggaucccguaguguacgacgcaaaauuugaaaagcagcuaggacagaucaugcugcucauucuuuguacgucacagauccuguugaugcgcaccacaugggcucugugcgagagcauaacucucgccaccggcccacugacaaccuuaugggaggguuccccugggaaauucuggaauacuacgauugcggucaguauggccaacaucuuccggggaucuuaucuugcaggcgcuggucuggccuuuagccucaugaagucacuaggcgggggacgaagaggcacaggggcacaaggagaaacccugggcgagaaguggaaaaggcaguugaaucagcuguccaagagugaguucaacacuuacaaacgcagcgguauuauggagguugaccggucugaagcuaaggaggggcucaaaagaggagagaccacaaagcacgccgugucccguggcacugccaaacuuaggugguuugucgaacggaaucuggugaaacccgaggguaagguaaucgauuugggcugugggcgcggaggcuggucauauuacugcgcggggcugaaaaaggugaccgaaguuaaaggauauacaaagggcgguccagggcaugaggaaccuauacccauggcuacguacggauggaaccucgugaaauuacacagcggcaaggacgucuucuuuaucccgccagagaagugugauacccugcuuugcgacauuggcgagucgucuccuaaucccacuaucgaagaggggcgaacacugagagugcuaaaaauggucgaaccauggcucaggggaaaccaguucuguauuaagauccugaaucccuacaugccuagugugguugagaccuuggagcaaaugcagcggaaacaugguggcaugcugguacgcaacccgcucuccagaaauagcacucacgaaauguauugggugucaugcgggacaggaaacauugucuccgcagugaauaugaccucuaggaugcuucugaaccgauuuacgauggcccaccggaagcccaccuacgagcgugauguugacuuaggcgcugguacaagacauguggccgucgaaccagagguggcaaaccuggauaucauagggcagcgcauugaaaauaucaaacacgagcauaagagcacuuggcacuaugacgaggauaacccuuacaagaccugggccuaucauggaaguuacgaaguaaaacccuccggcagcgcuucuucaauggugaauggcguugucaaguugcucacaaaaccuugggacgugaucccaauggugacucagauugcgaugaccgauacaacccccuucgggcaacagagggucuuuaaggagaaaguugacacucggacgccuaaggccaagagaggaacagcacagauaauggaagugaccgcuaaauggcugugggguuuccuaagucgcaacaagaaaccaaggaucuguacucgagaggaauuuacccggaagguaagauccaaugccgcaauuggcgccguguucgucgacgagaaccaauggaauagcgcuaaagaggccguggaagaugagagguuuugggaccuuguucaccgcgaacgugagcugcacaagcaggggaagugcgcgacaugcguguauaacaugaugggaaaacgggaaaagaaacucggcgaguucgguaaggcaaaagggucuagagccaucugguacauguggcugggagcuagguucuuggaguuugaagcccugggcuucaugaaugaggaucauugguuuucgcgcgaaaacucacucagcggcgucgagggggagggacuucacaagcuggguuacauuuuacgagacaucuccaaaauacccggcgggaauauguaugcagaugacacggcuggaugggauacccggaucacugaagacgaucugcagaacgaggccaagauuacagacaucauggaaccggagcaugcuuugcucgccaagaguauuuucaaacugaccuaccagaauaaggugguaagaguucaaaggccugccaaaaacggcacugugauggaugucaucucucgcagagaccagcgggguagcggacaggugggaacauauggccuaaauaccuuuacaaacauggaagcgcagcuuauaaggcaaauggaguccgagggcauuuucucaccaagugaacuggagacucccaaccucgccgggcgugugcuggauugguuggaaaagcacggagucgagcgauuaaaacgcauggcuaucucuggugacgacuguguugugaagccuaucgaugacagauuugccaccgcacugacggcucucaaugauaugggcaagguacggaaagacauuccacagugggaacccagcaagggguggaacgauuggcaacaggugccguucugcucccaccauuuucaccaacuuauaaugaaagacggaagggagaucgucgugccuugucgcaaucaggaugagcugguuggcagagcccgggugucacagggugcaggguggagccuaagggaaaccgccugccugggaaagucuuacgcgcagauguggcaacucauguauuuccaucgacgugacuugagacuggcugccaacgcaauuuguuccgccguccccguggauuggguaccaacaagucgcacuaccuggagcauccacgcucaucaccaguggaugacaacugaggacaugcuuucgguuuggaaucggguguggauugaagagaacccuuggauggaagauaaaacccacaucuccucuuggggcgacguccccuaccugggcaagagggaggaccaguggugcgggucacucauaggauuaacggccagagcaacaugggcuaccaauauccaaguggccauuaaccagguucgccggcugaucgguaaugagaacuauuuggauuacaugacuagcaugaagagguuuaaaaaugaaagugacccagagggcgcgcugugguga

SEQ ID NO: 14063 - RNA, 9879 nt, Artificial Sequence
  derived and/or modified CDS sequence (opt3) from DENV-1__EU482533__SS-prME
agcgugacaaugcugcuaaugcuuaugcccacagcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuaucguguuggguucucaggagggggcuaugcacacugcccucaccggcgcaacggaaauccaaaccuccggaacaacuaccauuuucgccggccaucugaagugccguuuaaaaauggauaagcugacacuaaaagggaugagcuaugucauguguacuggaucguucaagcucgagaaggaaguggcugagacccagcacgguacgguccuggugcagauaaaauacgagggcacagacgcgccuugcaagaucccauuuucuacccaggaugaaaaagggguuacucaaaacggacgccuuauuacagcaaaucccaucgugaccgacaaggagaaaccuguaaacauagaagccgagccacccuucggcgaguccuauauugucaucggugcuggggaaaaggccuugaagcugucaugguuuaaaaagggcaguagcaucggaaaaauguucgaggcaacugccagaggcgcuaggcggauggccauucucggggauaccgcaugggacuuuggauccaucgguggcguguucacaucuguugggaagcuggugcaucagauuuuuggaacggcguacggcguccuuuucagcggugugucauggaccaugaaaauagggaucggcguacuguugacuuggcucggacugaauagucgauccacuagcuuaucuaugaccuguauugcugugggccugguuacacuauaccucggggucauggugcaggccgauucaggaugcgugaucaacuggaagggccgcgaacugaagugugguagugggaucuuugucacuaaugagguucacaccuggacggaacaguauaaauuccaagcagacagcccgaagagacuuuccgccgcuauuggaaaagccugggaggagggcgugugcgguauaaggucugcaacacgguuggaaaacaucauguggaagcagauuucgaacgagcugaaucauauccuccuggaaaacgacaugaaauuuaccgugguagucggcgauguggcugggauuuuagcccagggaaagaaaaugauccgcccucagcccauggaguacaaguauagcuggaaguccuggggcaaagcgaagauaaucggggccgacguucaaaaugcuacuuucauuaucgauggaccaaacaccccugaaugucccgacgaucagagagcauggaauauuugggagguggaggacuacggcuuugguaucuucacaacuaacauauggcugaaacuuagggauucauauacccaggucugcgaccaccguuugaugagugccgcuauuaaggauucuaaagccgugcacgcagacaugggguacuggaucgaaagcgagaagaaugaaacauggaagcucgcgcgggccuccuucauugagguuaaaacguguaucuggccaaagucacauacccuguggagcaacggagugcuagaaucugagaugauaauccccaaaauuuauggcgguccuaucucccagcacaauuaccgaccaggcuacuuuacucaaacagcugggccguggcaucugggaaagcucgagcuggauuucgaccuuugcgaaggcaccacuguagucguggaugagcacugcgggaacagaggacccaguuugaggacaaccacggugacuggcaaaauuauccacgaaugguguugccgcagcuguacccugccuccauuacgguuuaagggugaggacgggugcugguauggaauggagauaagacccgucaaggaaaaagaggaaaaucucguuaagucuaugguguccgccggcucaggugagguagacaguuucagccugggccuucuguguauuucgaucaugaucgaagaggugaugaggucccgcuggucucgaaaaauguugaugacagggacccucgcagucuuuuuccugcuaauuaugggacagcugacuuggaacgaucucauccggcugugcauuauggugggcgcuaaugccagcgaccguauggggaugggaacaaccuaccuugcauugauggccacauuuaagaugagaccuauguucgcuguuggccuguuauuuaggcgccucacuucacgggaggugcugcuucugaccauaggucuaagucucgucgcguccguggaacugccaaacucuuuggaggaacugggggauggauuagccaugggcaucaugauucucaaacugcuuacggacuuccagagccaucaacugugggcaacauugcucucccugaccuuuaucaagacuaccuucucacuacacuaugcuuggaagacaauggccaugguucugagcauugugagucuuuuuccccucugucugucuacuaccucccagaaaacgacaugguugccgguccuguuaggcagccucgggugcaagccucugaccauguuccuuaucgccgagaauaaaauauggggaagaaagucguggccacugaacgaagguaucauggcuguaggcauugugucaaucuugcucucuagucugcucaagaaugauguuccccuggcagggccucuuauugccggaggcaugcucaucgcguguuacgugauauccgguagcucugcugaccugagcuuggagaaggccgcagaggucuccugggaagaggaagccgagcauucaggggcuagucacaauauuuuaguggaaguacaggaugacggaacuaugaaaaucaaggaugaggagagggacgauacacugaccauccuccugaaggcaacucuucuggccgugagcggcgucuaucccuugucuauuccagcgacacuauucguuugguacuuuuggcagaaaaagaaacaacgauccggcgugcugugggacaccccuucacccccagaaguggagcgcgcuguccucgaugacgggauauaucggaucaugcagagaggacugcuugguaggagucaggugggcguugggguauuccaggaaaacguguuucauacgauguggcacgucacucguggagccguguuaauguaccaaggcaagcgccuggagccgagcugggcauccguuaaaaaggaccucauuucuuacggugggggauggcgguugcagggcucguggaauaccggcgaggaagugcaggucaucgccguggagccugggaagaaccccaaaaauguacagacagcuccaggaaccuucaagacaagcgaaggugaggucggcgccauugcacuggauuuuaaacccgggacuucaggauccccuaucgugaacagagaaggcaagauaguuggucucuaugggaauggaguggucaccacgaguggcacauacgugucugcuaucgcccaagcgaaagccagccaggagggcccacugcccgagauugaagacgagguuuucaggaagcgaaaccuuacuaucauggaucugcacccuggguccggaaagacccggcgcuauuugccggcaauugugagagaagcuaucaaaaggaagcuacggacacugauacucgccccaacccgagucguggcuucagagauggcagaagccuuaaaagguaugcccauuagauaccagacuaccgccguaaagucugagcauacaggcaaagagaucguggaccugaugugccacgcuacguuuacuaugcgccuucugagcccuguuagggucccaaauuauaacaugaucauuauggaugaagcgcauuucaccgaccccaguuccaucgcagcccguggguacauaagcacacgggugggaaugggcgaggcugccgcaauuuuuaugaccgccacuccuccggguucuguggaggcuuucccccaaucaaaugcggucauccaggaugaggaaagagacauuccagagagguccuggaacaguggguaugaguggaucacagauuuuccuggaaagaccguaugguucgugcccagcauaaagucgggcaaugacauugccaacugucuccgcaaaaauggcaagcgaguuauccaguugucuagaaaaacguucgauacugaauaccagaagaccaagaacaacgacugggacuacguggucaccaccgauaucuccgagaugggggcaaauuuucgggcugacagggugauugauccacgccguugccugaagccuguuauccucaaggacggacccgaaagagugauucuggccgguccaaugccggucacuguggcaagcgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagaaaaaucagccgcuauugauggggaguaucgguuaaggggcgaggcccgcaagacauuuguagaacugaugagaaggggagaccucccuguguggcugaguuacaaaguugcuucugagggcuuccaguauuccgaucggcguuggugcuuugacggggaacgcaacaaucaaguccuugaggaaaacauggauguggagauauggacuaaggagggagaacgaaagaaacugagaccaagguggcucgacgcacggacguacagcgaccccuuggcccugcgcgaguucaaagaauuugcugccgguagaaggucagugaguggcgaucuaauccuggagauugggaaacucccucagcaccuuacccagcgggcacagaaugcgcuggacaacuuagucauguugcauaauagcgaacaaggaggccgagccuauagacacgcuauggaggagcugccggauacaaucgaaacucucaugcugcuugcccugauugcaguucucaccgguggggugacauuguucuuucuguccggccgcggauuaggcaagaccucuaucgggcuacuguguguaauggcuagcuccgugcuccuuuggauggccucagucgagccacauuggauagcagccucuaucauucuggaguucuuuuugauggugcugcucauccccgagccugacaggcagcggacuccccaggauaaccagcuggcuuacguugugauuggacuucucuucaugauccugacggucgcggccaaugagauggguuugcuggaaaccaccaagaaggacuuaggcauagggcacguagcaguggagaaccaccaucacgcugccaugcuagauguugaccugcauccagccagugcauggacucucuacgcuguggccaccacaauuaucaccccuaugaugcgucacacuauugaaaacacaacggcgaauaucucgcuuaccgcuauagccaaccaagcagccauccugaugggauuggauaaaggcuggcccauuagcaagauggacaucggugucccacugcucgcucuggggugcuauucccaggugaauccucuuacuuuaacagcagccguccugaugcucguggcgcauuacgcuauuaucggcccgggauugcaggccaaggcaaccagagaggcccagaaaaggaccgcugccggcauaaugaagaaccccacaguugaugggauuguggcaaucgaccuggauccaguaguguaugacgcuaaauuugaaaagcagcuaggacagaucaugcugcucauucuuuguacuucucagauccuguugaugcgcacgaccugggcccugugcgagucaauaacacucgcgacuggcccucugaccacauuaugggaggguagccccgggaaauucuggaauaccacuauugccgucuccauggcaaacaucuuccggggaaguuaccuugcuggcgccggucuggcauuuucucucaugaaaagccuaggcgggggacgaagaggcacgggggcucaaggagaaacacugggcgagaaguggaaaaggcaguugaaucagcugucaaaguccgaguucaacaccuauaaacgcagugguauuauggagguugaccggagcgaagccaaggaggggcucaaaagaggagagacuaccaagcacgccgugucucguggcacagcgaaacuuaggugguuugucgaacggaaucuggugaaaccagaggguaagguaaucgauuugggcugugggcgcggaggcugguccuacuauugcgcugggcugaaaaaggugacugaaguuaaaggauacaccaagggcgguccugggcacgaggaacccauaccgauggcaacauacggauggaaccucgugaaauuacauucaggcaaggacgucuucuuuaucccaccugagaagugugauacgcugcuuugcgacauuggcgagagcucgcccaauccaaccaucgaagaggggcgaacucugagagugcuaaaaauggucgaacccuggcucaggggaaaccaguucuguauuaagauccugaauccuuauaugccgucugugguugagacauuggagcaaaugcagcggaaacacgguggcaugcugguacgcaacccccucaguagaaauuccacccaugaaauguacugggugagcugcgggacuggaaacauugucucagccgugaauaugacauccaggaugcuucugaaccgauuuaccauggcucaccggaagccaacguaugagcgugauguugacuuaggcgccgguaccagacacguggcagucgaaccugagguggccaaccuggauaucauagggcagcgcauugaaaauaucaaacaugagcacaagucuacauggcauuacgacgaggauaaccccuauaagacuugggcuuaccacggaagcuaugaaguaaaaccuaguggcuccgcgagcucuauggugaauggcguugucaaguugcucaccaaaccaugggacgugauccccauggugacacagauugccaugacugauaccacaccuuucgggcaacagagggucuuuaaggagaaaguugacacccggacuccaaaggcaaagagaggaacggcucagauaauggaagugacagccaaauggcugugggguuuccuaucacgcaacaagaaacccaggaucuguacccgagaggaauuuacucggaagguaagaaguaaugcagccauuggcgcuguguucgucgacgagaaccaauggaacuccgccaaagaggcgguggaagaugagagguuuugggaccuuguucaucgcgaacgugagcugcacaagcaggggaagugcgcaaccugcguguacaacaugaugggaaaacgggaaaagaaacucggcgaguucgguaaggccaaagggagcagagcuaucugguacauguggcugggagccagguucuuggaguuugaagcacugggcuucaugaaugaggaucacugguuuucucgcgaaaacucgcucucaggcgucgagggggagggacuucauaagcuggguuauauuuuacgagacaucagcaaaauaccgggcgggaauauguacgcugaugacacagccggaugggauacgcggaucaccgaagacgaucugcagaacgaggcuaagauuacugacaucauggaaccugagcacgccuugcucgcaaaguccauuuucaaacugacauaucagaauaaggugguaagaguucaaaggccagcgaaaaacggcaccgugauggaugucaucagucgcagagaccagcgggguucuggacaggugggaacuuacggccuaaauacauuuaccaacauggaagcccagcuuauaaggcaaauggagagcgagggcauuuucucccccucagaacuggagacaccuaaccucgcugggcgugugcuggauugguuggaaaagcauggagucgagcgauuaaaacgcauggccaucaguggugacgacuguguugugaagccaaucgaugacagauuugcaacugcucugaccgcccucaaugauaugggcaagguacggaaagacauuccccagugggaaccgucuaagggguggaacgauuggcaacaggugccuuucugcagccaccacuuucaucaacuuauaaugaaagacggaagggagaucgucgugcccugucgcaaucaggaugagcugguuggcagagcacgggugucccagggugccggguggucacuaagggaaacggcgugccugggaaagagcuaugcucagauguggcaacucauguacuuccaccgacgugacuugagacuggccgcaaacgccauuuguucugcugucccaguggauuggguaccuaccucccgcacaacuuggaguauccaugcccaccaucaguggaugaccacagaggacaugcuuagcguuuggaaucggguguggauugaagagaaccccuggauggaagauaaaacucacaucucguccuggggcgacgucccauaucugggcaagagggaggaccaguggugcgggucucucauaggauuaaccgcaagagcuacgugggccacaaauauccaaguggcgauuaaccagguucgccggcugaucgguaaugagaacuacuuggauuacaugaccucaaugaagagguuuaaaaaugaaagcgaccccgagggcgcucugugguga

SEQ ID NO: 14064 - RNA, 9879 nt, Artificial Sequence
  derived and/or modified CDS sequence (opt3) from DENV-1__EU482534__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaagccaucaguugugggccacacuccugucccuaaccuucgugagaacuaccuuuucacugcacuaugcauggaaaacaauggcuaugguccuuagcaucguaagucucuucccccuguguuugucuacuaccucccagaagacgacauggcugccgguguuacucggcagccuggggugcaagccucuuaccauguuucugauugccgagaauaaaaucuggggaaggaagucguggccauugaacgaagguauaauggccguuggcaucgugucaauucuccugucuagucuacugaaaaacgaugucccccuugcugggccucucaucgcaggaggcaugcugauugccuguuacgugaucuccgguagcucugcggacuugagcuuagagaaggcugccguaguguccugggaggaagaggcagaacauucaggggccagucacaauauacuggucgagguucaggaugacggaacuaugaaaauuaaggaugaagagcgagacgauacacucaccauccugcuuaaagcuacucuguuggcagugagcggcguguauccccuaucuaucccagccacacuguucgucugguacuucuggcaaaagaagaaacagcgcuccggcgugcucugggacaccccuucacccccagagguugaacgggcgguacuggaugacgggauuuauagaauaaugcagaggggacuuuuaggucguagucaggugggcgucgggguguuucaagagaacguuuuccauacgauguggcacgugacucgcggagcuguccugauguaccagggcaagcggcucgaaccgagcugggccuccgugaaaaaggacuugaucucuuacggugggggauggagacugcagggcucguggaauaccggcgaggagguacaggucauugcaguggaaccugggaaaaaccccaagaauguucaaacagccccaggaaccuuuaagacaagcgagggugaagugggcgcuaucgcccucgauuucaaacccgggacuucaggauccccuauugucaacagggagggcaagaucgugggucuguaugggaauggaguugugaccacgaguggcacauacgucucugcaauagcucaggccaaagcgagccaggaaggcccacuucccgagaucgaggacgaaguguuucgaaagcggaaccugacuauuauggauuugcacccuggguccggaaaaacccgcagauaucuaccggccaucguaagggaggcaauuaagcggaagcugcgaacacucaucuuagcuccaaccagagugguugccucagaaauggcugaggcacugaaagguaugcccauacgcuaccaaacuaccgccgucaagucugaacauacaggcaaagagauuguggaccuuaugugccacgccacguucacuaugaggcugcucagcccugugcgugucccaaauuauaacaugaucaucauggaugaggcucauuuuaccgaccccaguuccauugcggcacggggguacaucagcacaagaguaggaaugggcgaagccgcugccauauucaugaccgcaacuccuccggguucuguggaggccuuuccccagucaaaugcuguuauucaggaugaagagagggacaucccagaacgcuccuggaacaguggguaugaguggauuacagauuucccuggaaagaccgugugguuuguccccagcaucaaaucgggcaaugacauagcgaacuguuugcgaaagaauggcaagagagugauucagcugucucggaaaacguucgauacugaguaccaaaagacaaaaaacaacgacugggacuacguugugaccaccgauaucuccgaaaugggggccaauuucagggcagaccgcgucaucgauccacguagaugccucaagccugugauucugaaagacggacccgagcggguaauccuugcugguccaaugccggugacuguugccagcgcagcccagaggcgcggccgaauugggagaaaccacaauaaggaaggagaucaguauauauacaugggccagccucuaaacaaugacgaggaucaugcucacuggacagaggccaagaugcuguuggacaacaucaauacccccgaagguauuaucccagcguuauuugagcccgaacgggagaaaucagcagccaucgauggggaauauaggcugcgcggcgaggcuagaaagacauucgucgagcucaugaggcggggagaccugccuguguggcuuaguuacaaaguggccucugaaggcuuucaauauuccgaucgucgcuggugcuucgacggggagcgaaacaaucagguccuggaagagaacauggauguugaaauuuggacuaaggagggagagagaaaaaagcucaggccacggugguuggacgcucgcacguacagcgacccccuggcacuaagagaauuuaaagaguucgccgcugguaggcggucagugaguggcgaucugauacucgaaaucgggaagcuuccucagcaccugacccagcgagcccaaaaugcauuagacaacuugguaaugcugcauaauagcgagcagggaggcagagcguaucgccacgccauggaagagcucccggauacaauugagacucugaugcuucuggcucucaucgccguguugaccgguggggucacacuguuuuucuuauccggcaggggacuaggcaagaccucuauugggcugcucugugugauggcaagcuccguucuucuguggauggcuucaguggaaccacauuggaucgccgcaucuauaaucuuggaguuuuuccugaugguccuccugauucccgaaccugaccggcagcguacuccccaggauaaccaacuugccuacguagugaucggacuccuguuuaugauuuugacgguugcugcgaaugagaugggucuguuagagaccacaaaaaaggaccuaggcaucgggcacguggccgucgaaaaccaccaucacgcagcuaugcuggauguggaccuccauccagccagugccuggacucuuuacgcagucgcuaccacaauaauuaccccuaugaugagacacacuaucgagaacacaacggccaauauuucgcugaccgcgaucgcuaaccaggccgcaauauugaugggacuggauaaaggcuggcccaucagcaagauggacauuggugugccacuccuggcccuugggugcuauucccagguuaauccuuuaacucugacagcugcagugcucauguugguagcccauuacgcgaucauuggcccgggacugcaagcuaaagccaccagggaagcacagaagcgcaccgccgcuggcaucaugaagaaccccacaguggaugggauagucgccauugaccuagauccaguuguguaugacgcaaaauucgagaagcagcugggacagaucaugcuccuuauccuguguacuucucaaauuuugcugaugcggacgaccugggcucucugcgaaucaaucacacuggccacuggcccuuuaaccacacuuugggaggguagccccgggaaauuuuggaauaccacuauagcggucuccauggccaacauuuuccgaggaaguuaccuggcaggcgcuggucucgccuucucucuaaugaagagccugggcgggggaagaaggggcacgggggcacagggagagacauugggcgaaaaauggaagcgccagcugaaucagcucucaaaguccgaguuuaacaccuauaaacggagugguaucauggaaguggacagaagcgaggcuaaggaagggcuuaaacguggagagacuaccaagcacgccguaucuaggggcacagccaaacugcggugguucguggagcgcaauuugguuaagccagaagguaaggugauugaucugggcugugggcgaggaggcugguccuacuauugcgcggggcucaaaaaggucacugaggugaaaggauacaccaagggcgguccugggcacgaagagcccaucccgauggcuacauacggauggaacuuagucaaacugcauucaggcaaggacguguuuuucauaccaccugaaaaaugugauacgcuucugugcgacaucggcgagagcucgcccaauccaaccauugaggaagggagaacucuaaggguucucaagaugguagagcccuggcugcggggaaaccaauuuuguaucaagauuuugaauccuuauaugccgucuguggucgaaacacuggagcagaugcagcgcaaacacgguggcaugcucgugagaaacccccuuaguaggaauuccacccaugagauguacuggguuagcugcgggacuggaaacaucgugucagcagucaauaugacaucccgaaugcuguuaaaccgguucaccauggcccaccguaagccaacguaugaaagagauguggaccugggcgcugguacccgccacguagccguggagccugaaguugcaaacuuggauauuaucgggcagaggauagagaauauuaaacaugaacacaagucuacauggcauuacgacgaggauaaccccuauaaaacuugggccuaccacggaagcuaugaggucaagccuaguggcuccgcuagcucuauggugaauggcguggucaagcuccugaccaaaccaugggacguuauccccauggugacacaaaucgcgaugacugauaccacaccuuuugggcagcagcggguauucaaggaaaaaguggacaccagaacuccaaaggccaaacgcggaacggcacaaauuauggaggucacagcuaaguggcuaugggguuuucuuucaaggaacaagaaaccccgaauauguacccgggaagaguucacuagaaaggugaggaguaaugccgcaaucggcgccguuuuuguggacgaaaaccaguggaauuccgcuaaagaggccgucgaggaugaacgcuucugggaccuggugcaucgugagcgggaacuccacaagcaggggaaaugcgcgaccugcguauacaacaugaugggaaagagagagaagaaacugggcgaauuugguaaggcaaaagggagcagggccauuugguacaugugguugggagcucgcuuccuggaguucgaggcccucggcuuuaugaaugaagaucacugguucucucgagagaacucgcuuucaggcguugaaggggagggacugcauaaguuagguuauauccugcgggacauuagcaaaaucccgggcgggaauauguacgcagaugacacagcuggaugggauacgagaauaaccgaggacgauuugcagaacgaagccaagaucacugacauuauggagccugaacacgcucuccuggccaaauccaucuuuaagcuaacauaucaaaauaagguggucagggugcagcgcccagcaaaaaacggcaccgugauggaugucauuaguagacgggaccagagggguucugggcagguuggaacuuacggccuuaauacauucaccaacauggaggcgcaacugauccgucagauggaaagcgagggcauauuuucccccucagagcucgaaacaccuaaccuggccgggcgaguguuggauugguuagagaagcauggaguagaacgccugaaaagaauggcuauuaguggugacgacuguguggucaagccaaucgaugaccgguucgccacugcacucaccgcucuuaaugauaugggcaaagugaggaaggacaucccccagugggagccgucuaagggguggaacgauuggcagcaaguuccuuuuugcagccaccacuuccaucagcugauuaugaaagacggacgcgaaauagugguccccuguagaaaucaggaugagcuagugggccgggccaggguaucccagggugcaggguggucacugcgagagacggccugccucggaaagagcuaugcgcaaauguggcaguugauguacuuucaccguagagaccugcgccuugcugccaacgcaaucuguucugccguuccaguggauugggucccuaccucccggacaacuuggaguauucaugcucaccaucaguggaugaccacagaagacaugcugagcguguggaauaggguuuggaucgaggaaaaccccuggauggaggauaaaacucacauuucguccuggggcgacgugccauaucucggcaagagagaagaccaauggugcgggucuuuaaucggacugaccgcccgcgcaacgugggcuacaaauauacaggucgccaucaaccaggugcggagguugcuggguaaugagaacuaccucgauuacaugaccucaaugaaacgauucaagaaugagagcgaccccgaaggcgcgcuuugguga

SEQ ID NO: 14065 - RNA, 9879 nt, Artificial Sequence
  derived and/or modified CDS sequence (opt3) from DENV-1__EU482535__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacuuuaauugccauggaccucggagagcugugugaagauaccaugacauacaaaugcccacggauaaccgaggcggaaccggacgauguggacuguuggugcaaugcuacugauacauggguaaccuaugggacguguucacagacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaaaaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaagaugagggauuccuacacacaggucugcgaccaccguuugaugucagcugcaaucaaagauaguaaggccgugcaugcugacaugggguauuggauugaaucugagaaaaaugaaacguggaagcucgcccgggcauccuucaucgagguuaagaccuguauauggccaaaaucccacacucuguggucaaacggagugcuagaaagcgagaugaucauucccaagaucuacggcgguccuauuucucaacauaauuaucgaccaggcuacuucacacagaccgcggggccguggcaccugggaaaacucgagcuggauuuugaccuuugcgaaggcacuacaguagucguggaugagcacugcgggaacagaggacccuccuugaggaccacgacugugaccggcaagaucauacaugaaugguguugccgcaguuguacacugccuccauuacgguucaaaggugaggacgggugcugguacggaauggagauuagacccgucaaggaaaaggaggaaaaucucguuaaaagcauggugucugccggcuccggugagguagacucauuuagucugggccuucuguguaucagcaucaugauugaagaggugaugaggucgcgcuggucccgaaagauguugaugaccgggacucucgcugucuuccugcuacugaucaugggacagcucacauggaacgaucugauucggcuuugcauaauggugggcgccaaugcaucugaccguauggggaugggaaccacauauuuggcucugauggccacuuuuaaaaugagaccuauguucgcaguuggcuuacucuuuaggcgccugaccagccgggaggugcuucugcuaacgaucggucucucacuggucgccaguguggaauugccaaacucccuggaggaauuaggggauggacucgcuaugggcauuaugauccugaaacuucugacagacuuccaaucucaccaguugugggcgacccuccugagccuaacuuuuauuaaaaccacacugucccuucauuacgccuggaagacuauggcaaugguucucucaaucgugagccugauacccuugugucugaguaccacgucucagaagacaaccugguuaccgguccuccugggcucccuugggugcaaaccucugacuauguucuugaucgcugagaauaagauuuggggaagaaaaagcuggccacucaacgaagguaucauggccguaggcgugguuucgauucugcuaucaucucugcuuaagaacgaugugccccucgccgggccucugaucgcuggaggcauguugauagcauguuaugucauuagugguuccagcgccgacuuaucucuggagaaagcggcugaggugagcugggaagaggaagccgagcacuccggggcaucacauaauauccucguagaagugcaggaugacggaacaaugaagaucaaagaugaggagagggacgauacccugacuauucuucugaaggccacauugcuagcugucaguggcguuuacccccugagcauaccagcaacccucuuugugugguauuucuggcaaaagaaaaagcagcgaucuggcgugcugugggacacgccuucacccccagaagucgagcgcgccgugcuugaugacgggaucuaccggauuaugcagagaggauuacuggguaggagccagguuggcguagggguguuucaagaaaacgucuuccacacuauguggcacgugacccguggagcgguucucauguaucagggcaaacgcuuggagccgaguugggcuagcgugaagaaagaccugaucuccuacggugggggauggcggcuccagggcucuuggaauacaggcgaggaaguccaggugauugccguagagccuagaaagaaccccaagaauguccaaaccgcaccagggacauucaaaacucccgaaggagaggugggugccaucgcucuggauuuuaagccuggcaccucggggagcccaauaguuaacagggaaggaaaaaucgugggccuuuacgguaauggggucgugacgacaucaggaacuuauguuuccgccauugcacaggcuaaggccagucaggagggcccccugccugagaucgaagacgagguguuccgaaaacggaacuugaccauuauggaucuacauccgggcucugggaagacacgcagauaccugccagcgaucgucagggaagccauaaagcggaaacuccgaaccuuaauucuggcacccacuagagugguagcuagcgagauggccgaagcucuuaagggaaugccuauccgcuaucaaaccacagcagugaaauccgagcacacggguaaggagaucguugaccugaugugccaugccacuuuuaccaugaggcucuugucaccaguccgugugcccaauuacaacaugauuaucauggaugaagcccacuucacagacccuucuagcauagcugcgcggggcuauauuaguaccagaguggggaugggagaggcagccgcuaucuuuaugacugccacaccgcccggcuccgucgaagcauucccacagagcaaugccguaauucaggaugaggaaagggacaucccugagcgcucuuggaacucagguuacgaguggauaaccgauuuucccgggaaaacggugugguucguuccauccauuaagaguggaaaugacaucgcuaacugucugcgaaagaauggcaaaagagugauccagcucagccggaagacuuuugauacagaauaucagaagaccaagaacaacgacugggacuacgucgugaccacugauauuucggagaugggcgcgaauuucagggccgaccgcguuaucgauccucguagaugccugaaacccgugauucuuaaggacgggccagaacgggucauacuagcaggaccgaugccugugacaguagcuucugccgcacagaggcgcggucgaaucggcagaaaccauaauaaggagggggaucaguacauuuauaugggacagccccugaacaaugacgaggaucacgcccacuggaccgaagcuaaaauguuguuagacaacaucaauacaccagagggcaucauucccgcccuguuugaaccugagcgggaaaaguccgcggcaauagauggugaguacaggcuccgcggggaggccagaaaaacuuucguggaacugaugaggcggggcgaccuuccaguuuggcugagcuauaaggucgcuucagagggauuccaauacagugaucgucgcuggugcuuugacggcgaacgaaacaaucaggugcucgaggaaaacaucgauguggagauuuggacgaaagagggggaaagaaagaaauugaggccccgguggcuggacgcccgcaccuauucugacccucuagcucugagagaguucaaggaauuugcagccggaaggcgguccgucagcggugaucucauccuugagauuggcaagcugccgcagcauuuaacacagcgagcucaaaaugccuuggacaaccugguuaugcuccacaauucagaacaagggggcagagcauaccgccaugcgauggaggagcugccagauacuaucgaaacccuuaugcugcucgccuugauagcugugcugacaggcgguguaaccuuauucuuucuaagugggaggggccugggaaaaacuagcaucggccuccuuugugugauggccuccucuguccuguuguggauggcaagcguggagccccacuggauugcugccuccaucauucuggaguucuuucucaugguucugcuuaucccugagcccgaccggcagcguacgccacaggauaaccaacucgcauauguggucauagggcuguuguucaugauucugaccguagccgcuaaugagaugggauuacuagaaacaacuaagaaagaccuggguaucggccacgcggccguggagaaccaucaccaugcaaccaugcucgauguugaccuucacccugcuucagccuggacacuguacgccguggcaaccacuauuaucacacccaugaugagacauacgauagaaaacaccacugcuaauaucucuuugacagccauugcgaaccaggcugccauccugauggggcucgauaagggauggccaauuaguaaaauggacaucggcgucccucugcuugcauuagguugcuacagccaggugaauccgcugacccucaccgccgcugucuugaugcugguggcacacuaugccauaauugggcccggccuacaagcgaaggcuacaagggaggcccagaagcgcacugcagccggaaucaugaaaaacccaacgguugauggcaucguggcuauugaccuggauccuguaguguacgacgccaaguuugaaaaacagcucgggcagaucaugcuucugauauuguguaccagccaaauucugcucaugcggacaacuugggcacugugcgaguccaucaccuuagcuacaggaccccuuaccacucugugggagggcucuccagguaaguucuggaauacgacaauugccgucucaauggcgaacaucuuucgagggagcuaucucgccggagcaggccuagcuuucucccugaugaaaaguuuggguggcgggagaaggggaaccggcgcccagggggaaacucugggagagaaguggaagcgccagcucaaucagcuuucuaaaagcgaauuuaacauauacaagcggucaggcaucauggagguugacagauccgaagcaaaagagggucugaagcguggggagaccacaaggcacgcugugagucggggaacugccaaauugcgcugguucgucgaacgaaaucuggugaagccugagggcaagguaauugaucucgguuguggcagagggggauggagcuauuacugcgccggccuaaagaaggugaccgaaguuaaaggguauacaaagggaggccccggucaugaggaaccgaucccaauggcgacguacggguggaaccuggugaaacuucacucuggaaaggacgucuucuuuaccccucccgagaaaugugauacucugcuaugcgacauuggcgaguccucaccaaaucccacaaucgaagagggcaggacccuccgggugcugaagauggucgaaccuugguugcgcgggaaccaauucuguauuaagauccugaauccguacaugcccagcgugguugagacucucgagcagaugcagagaaaacauggagguaugcuuguaaggaacccacugucgcgaaauucuacacacgaaauguauugggugaguugcggcaccgggaacauagucuccgcugugaauaugacgagccggauguuacugaaccguuuuaccauggcacacagaaagccuacauacgagaaagauguugacuugggagccggcacucgccauguggcugucgaacccgagguggccaaccucgauauuaucggucagaggaucgaaaauauuaagcacgagcauaaaucaaccuggcacuaugacgaggauaacccuuacaagacaugggcauaucauggguccuacgaaguaaagccaucuggaagcgccaguuccauggugaauggcguugucaaacugcuaacuaagcccugggacgugauaccuauggugacccaaaucgcuaugacagauaccacuccauucggccagcagcgggucuuuaaagagaagguugacacgagaacacccaaagcgaagcgcgggaccgugcaaauuauggaaguaacugccagguggcuuuggggauuccugagccgaaacaagaaaccgcggaucuguaccagagaggaauuuacaaggaaggugcgcucuaaugcagcuauuggugccgucuucguggacgagaaccaguggaacucagcaaaagaggccguugaagaugagcguuuuugggaccucgugaagaaagaacgggagcugcacaagcagggcaagugcgcuacgugcgucuauaacaugauggggaaaagagaaaagaaauugggagaguucggcaaggccaaagguaguagggcgaucugguacauguggcugggggcacgcuuucucgaguucgaagcccuuggauuuaugaaugaggaucacugguucucccgagaaaacagccugucuggcguggagggcgagggguuacauaagcugggauacauauugcgggacaucucgaaaauuccugguggcaauauguaugcugaugacaccgccgggugggauacuagaaucacagaagacgaucuccagaacgaggcaaagauuaccgacaucauggaaccagagcacgcucugcuagccacuucaauauucaaacuuacauaccaaaauaaaguaguuagggugcagcgccccgcuaagaacggaaccgucauggaugugauuagcagacgggaccagaggggcuccggucagguggggacauauggacugaauacuuuuaccaacauggaagcccaacucauccgucagauggagagugagggcaucuuccugccuucugaauuggagacgccaaacuuagcagaacgaguccuggauuggcucgagaaauacggcguugaacgccuuaagagaauggcgauuagcggggacgacugugugguaaaacccauagaugaccgguuugccaccgcucugacagcccuaaaugauaugggaaaggugaggaaggacaucccgcagugggagccuuccaaagguuggaacgauuggcagcaaguccccuucugcucacaucacuuucaccagcugauuaugaaggacggccgcgagaucgugguuccauguagaaaucaggaugaacucguggggcgggcaagggucagucagggagcuggcuggucuuugcgagagacugccugccuggguaaaagcuaugcacaaauguggcagcuuauguacuuccaucguagagaccugcgccucgccgcgaacgcuauuuguuccgccgugccuguaaauuggguucccaccucacggacaacuuggagcauccacgcacaucaccaguggaugaccacggaagauauguuaucuguguggaacagggucuggauagaggaaaauccauggauggaggacaagacacauguguccaguuggggagauguucccuaucugggaaaaagagaggaccaauggugcggcagcuugaucggccugaccgcccgcgcuacuugggccucgaacauucagguggcaaucaaucagguccggaggcucauugggaacgaaaauuaccuugacuacaugacauccaugaagcgauuuaagaacgagggagauccugaaggugcucugugguga

SEQ ID NO: 14066 - RNA, 9879 nt, Artificial Sequence
  derived and/or modified CDS sequence (opt3) from DENV-1__EU482536__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaagccaucaguugugggccacacuccugucccuaaccuucaucagaacuaccuuuucacugcacuaugcauggaaaacaauggcuauggugcuuagcauugucagucucuucccccuguguuugucuacuaccucccagaagacgacauggcugccgguauuacucggcagccuggggugcaagccucuuaccauguuucugaucgccgagaauaaaauauggggaaggaagucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgagguguccugggaagaggaagcagagcauucaggggccagucacaauauucugguagaagugcaggaugacggaacuaugaaaaucaaggaugaggagcgagacgauaugcucacaauccugcuuaaagcuacccuguuggcagucagcggcguuuauccccuaucuauuccagccacucuguucgugugguacuucuggcaaaagaagaaacagcgcuccggcgugcucugggacacaccuucacccccagaagucgagcgggcggugcuggaugacgggauauauagaaucaugcagaggggacuuuuaggucguagucagguuggcguagggguguuucaagaaaacgucuuccauaccauguggcacgugacgcgcggagcuguucugauguaccagggcaagcggcucgagccgagcugggccuccgugaaaaaggacuugauuucuuacggugggggauggagacugcagggcucguggaauacuggcgaggaaguccaggugaucgcaguagagccugggaaaaaccccaagaauguccaaaccgccccaggaacauuuaagaccagcgaaggugaggugggcgcuauugcccucgauuucaaacccgggacaucaggauccccuaucguuaacagggaaggcaagauagugggucuguaugggaauggagucgugacuaccaguggcacguacguuucugcaaucgcucaggccaaagcgagccaggagggcccacuucccgagauugaagacgagguguuucgaaagcggaaccugacaaucauggauuugcacccuggguccggaaaaacucgcagauaucuaccggccauugucagggaagcaaucaagcggcgacugagaacccucauauuagcuccaacacgcgugguagccucagagauggcugaagcacugaaggguaugcccauuagguaccaaaccacugccgugaaaucugagcauaccggcaaggagaucguugaccuuaugugccacgccacauucacgaugcgucugcucagcccuguccgggugccaaauuauaacaugaucauuauggaugaagcucauuuuacugaccccaguuccaucgcggcaagaggguacauaagcaccagggugggaaugggcgaggccgcugccauuuucaugacagcaaccccuccggguucugucgaagccuuuccccagucaaaugcuguaauccaggaugaggaacgcgacauuccagagcgauccuggaacaguggguaugaguggaucacugauuucccuggaaaaacagugugguuuguucccagcauaaagucgggcaaugacauugcgaacuguuugagaaaaaauggcaagcgggugauccagcugucuaggaagaccuucgauacggaauaccaaaaaacuaagaacaacgacugggacuacgucgugacaaccgauaucuccgagaugggggccaauuuccgcgcagaccguguuauugauccaagacggugccucaaaccugugauccugaaggacggacccgaaagggucauucuugcugguccaaugccggugaccguagccagcgcagcccagcgccgaggcagaauagggcggaaccacaauaaagagggagaucaguauaucuacaugggccagccucuaaacaaugacgaggaucaugcucacuggacugaagccaagaugcuguuggacaacauuaauacacccgaggguaucaucccagcguuauuugaacccgagagggaaaagucagcagccauugauggggaguaucgccugagaggcgaggcuaggaaaaccuucguggaacucaugcggcguggagaccugccuguuuggcuuaguuacaaggucgccucugagggcuuucaauauuccgaucgccgauggugcuucgacggggaaagaaacaaucaggugcuggaggaaaacauggauguggagauauggacaaaagagggagaaaggaagaaacuccggccacgcugguuggacgcuagaacuuacagcgacccccuggcacuaagggaguuuaaggaauucgccgcuggucggcgaucagucaguggcgaucugauccucgagauugggaaacuuccucagcaccugacgcagagagcccaaaaugcauuagacaacuugguuaugcugcauaauagcgaacagggaggccgcgcguauaggcacgccauggaggagcucccggauaccaucgaaacacugaugcuucuggcucucauugccguguugacuggugggguaacccuguuuuucuuauccggccggggacuaggcaagacaucuaucgggcugcucugugugauggcaagcuccguccuucuguggauggcuucaguggagccacauuggauagccgcaucuaucauuuuggaauuuuuccugaugguucuccugauccccgagccugaccgucagagaaccccccaggauaaccaacuugccuacguggucauuggacuccuguuuaugaucuugacuguagcugcgaaugagaugggucuguuagaaacgaccaagaaagaccuaggcauagggcacguggccguugagaaccaccaucacgcagcuaugcuggauguggaccuccauccagccagugccuggacacuuuacgcagucgcuacuaccauuaucacaccuaugaugaggcacaccauugaaaacacuacagccaauaucucgcugacggcgauagcuaaccaggccgcaaucuugaugggacuggauaagggcuggcccauuagcaaaauggacaucggugugccacuccuggcccuugggugcuauucccaggucaauccuuuaacccugacugcugcagugcucauguugguugcccauuacgcgauuaucggcccgggacugcaagcuaaggccacacgcgaggcacagaaacggaccgccgcuggcauaaugaagaaccccaccguggaugggauuguagccaucgaccuagauccaguggucuaugacgcaaaguucgaaaaacagcugggacagaucaugcuccuuauucuguguacaucucaaaucuugcugaugcgaacuacgugggcucucugcgagucaauaacccuggccacaggcccuuuaacuacccuuugggaggguagccccgggaaguuuuggaauacaaccauugcgguuuccauggccaacaucuucagaggaaguuaccuggcaggcgcuggucucgccuucucucuaaugaaaagccugggcgggggaaggcgcggcacuggggcacagggagaaacguugggcgagaaguggaaacggcagcugaaucagcucucaaaguccgaauuuaacacauauaagagaagugguauuauggagguggaccguagcgaagcuaaagaggggcuuaagaggggagagaccacuaaacacgccgucucucggggcaccgccaagcugcgcugguucguggaacgaaauuugguaaaaccagaggguaaggugaucgaucugggcugugggagaggaggcugguccuacuauugcgcggggcucaagaaaguuacagaagugaagggauacacuaaaggcgguccugggcacgaggaacccauaccgauggcuaccuacggauggaacuuagucaagcugcauucaggcaaagacguguuuuucaucccaccugagaagugugauacacuucugugcgacauuggcgagagcucgcccaauccaacgaucgaagaggggaggacccuacggguccucaaaaugguggaacccuggcugcgcggaaaccaauuuuguauuaagaucuugaauccuuauaugccgucuguuguagagacucuggagcagaugcagagaaagcacgguggcaugcucgugaggaacccccuuagucgaaauuccacacaugaaauguacugggucagcugcgggaccggaaacauugugucagcaguuaauaugacuucccggaugcuguuaaaccguuucacaauggcccacagaaaaccaaccuaugagcgcgauguggaccugggcgcugguacgaggcacgucgccguggaaccugagguagcaaacuuggauaucauagggcagcggauugaaaauaucaagcaugagcacaaaucuaccuggcauuacgacgaggauaaccccuauaagacaugggccuaccacggaagcuaugaagugaaaccuaguggcuccgcuagcucuaugguuaauggcgucgugaagcuccugacuaagccaugggacgugauccccauggucacccaaauugcgaugacagauacuaccccuuuugggcagcagagaguuuucaaagagaagguggacacacgcaccccaaaagccaagaggggaacugcacaaauaauggaaguaacggcuaaauggcuaugggguuuucuuucacgaaacaagaagccccggaucuguacaagagaggaauucaccaggaaagugcgcaguaaugccgcaauuggcgccgucuuuguggacgagaaccaguggaauuccgcuaaggaggccguugaagaugagcguuucugggaccuggugcaucgggaaagagagcuccacaaacaggggaagugcgcgacuugcgucuacaacaugaugggaaaaagggaaaagaagcugggcgaguuugguaaagcaaaggggagccgcgccaucugguacaugugguugggagcucgauuccuggaguucgaagcccucggcuuuaugaaugaggaucacugguucucucgggaaaacucgcuuucaggcguggagggggagggacugcauaaauuagguuauauucugagagacaucagcaagauaccgggcgggaauauguacgcagaugacaccgcuggaugggauacaaggaucacggaagacgauuugcagaacgaggccaaaauuaccgacaucauggaaccugagcacgcucuccuggccaaguccauuuuuaaacuaacuuaucaaaauaagguaguucgcgugcagagaccagcaaagaacggcacagucauggaugugaucagucggagggaccagcgugguucugggcaggugggaaccuacggccuuaauacuuucacaaacauggaagcgcaacugauacgacagauggagagcgagggcauuuuuucccccucagaacucgagaccccuaaccuggccgggcgcgucuuggauugguuagaaaaacauggaguugagagacugaagcggauggcuaucaguggugacgacugugugguaaaaccaaucgaugacagguucgccacagcacucacugcucuuaaugauaugggcaaggugcgcaaagacauuccccagugggaaccgucuaagggguggaacgauuggcagcaagucccuuuuugcagccaccacuuccaucagcugauaaugaaggacggaagagagaucgugguucccugucggaaucaggaugagcuagugggcagggcccgagucucccagggugcaggguggucacugcgugaaaccgccugccucggaaaaagcuaugcgcaaauguggcaguugauguacuuucacagacgcgaccugcggcuugcugccaacgcaauuuguucugccgugccaguagauuggguuccuacguccaggaccacauggaguauccaugcucaccaucaguggaugacuaccgaggacaugcugagcguguggaauagagucuggauugaagagaaccccuggauggaagauaagacacacgugucguccuggggcgacguuccauaucucggcaaacgcgaggaccaauggugcgggucuuuaaucggacugacugcccgggcaaccugggcuacgaauauacagguggccaucaaccaggucaggcgauugcuggguaaugagaacuaccucgauuacaugacaucaaugaagagauucaaaaaugaaagcgaccccgagggcgcgcuuugguga

SEQ ID NO: 14067 - RNA, 9879 nt, Artificial Sequence
  derived and/or modified CDS sequence (opt3) from DENV-1__EU482537__SS-prME
agcgugaccaugcugcucaugcuuaugcccacagcacuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaaaaagaugauacgcccucaacccauggagcacaaauacucguggaaaagcuggggcaaggcuaagaucauuggggccgacguccagaauaccacuuuuaucauugauggaccaaacaccccugaaugucccgacgaucagagagcguggaauaucugggagguggaggacuauggcuucgguauauuuacaacuaacauuuggcuuaaguugagggauuccuacacccaggccugcgaccaccgucucaugucagcugcaaucaaagauaguaaggccguucaugcugacaugggguauuggauugaaucugagaaaaaugaaacauggaagcuggcccgggcauccuucaucgaggugaagacguguauauggccaaaaucccacacccuauggucaaacggaguacuggaaagcgagauggucauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuauguaaucagugguuccagcgccgaccugucucucgagaaagcggcugaggugagcugggaagaggaagccgagcacuccggggcaucacauaauauacuggucgaaguucaggaugacggaacuaugaagauuaaagaugaggagagggacgauacacuuaccauccuguugaaggccacucuacuggcugugaguggcguguacccccucagcaucccagcaacacuguucgucugguauuuuuggcaaaagaaaaagcagcgaucuggcgugcuuugggacaccccuucacccccagaaguugagcgcgccguauuagaugacgggauuuaccggauaaugcagagaggacugcucgguaggagccaggugggcgucgggguguuccaagaaaacguuuuccacacgauguggcacgugacucguggagcggucuugauguaucagggcaaacgccuggagccgaguugggcuagcgugaagaaagaccucaucuccuacggugggggauggcggcugcagggcucuuggaauaccggcgaggaaguacaggucauugccguggagccugggaagaaccccaagaauguucaaacagcaccaggaaccuuuaaaacacccgaaggugaggugggcgccaucgcucuugauuucaagccugggacuucgggaagcccaauugucaacagagaaggcaaaaucgugggucuguacgggaauggaguugugaccacgucaggcacauaugucuccgccauagcacaggcuaaggccagucaggagggccccuugccugagaucgaagacgagguguuuaggaaacgaaaccuaacuauuauggaucugcauccggggucuggaaagacccggcgcuaccucccagcgaucguaagagaagccauuaagaggaaauuacggacacugauccuugcacccacccgagugguugcuagcgagauggccgaagcucugaaggguaugccuauaagauaucaaacuaccgcagucaaauccgagcacacaggcaaggagauuguggaccucaugugccaugccacguucacuaugcgcuugcugucaccagugaggguccccaauuacaacaugaucaucauggaugaagcccacuuuaccgacccuucuagcauugcugcgcguggguauaucaguacacggguaggaaugggcgaggcagccgcuauauucaugaccgccacuccgcccgguuccguggaagcauuuccacagagcaaugccguuauucaggaugaggaaagagacaucccugagaggucuuggaacucaggguacgaguggauuacagauuuccccggaaaaaccgugugguuugucccauccaucaagaguggcaaugacauagcuaacugucuccgcaagaauggcaaacgagugauucagcugagcagaaagacguucgauacugaauaucagaaaaccaagaacaacgacugggacuacguugugaccaccgauaucucggagaugggggcgaauuuucgggccgacagggucaucgauccucgccguugccuuaaacccgugauucuaaaggacggaccagaaagaguaauccuggcagguccgaugccugugacuguugcuucugccgcacagcggaggggccgcauugggcgaaaccauaauaaggagggagaucaguacauauauaugggccagcccuugaacaaugacgaggaucacgcccacuggacagaagcuaaaauguuacuggacaacaucaauaccccagaggguauuauccccgcccucuucgaaccugagagagaaaaguccgcggcaaucgauggggaguaccggcugaggggcgaggcccgcaaaacauucgucgaacuuaugagaaggggagaccugccaguguggcucagcuauaagguggcuucagagggcuuucaauacagugaucggcguuggugcuucgacggggaacgcaacaaucaggucuuggaggaaaacauggauguugagauuuggacuaaagagggagaacgaaagaaacugagacccagguggcuagacgcccggacguauucugacccucuggcucuccgcgaguuuaaggaguucgcagccgguagaagguccgugagcggcgaucuuauacuggagaucgggaaguuaccgcagcauuugacccagcgggcucaaaaugcccuggacaaccucguaaugcugcacaauucagaacagggaggccgagcauacagacaugcgauggaggagcuuccagauacaauugaaacucugaugcucuuggcccugaucgcuguguuaaccgguggggucacacuauuuuuccugaguggccgcggacucggcaaaaccagcauugggcuucugugugugauggccuccucuguuuugcuguggauggcaagcguggagccccacuggaucgcugccuccauaauccucgaauuuuuccugaugguccuucucauuccugagcccgacaggcagcggacuccacaggauaaccaacuggcauauguagugaucggauugcuguuuaugauuuuaacgguugccgcuaaugagaugggucuacuggaaaccacaaagaaagaccucggcaucgggcacguggcggucgagaaccaucaccaugccacuaugcuugauguggaccugcacccugcaucagcuuggaccuuguacgccgucgccacaaccauaauuacucccaugaugcgucauacaaucgaaaacacgaccgcaaauauuucucugacugcuaucgccaaccaggcggcuauacucaugggacuggauaagggcuggccaaucaguaaaauggacauuggugugccucuuuuagcccuggggugcuacucgcagguuaauccgcucacauugaccgcagccgugcugaugcuaguagcucacuaugcaaucauuggccccggacugcaagccaaggcgaccagagaggcucagaagaggacagccgcaggcaucaugaaaaacccaacuguggaugggauagucgccauugaccucgauccuguuguguacgacgcuaaguucgaaaaacagcuuggacagaucaugcuguugauccuguguacgagccaaauucuccugaugcgcaccacaugggccuuaugcgaguccaucacucuugcaaccggcccccugacaacccucugggaggguucuccagggaaguuuuggaauacuacgauagcugucucaauggccaacauuuuccggggaagcuaucuagcgggcgccggucuggcauuuuccuugaugaaaagucugggcgggggacgaagaggcacaggggcucagggagaaacccucggcgagaaguggaagaggcagcuuaaucagcugucuaaaagcgaguucaacaucuacaagcgcucagguauuauggagguggaccgguccgaagccaaagagggguugaagagaggagagacuacccgucacgcaguaaguaggggcacagcuaaacugcggugguucguggaacgcaaucucguuaagccugaggguaaggugaucgauuuaggcugugggcgaggaggcuggagcuauuacugcgccgggcugaaaaaggucacugaagugaaaggauauaccaagggcggucccgggcaugaggaaccgauaccaauggccacauacggauggaaccuugucaaacugcacucuggcaaggacguguuuuucacgccucccgagaaaugugauacccuacucugcgacaucggcgaguccucaccaaaucccacuauugaagaggggagaacacugaggguuuugaagaugguagaaccuuggcugcggggaaaccaauuuuguaucaagauucucaauccguacaugcccagcguggucgagacccuugagcagaugcagcgcaaacaugguggcaugcuggugagaaacccauuaucgagaaauucuacucacgaaauguauuggguuaguugcgggacaggaaacaucguguccgcggucaauaugaccagccgaaugcuguugaaccgguucacgauggcucaccguaagccuaccuacgagagagauguggaccucggcgcagguacacgccauguagccguggaacccgagguugcuaaccuggauauuaucgggcagaggauagaaaauauuaaacacgagcauaagucaacuuggcacuaugacgaggauaacccuuacaaaaccugggccuaucauggauccuacgaagucaagccaucuggcagcgcaaguuccauggugaauggcguggucaagcuacuuacaaaacccugggacguuaucccuauggugacucaaaucgccaugaccgauacaaccccauuugggcagcagcggguauucaaggagaaaguggacacuagaacgcccaaggcuaaacgcggaacagcgcaaauuauggaagucaccgccagguggcugugggguuuucucagccgaaacaagaagccgcggauauguacuagagaggaguucaccaggaaagugcgcucuaaugcagcuaucggcgccguuuuuguggacgagaaccaguggaacucagcaaaggaggccgucgaagaugagcguuucugggaccuggugcagaaagaacgggaguugcacaagcaggggaaaugcgcuacaugcguauauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguugagggggagggacugcauaaguuggguuacauccuccgggacauuucgaaaaucccuggcgggaauauguaugcugaugacacggccggaugggauaccagaauaacugaagacgaucugcaaaacgaggcaaagaucacagacauuauggaaccagagcacgcucuacuugccaccucaaucuuuaaacugacuuaccagaauaagguggucagggugcagcgccccgcuaagaacggcacagugauggaugucauuagcagacgggaccagagggguuccgggcaaguuggaaccuauggccucaauacauucacuaacauggaagcccagcugauccgucagauggagagugagggcauauuuuugccuucugaauuagagaccccaaaccuggcagaacgagugcucgauuggcuugagaaacaugggguagaacgccugaagagaauggcgauuagcggagacgacuguguggucaaacccaucgaugaccgguucgccacggcucuaaccgcccugaaugauauggguaaggugaggaaagacaucccgcagugggagccuuccaagggcuggaacgauuggcaacagguucccuuuugcucacaccacuuccaucagcucauuaugaaggacgggcgcgagauaguggucccauguagaaaucaggaugaauuggugggacgggcaaggguaagucaaggcgcugguuggucucugcgagagacagccugccuugggaaaagcuacgcacagauguggcagcugauguauuuucaccguagagaccuccgcuuagccgcgaacgcuaucuguuccgccguuccuguggauuggguccccacuucacggaccacauggagcauucaugcacaccaucaauggaugacuaccgaagacaugcugucuguguggaauaggguuuggaucgaggaaaacccauggauggaggauaagacgcacguguccaguuggggagacguccccuacuugggcaaaagagaggaccaguggugcggcagccugauugggcucacagcccgcgcuaccugggccucgaauauccagguggcaauaaaccagguacggaggcuuaucggaaaugaaaacuaucuggauuacaugacuuccaugaagcgauucaaaaaugagggugacccugaaggcgcucuaugguga

SEQ ID NO: 14068 - RNA, 9879 nt, Artificial Sequence
  derived and/or modified CDS sequence (opt3) from DENV-1__EU482538__SS-prME
agcgugaccaugcugcucaugcuuaugcccacagcacuggcuuuccacuugacuacgcggggcggggagccucauaugaucgucuccaagcaggaaaggggaaagucuuuacuguuuaagaccucagccgguguuaauaugugcacacucauugccauggaccucggcgaguucugugaagauacuaugaccuacaagugcccacggauuacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacagagagaaaccugucaacauagaagccgagccacccuucggcgaguccuauauugugaucggugcuggggaaaaggccuugaaacugucaugguuuaagaagggcaguagcaucggaaaaauguucgaggcaaccgccaggggcgcucggcgaauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgcuccacuagcuuaucuaugacauguauugcuguuggccuggucacccuauaccucggggugauggugcaggccgauucaggaugcgucaucaacuggaagggcagagaacugaaaugugguagugggaucuuuguuacaaaugaggugcacacuuggaccgaacaauauaaguuccaggcagacagcccgaagaggcuuuccgccgcuauuggaaaagccugggaggagggcgugugcgguauacggucugcaacgcgcuuggaaaacaucauguggaagcagauuucgaacgagcugaaucauauccuccuggaaaacgacaugaaauuaacaguagucgugggcgauguugcugggauucuggcccagggaaagaaaaugaucagaccucaacccauggaguacaaguauagcuggaaauccuggggcaaggcgaagauaaucggggccgacgugcagaauaccacuuuuauuaucgauggaccaaacacccuugaauguccugacgaucagagggcuuggaauauuugggaggucgaggacuacggcuucgguaucuuuacaacuaacauaugguugaaacuccgugauucauauacccaggugugcgaccaccggcugaugagugcagccauuaaggauucuaaagcuguucacgccgacaugggguacuggaucgaaagcgagaagaaugaaacauggaaacuagcacgagcguccuucauugaggugaagacguguaucuggcccaagucacauacccuguggagcaacggaguacucgaaucugagaugauaaucccaaaaauuuauggcggucccaucucccaacacaauuacagaccuggcuacuucacucagacagccgggccauggcaucugggaaaacuugaguuggauuuugaccugugcgaaggcaccacugucgugguggaugagcacugcgggaacaggggaccgaguuuacgcacaaccacggucacuggcaaaauuauccacgaaugguguugccggagcuguacccuacccccucugagauucaagggugaggacgggugcugguauggaauggagauaaggccaguuaaagaaaaggaggaaaaucuugugaagucuaugguauccgcuggcucaggugagguggacaguuuuagccugggcuugcucuguauuucgaucaugaucgaagaggucaugcgcucccgauggucucggaaaaugcugaugacagggacccuagccguguucuuucugcucauuaugggacagcugacuuggaacgaucuuauccguuugugcauuaugguuggcgcaaaugcuagcgacagaauggggaugggaacaaccuaccuggccuuaauggcaacauucaagaugaggcccauguuugccgugggccuccuguuccgccggcuuacuucaagagagguccugcuacucaccauaggucugaguuugguggcuuccguugaacugccuaacucuuuagaggaacucggggauggacuggcgaugggcaucaugauucuuaaacuguugacggacuuucaaagccaucagcucugggccacacugcuaucccugaccuucaucaggacuaccuuuucacuucacuaugcauggaagacaauggcuauggugcucagcauugucagucuguucccauugugucugucuacuaccucccagaaaacgacaugguuacccguacuccugggcagccuugggugcaagccgcugaccauguuuuugaucgccgagaauaagauauggggacgaaaaucguggccucucaacgaagguaucauggccgugggcauuguuucaauccugcuaucuagucugcuuaagaacgaugugccacucgcugggccccugauugcaggaggcauguugaucgccuguuacgucauauccgguagcucugcggacuuaagccuggagaaagcugccgagguguccugggaagaggaagcagagcauucaggggccagucacaauauucucguagaagugcaggaugacggaacuaugaagaucaaagaugaggagcgcgacgauacacugaccauccuucugaaggcuacuuugcuagcagucagcggcguuuauccucugucuauucccgccacacucuucgugugguacuucuggcagaagaagaagcagcgguccggcgugcugugggacaccccaucaccucccgaagucgagagagcggugcuugaugacgggauauauaggaucaugcagcguggauuacugggucgcagucagguuggcguagggguguuucaagaaaacgucuuccauacgauguggcacgugacucggggagcuguucucauguaccagggcaaaagauuggagccaagcugggccuccgugaagaaagaccugauuucuuacggugggggauggaggcuccagggcucguggaauaccggcgaggaaguccaggugaucgcaguagagccggggaagaacccuaaaaauguccaaacagcccccggaaccuuuaagacaagcgaaggugaggugggcgcuauugcccuggauuucaagccagggacuucaggaucccccaucguuaaccgagaaggcaaaauagugggucuuuaugggaauggagucgugaccacgaguggcacauacguuucugcaaucgcucagacuaaggccagccaggagggcccucugccagagauugaagacgagguguuucggaaacgcaacuugaccaucauggaucuacaccccggguccggaaagacaagaagguaucugccugcgauuguccgggaagccaucaaacgaagacuccgcaccuuaauacuggcaccgacuagggugguagcuucagagauggccgaagcucuuaaggguaugccaauucguuaccaaaccacagcagugaagucugagcauacgggcaaagagaucguugaccugaugugccacgccacuuucaccaugcggcucuugagccccgucagagugccuaauuauaacaugaucauuauggaugaagcccauuuuacagacccaaguuccaucgcugcgaggggguacauaagcacccgcgugggaaugggcgaggcagccgcuauuuucaugacugccacacccccugguucugucgaagcauuuccgcagucaaaugccguaauccaggaugaggaacgagacauucccgagagauccuggaacaguggguaugaguggaucaccgauuucccaggaaagacggugugguuuguuccuagcauaaaaucgggcaaugacauugcuaacugucugcggaagaauggcaaaagggugauccagcucucucgcaagacuuucgauacagaauaccaaaagaccaaaaacaacgacugggacuacgucgugaccacugauaucuccgagaugggggcgaauuuccgugccgacagaguuauugauccccggaggugccugaagccagugauccuuaaagacggaccugaacgcgucauucuagcaggucccaugccagugacaguagcuagcgccgcacagcgaagaggccggauagggaggaaccacaauaaggagggagaucaguauaucuacaugggccagccgcugaacaaugacgaggaucaugcccacuggaccgaagcuaaaauguuguuagacaacauuaauacaccugaggguaucauccccgcccuguuugaaccagagcgcgaaaagucagcggcaauugauggggaguauagacucaggggcgaggcccggaagacuuucguggaacugaugcgucgcggagaccuucccguuuggcugaguuacaaagucgcuucugagggcuuucaauauuccgaucgaagauggugcuucgacggggaaaggaacaaucaggugcucgaggaaaacauggauguggagauauggacgaaggagggagaacggaaaaaguugcgcccuagauggcuggacgccaggaccuacagcgacccacuagcucugcgggaguuuaaagaguucgcagccggucgaagaucagucaguggcgaucucauccuugagauugggaagcugccccagcacuuaacacagcgcgcucaaaaugccuuggacaaccugguuaugcuccauaauagcgaacagggaggcagggcauaucggcacgcgauggaggagcugccugauacuaucgaaacccuuaugcugcucgccuugauugcugugcugacaggugggguaaccuuauuuuuccuauccggccguggacugggcaaaacuucuaucgggcuccuuugugugauggccagcuccguccuguuguggauggcaucaguggagccgcauuggauagcugccucuaucauucuggaauuuuuccucaugguucugcuuaucccagagcccgacagacagaggacgccucaggauaaccaacucgcauacguggucauuggacuguuguuuaugauccugaccguagccgcuaaugagauggguuuacuagaaacaacuaagaaggaccugggcauagggcacguggcgguugagaaccaccaucacgccgcaaugcucgauguggaccuucaucccgcuagugccuggacccuguacgccgucgcaacaaccauuaucacuccaaugaugcgccacacaauugaaaacacgaccgcuaauaucucguugacugccauagcgaaccaggcugccauccugaugggacucgauaaaggcuggccuauuagcaagauggacaucggugugccccugcuugcauuagggugcuauucccaggucaauccacugacacucaccgccgcuguguugaugcugguugcacauuacgccauuaucggcccuggacuacaagcgaaagcuacccgggaggcccagaagcgaacagcagccggcauaaugaaaaacccgacuguggaugggauuguagcuaucgaccuggaucccguggucuaugacgccaaguucgaaaagcagcucggacagaucaugcuucugauuuuguguacgucucaaauccugcucaugagaaccacaugggcacugugcgagucaauaacuuuagcuaccggcccacuuacaacccugugggaggguagcccugggaaauuuuggaauacuacgauugccguuuccauggcgaacaucuucaggggaaguuaccucgccggcgcaggucuagcuuucucucugaugaaaucauugggcgggggacgccggggcacaggggcccagggagaaacccugggcgagaaauggaagagacagcucaaucagcuuagcaaauccgaauuuaacacuuauaagcguagugguauuauggagguggacaggagcgaagcaaaggaggggcugaaacggggagagaccacaaagcacgcugucucucgcggcacugccaaauugcgaugguucguggauagaaaucugguaaagcccgaagguaaagugaucgaccucggcugugggaggggaggcugguccuacuauugcgccggguuaaagaagguuaccgaggugaaaggauacacaaagggcgguccagggcacgaggaaccuauacccauggcgacguacggauggaaccuggucaaacuucauucaggcaaggauguguuuuucaucccgccagaaaaaugugacacccugcuaugcgauauuggcgagagcucgccuaaucccacuaucgaggaagggcggacacuccgcguccugaagaugguggagccaugguugagaggaaaccaauuuuguauuaaaauccugaaucccuauaugccuucuguuguagaaacccucgagcagaugcagaggaagcacgguggcaugcuugugcgaaacccgcugaguagaaauuccacucaugagauguacugggucagcugcgggacaggaaacauugugucagcuguuaauaugaccucccguauguuacugaacagauucacgauggcacaccgcaagcccaccuaugaaagggacguggauuugggcgccgguacacggcacgucgcuguggagccagaaguagccaaccucgacaucauagggcagagaauugagaauaucaaacaugaacacaagucuacuuggcauuacgaugaggacaacccuuauaaaaccugggcauaccacggaagcuaugaggugaagcccaguggcuccgccagcucuaugguuaauggcgucgugaaacugcuaacaaagccuugggaugugaucccaauggucacucaaauugcuaugaccgacacaacccccuuugggcagcagcgcguuuucaaggaaaaaguggacacuaggacgccuaaggcgaaacgaggaacagcccaaauaauggagguaaccgcaaaguggcuuugggguuuucugucacggaacaaaaagccaagaaucuguacuagggaagaguucacccgcaaggugcguaguaaugcugccauuggcgcagucuuuguggaugaaaaccaguggaacuccgccaaagaggcuguugaggacgaacgguucugggaucucgugcauagagagagggaacugcacaagcaggggaaaugcgccacaugcgucuacaacaugaugggaaagcgcgagaaaaaguugggcgaauuugguaaggcgaaagggagccgagcaaucugguacauguggcugggagcccgguuccucgaguucgaggcucuuggcuuuaugaaugaagaccacugguucucuagagagaacucgcugucaggcguggaaggggagggauuacauaagcuggguuauauuuugagggauaucagcaaaauacccggcgggaauauguacgccgacgauacggcaggaugggacacccgcaucacugaggaugaccuccagaacgaagcuaagauuacagauaucauggagccggaacacgcccugcuagcuaaauccauuuuuaaacuuaccuaucaaaauaaaguaguuagagugcagcggccugccaagaacggcacugucauggacgugaucaguaggcgugaucagcgagguucugggcaagugggaacauacggccugaauaccuucacaaacauggaggcacaacucauacgccagauggaaagcgagggcauauuuuccccaucagagcuggaaacucccaacuuggcggggagagucuuagacuggcuggagaagcauggaguugaacggcucaaaaggauggccaucaguggugacgauugugugguaaagccuaucgacgaucgcuucgcuaccgcccuuacggcacugaaugacaugggcaaagugagaaaggauauuccacagugggagcccucuaaaggguggaacgacuggcagcaagucccguuuugcagccaccacuuccaucagcuaauaaugaaggauggacgggaaaucgugguuccuuguaggaaucaggacgagcuggugggccgagcucgugucucccagggugccggguggucacucagagagaccgcaugcuugggaaagagcuaugcccaaauguggcagcugauguacuuucaccgccgggaucuuaggcuggcggcuaacgccauuuguucugcagugcccguagacuggguuccaacauccagaacuaccuggaguauccaugcccaccaucaguggaugacaacugaagauaugcucagcguguggaaucgcgucuggauugaggaaaacccuuggauggaggacaaaacccacgugucguccugggaagacguucccuauuuaggcaagcgggaggaucaauggugcggcucucugaucggguugacggcuagggccacaugggcaaccaauauacagguggcuaucaaccagguccgaagacugcucggaaaugagaacuaccuugacuacaugacuucaaugaaacgguucaagaaugaaagcgauccagagggugcccugugguga

SEQ ID NO: 14069 - RNA, 9879 nt, Artificial Sequence
  derived and/or modified CDS sequence (opt3) from DENV-1__EU482539__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccuugcaaauccugcucaugcgaacaacuugggcacugugcgaaagcauaaccuuagcuacagguccccuuaccacucugugggagggguccccaggaaaguuuuggaauacgacaauugccguuucuauggcgaacaucuucagaggcucauaccucgccggugcaggccuagcuuucagccugaugaaaucccuagggggaggcaggcgcgggaccggagcccagggcgagacucugggugaaaaguggaaacggcagcucaaucagcuuaguaagucugaguuuaacaccuauaagagaagcgggauuauggaaguggaccguucagaggcaaaagaaggacugaagaggggcgagacaacuaaacacgcugucucccgggguaccgccaaguugcgcugguucguggagcgaaaucugguaaaaccugaaggcaaggugaucgaucucggguguggaagaggcggguggaguuacuauugcgccggauuaaagaaaguuacagaggugaagggcuacacgaaaggugggcccggacacgaggagccgauaccaauggcgaccuacggcuggaaccuggucaaacuucauagcggcaaagacguguuuuucaucccucccgaaaagugugauacucugcuaugcgacauuggggagucuuccccaaaucccacaaucgaggaaggaaggacccuccggguccugaaaaugguggagccuugguugcgcgguaaccaauuuuguauuaagauccugaauccguauaugcccucaguuguagaaacucucgagcagaugcagagaaagcacggcgggaugcuugugaggaacccacugagccgaaauucgacacaugagauguacugggucucuugcggaaccggcaacauugugagugcuguuaauaugacgucccggauguuacugaaccguuucaccauggcacacagaaaaccuacauaugaacgcgauguggacuugggugccgggacuaggcacgucgcuguggagcccgaaguagccaaccucgauaucauaggacagcggauugagaauaucaagcaugaacacaaaagcaccuggcauuacgacgaggauaacccuuauaagacaugggcauaccacggcucauaugaggugaaaccauccggcucugccagcaguaugguuaauggggucgugaagcugcuaacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuuuggggcuuucugucccgaaacaagaagccgcggaucuguaccagagaagaguucacaaggaaagugcgcagcaaugcugccauuggggcagucuuuguggacgaaaaccaguggaacucugccaaggaggcuguugaggaugaacguuucugggaccucgugcaucgggagagagaacugcacaaacagggaaagugcgccacgugcgucuacaacaugaugggcaaaagggagaagaaguugggugaauuugggaaagcgaagggaucacgcgcaaucugguacauguggcugggcgcccgauuccucgaguucgaggcucuuggcuuuaugaaugaagaucacugguucagucgggagaacucccugagcgggguggaaggagaggguuuacauaaacugggcuauauuuugagagacaucucuaauauaccugggggaaacauguacgccgaugacaccgcaggcugggauacuaggaucacagaggacgaucuccagaaugaagcucgcauuaccgacaucauggagccagaacacgcccugcuagcuaagucgauuuuuaaacuuacuuaucaaaacaagguaguuagagugcagcggcccgccaaaaaugguacagucauggaugugaucucaaggcgugaccagcgagggagcggacaggugggcaccuacggccugaacacauucacuaacauggaggcacaacucauacgccagauggaauccgaggggauuuuuaguccuucugagcuggaaaccccaaauuuggcggagagagucuuagauuggcuggaaaaguauggaguugagcggcucaagaggauggccaucagcggugacgacugugugguaaaacccaucgaugaccgcuucgcuacggcccuuaccgcacugaacgauaugggcaaggugagaaaagacauuccgcagugggaaccuuccaagggguggaaugauuggcagcaaguccccuuuugcucacaucacuuccaccagcuaauaaugaaagacggacgggagaucgugguuccauguaggaaccaggaugagcuggugggccgagcucgugucagucagggugccggguggucucucagagaaacagcaugcuugggaaagagcuacgcccaaauguggcagcugauguauuuucaucgccgggaccuuaggcuggcggcuaaugccauuuguuccgcagugccuguagauuggauccccacuucaagaaccacauggagcauucacgcccaucaccaguggaugacuaccgaggacaugcucucuguuuggaaccgcguguggaucgaagagaauccauggauggaagauaagacgcauauauccaguuggggcgacguccccuacuuaggcaaacgggaggaccaauggugcgggagccugaucggauugacagcuagggccaccugggcaacuaacauucagguggcuaucaaucagguucgaagacugauugguaacgagaauuaccucgauuauaugacaucgaugaagcgguucaaaaacgaauccgacccugagggcgcccuuugguga

SEQ ID NO: 14070 - RNA, 9879 nt, Artificial Sequence
  derived and/or modified CDS sequence (opt3) from DENV-1__KP188539__SS-prME
agcgugaccaugcugcucaugcuucugcccacagccuuggcuuuccacuuaacuacgagaggcggggagccucauaugaucgucuccaagcaggaaagaggcaaaucucugcuguuuaagaccucaguuggugugaacaugugcacacucauugcaauggaccugggcgagcuuugugaagauacuaugaccuacaaaugcccacggauuacagaggccgaaccggacgauguagacuguuggugcaaugcgaccgauacuugggugacauaugggaccuguagucaaacgggggagcaccgccgagacaagcguagcgucgcucuggcaccacaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaggaacaagaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuauuaucacuccccaagccccuaccucagagauccagcuuaccgacuacggggcgcugacauuggacuguaguccaagaaccggacuagauuucaacgaaauggugcugcucacuaugaaagaaaagagcuggcugguacauaaacagugguuucuugaccugccguugcccuggacaucuggcgccuccacgucacaagagaccuggaauaggcaggaucuccugguuacuuucaagacagcacacgcuaagaaacaggaaguggucguguuagguagccaagagggggccaugcacaccgcucugacaggcgccacugaaauucagaccaguggaacgaccacaauauuugcaggccaucuaaagugccggcucaaaauggacaagcugacucuuaaagggaugucuuaugucauguguaccggauccuucaaguuggagaaggaaguggccgagacacagcacgguacuguucuggugcagguaaaauacgagggcaccgaugcuccuugcaagaucccauuccucacgcaagacgaaaaaggggucacacagaacggacgucugauuaccgcgaaucccaucgugacugauaaggagaaaccuguuaacauagaaacagagccacccuuuggcgagagcuauauuguggucggugcaggggaaaaggcccuuaagcugucgugguucaaaaagggaucuuccaucggaaaaauguuugaggcuaccgcccgcggcgcaagaaggauggccaucuugggggacacugcuugggauuucggaucaauugguggccucuuuaccaguguggggaagcugauccaucagguauucggaacagccuacggcguguuauuuagcgguguuuccuggacgaugaaaauugggauaggcauccugcuaaccuggcucggacuaaauucucggagcacuucacuuaguaugacauguauugcagucggcauggugaccuuguaccugggggugaugguccaggcggacuccggaugcguuaucaacuggaagggccgagaacucaagugugguagcgggaucuucgugacaaacgaggugcacacuuggaccgaacaauauaaauuucaggcugauucuccgaagcgccugucagccgcaauuggaaaagccugggaggagggcguaugcgguauaagaagugcuacgagguuagaaaauaucauguggaagcagauuagcaacgagcugaauuacauccuuuuggaaaacgacaugaaauucacagucgugguuggcgacgugaaugggauucucgcccagggaaagaaaaugauccggccucaacccauggagcauaaguauuccuggaagucuuggggcaaagcaaagauaaucggggcugauauucagaacaccacuuuuaucauugacggaccagauaccccugaaugucccgacgaucagcgcgccuggaauaucugggaggucgaggacuacggcuucgguauauuuacaacuaacauuuggcugaaacuaagagauucgcacacccagaugugcgaccacaggcugaugagcgcggccaucaaggauuccaaagcugugcaugcagacaugggguauuggauugaaucagagaagaaugaaacauggaagcucgcccgugcuaguuucaucgagguuaaaacguguauauggccaaagucucacacccuguggagcaacggagugcuugaauccgagaugguaauccccaaaauuuacggcgguccuaucucacaacauaauuaucggccaggcuacuucacucagacagccgggccguggcacuugggaaagcuggaguuagauuuugaccucugcgaaggcaccacugucgugguggaugagcacugcggguaccgaggacccagccugagaacaaccacggucacuggcaaaauuauccaugaaugguguugcaggucuuguacccuuccuccacugcgcuuccggggugaggacgggugcugguauggaauggagauaagacccguuaaggaaaaggaggaaaacuuggugagguccaugguaagugcaggcagcggugagauggacucuuuuucccucggcauucugugugugucaauccuaaucgaagaggucaugcgcagucgauggagccggaaaaugcugaugacagggacccucgcgguguuccugcuuuugauuaugggacagcugacuuggaaugauuuaauccgucucugcauuaugguuggcgccaacgcuucggacagaauggggaugggaacaaccuaccuggcccuuauggcaacauuuaagaugaggccuauguucgcugugggccugcuauuucgccggcucacuuccagagagguccuguugcugaccguggguuuaucucucguugccagcguggaacugccaaauucacuugaggaacugggggauggauuggcaaugggcauaaugaugcucaaacugcuaacggacuuccaaccccaccagcuguggacaacccuucucagucugacuuuuaucaggaccuccuugucucuggauuaugccuggaagacaauggcuauggcguuaagcauugucucccucuucccgcugugucuuucaacuaccagccagaaaacgacauggcugccuguauugcucggcaguuuugggugcaagccacugaccauguuccuaaucacugagaacaagauuuggggacgaaaaucuuggcccaucaacgaagguauaauggccgugggcaucguuuccauucugcuuagcucgcuccugaaggacgaugugccuuuggcagggcccuuaaucgcuggaggcaugcugauugccuguuacgucaucucagguucuagugccgaccucucccuggagaaagcugcagaggugagcugggaagaggaagccgagcauucugggacaagccacaauauacuuguagaagugcaggaugacggaaccaugaagauuaaagaugaggagcgcgacgauacucugacaaucuugcuaaaggcgacccugcucgcugucuccggcguuuauccaaugucaaucccugccacgcuguuugugugguacuucuggcagaaaaagaagcagcggaguggcgugcuuugggacacucccagcccaccggaagucgagagagcaguguuagacgaugggauuuauaggauacugcagcguggacucuugggucgcucucagguuggcguagggguguuccaagacggagucuuucauaccauguggcacgugacacggggcgccguucugauguaccaggguaaaagacucgaaccuuccugggcuucagugaagaaagaucugaucaguuacgggggaggcuggagguuccagggcagcuggaacaccggggaggagguccaggugauugcaguagaacccggaaagaaucccaaaaacguccaaacaacucccgguaccuuuaagacgccugagggcgaagugggggccaucgcgcuugacuucaagccaggaacauccggcucucccauuguuaaucgagaggguaaaaucguggggcuguauggaaacggcgucgugacuaccucgggcacauacguuagcgcuauagcccaggcaaaggccacccaggaagggccuuugccggagaucgaggaugaaguguuuaaaaagcggaaucuaacuauuauggaccugcacccaggaucagguaaaacccgcagauaucuccccgcuaucgucagggaggccauuaagcggaaguuacgaacacugauccuugcaccuacgagagugguagcuuccgaaauggccgaggcgcugaaaggcaugccaauacgcuaccaaacuaccgccgugaagagugaacauacagggagggagauuguugaucucaugugccacgcaaccuucacuaugcguuugcugucucccguccgggugccuaacuauaauaugaucaucauggacgaggcucauuuuacagauccggccagcauugcugcaagaggauacaucuccaccagggugggcaugggugaagccgccgcuauauucaugacggcgacucccccagggucagucgaggcauuuccucagucuaacgccguaauucaggacgaggaacgcgauauccccgaacgaagcuggaauaguggauaugacuggauuacagacuucccaggcaaaaccgugugguuuguuccuuccaucaagagcggcaacgauauagcuaauugucucaggaaaaacgggaagcgggugauucagcugucuaggaagaccuucgacacugaguaccagaaaacaaagaauaacgauugggacuacgucgugaccacagauaucucagagaugggagccaacuuccgcgcagaccguguuaucgaucccagacggugccuuaaaccagugauucuaaaggaagguccggagagggucauccuggccggcccuaugcccgugacuguagcuuccgcggcccagcgccgagggagaauuggacggaaucagaacaaagaaggcgaccaguauauauacaugggucaaccauugaauaacgaugaggaccacgcacauuggacggaggcuaagauguuacuggauaauaucaacacccccgaagggauuaucccugcccucuuugagccagaaagggagaagagugcagccaucgacggcgaauaucgccugagaggagaggcuaggaaaacauucguggagcuuaugcggcguggcgaucugcccguuuggcucagcuacaaggucgccucggaaggguuucaguauucugaccgccgauggugcuucgacggagagagaaauaaccagguguuggaagagaauauggauguggaaauuuggacuaaagagggugagaggaagaaacugcggccucgcuggcuagacgcgagaaccuacuccgauccgcuggcacucagggaauuuaaggaguucgccgcuggccggcgaagcgucucaagugaccuuauacuggaaaucgggaaauuaccacagcacuugacacugagagcccaaaacgcucucgauaaucugguuaugcuucacaacucugagcagggaggcaaggcauaucgccaugccauggaggagcugcccgacaccauugagacucucauguugcuggcuuuaaucgccgugcuaacgggugggguaacccuguuuuuccucuccggcaagggacuuggcaaaacaagcauugggcuguugugugugauggcaucaagugcgcugcucuggauggccagcgucgaaccucacuggaucgcugccuccauaauccuggaguuuuuccuuauggugcuccugauucccgaaccagauaggcagcggacuccucaggacaaucaauuggcauacguugugaucggacuguuauuuaugauucuaaccgucgcugccaacgagaugggucugcucgagacaaccaagaaagaucuuggcaucgggcauguagcaguggaaaaucaccaccaugccacuaugcuggacguugauuugcgucccgcuucugcguggacacuguacgccguggcaacgaccgucauaacuccaaugaugagacacacaauugagaacaccaccgcuaacaucagccucacagccauugccaaucaggcagcuauccugaugggacuugacaagggcuggccuauauccaaaauggauaucggugugccguuacuggcccucgggugcuauucacaggucaaccccuugacucugacggcggcugugcuaaugcugguugcccauuacgcaauuaucggcccaggacuccaagccaaggcuaccagggaagcacagaagcgcacagccgcgggcauuaugaaaaauccuacuguggacgggaucguaaccauagaccuugaucccguggucuaugacgcuaaguucgagaaacagcugggacagauuauguugcugauccucuguacaucucaaauccuguuaaugcggaccacuugggcccuuugcgaaaguauuacgcuggcaacaggcccacucaccacucuaugggaggguucgccugggaaguuuuggaacaccacaaucgccguuagcauggcuaauauauuccgaggauccuaccuggccggcgcagguuuggcuuucucucugaugaaaucacucggcgggggaagaaggggcacuggggcccagggagagacccuuggcgaaaaguggaagcgccagcugaaccaguugagcaaauccgaguuuaauacauauaagaaaagugguauuauggaaguggaucggucugaggcgaaggaagggcugaaaagaggagagacgaccaagcacgccgucagccguggcacugcaaagcucaggugguucguggagcggaacuuaguaaaacccgaagguaaggugaucgaccugggcugugggcgcggaggcuggucauacuauugcgcugggcuuaaaaagguuacagaggugaaaggauacaccaagggcgguccggggcaugaggagccaauuccuauggccacuuacggauggaaucuggucaaacuacacuccggcaaggauguguuuuucacacccccagaaaagugugacacccuccugugcgauaucggcgagaguagccccaacccuacgauagaggaagggcgaaccuugagaguccugaaaaugguggagccguggcucaggggaaaucaauuuuguaucaagauucuuaaccccuauaugccaucuguuguagaaacacuggagcagaugcagcggaaacacgguggcauguuagugcgcaauccucuguccagaaacucaacucaugagauguacugggucagcugcgggaccggaaauaucgugucggcaguuaacaugacaucuaggauguugcucaaucgauucacuauggcucaccggaagcccaccuaugaacgugacguggaucugggcgccgguacaagacaugucgccguggagccugaaguagcgaaccuagacauuaucgggcagcgcauugagaacaucaaaaaugaacacaagaguaccuggcacuacgaugaggacaacccauauaagacuugggcuuaccauggauccuaugaggugaaacccagcggcucagcauccucuaugguuaauggcgucgugaggcuucugacgaagccuugggacgugauaccaauggucacacaaauugccaugaccgauacuacccccuuugggcagcagcggguuuucaaagaaaagguggacacaagaacgccgcgcgcuaaaaggggaaccgcccaaaucauggagguaacugcaaaguggcucugggguuuucugagccgaacaaagaaaccucggaucuguaccagagaagaguucacuaggaaggugcgcaguaacgccgcuauuggcgcggucuuuguggaugaaaaucaguggaacuccgccaaagaggcaguugaggacgaacguuucugggauuuggugcaccgggagagagaacugcauaagcaggggaaaugcgcuacaugcgucuacaauaugaugggaaagagggagaagaaacucggcgaauuugguaaggccaaagggagccgcgcaauaugguacauguggcuuggagcccgauuccuggaguucgaggcuuuaggcuuuaugaacgaagaccacugguucucucgggaaaauucacugaguggcguggaaggggagggauugcauaagcucgguuauauccugagagauauuuccaaaaucccaggcgggaacauguacgccgacgauaccgcgggaugggacacaaggauuacugaggaugaccuacagaaugaagcaaagaucaccgauauaauggagcccgaacacgcccuucuggcuacgagcaucuuuaaacucaccuaucaaaacaagguaguucgcgugcagagaccugccaagucuggcacagucauggacgugauuucgcggagggaccagcgugguucaggacaggugggaacuuacggccugaauaccuucacaaacauggagguccaauugauccgacagauggaaagcgagggcauauuuuccccaagugaguuagaaacucccaaucuggccaaaaagguucucgauuggcuugagaaacacggggcugaacgccugaagagaauggccaucucuggagacgauugugugguaaaaccgauagacgaucgguucgcuaccgcccuaacggcacugaacgacauggguaaggugaggaaggauauuccucagugggagcccagcaaaggcuggaacgacuggcagcaagucccauuuugcucccaucacuuccaucagcucaucaugaaggaugggcgcgaaaucgugguuccuuguagaaaucaggacgaguuggugggacgggcgagggucucacagggcgccgguuggagucugcgagagacagcuugccuugggaaaucuuaugcccaaauguggcagcugauguacuuucaccguagagaucuccgcuuagcagcuaacgccauuuguagcgcagugcccguagacuggguuccaaccucccggacuacauggucaauacacgcccaucaccaguggaugaccacugaagacaugcugagcguguggaauagggucuggaucgaggaaaaccccuggauggaggauaagacccaugugucuuccugggaagagguuccuuauuugggaaaaagagaggaccaauggugcggcagucugauuggccucacagcgcgcgcuacgugggccaccaauauccagguggcaauuaaccagguccggaggcuuaucgggaaugaaaacuaccuggauuacaugacuagcaugaagcgauucaagaaugagucggacccagaaggagcccuaugguga

SEQ ID NO: 14071 - RNA, 9879 nt, Artificial Sequence
  derived and/or modified CDS sequence (opt3) from DENV-1__KP188540__SS-prME
agcgugaccaugcugcucaugcuucugcccaccgcauuggcuuuccacuuaacuacgaggggcggggagccucauaugaucgucuccaagcaggaaaggggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauucagaggggaagacggaugcugguacggcauggaaauccgccccguuaaggagaaagaagagaaucuggugcgaaguaugguaagcgccgguucuggcgaaguggauuccuuuucacuugggaugcugugugucaguauuaugaucgaggaggugaugcggagccguuggucgagaaagauguugaugacuggaacacucgcuguuuuccugcuacugauaaugggccagcucaccuggaacgaccugauuaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaaucgggcucagccugguugccucaguggaguugccaaacagucuggaagaguuaggagauggccucgcuaugggcauuaugaugcugaaacuucugaccgaguuccaaccccaccaguuguggacuacccuccugucccuaacauuugucaagacuacccugucucuugacuaugcguggaaaacgacagccaugguacucagcaucgugucccuguucccguugugucugucaaccacuagccagaagacaaccugguuaccuguucuccuggggaguuuuggaugcaaaccacuuacuauguuccugauuacagagaacaagauauggggucgcaagucuuggcccuugaaugagggcaucauggcaauugggaucguguccauucuccugagcucgcuacugaaaaacgaugucccucuugcuggaccccucaucgccggcgguaugcugauagccuguuacgugaucucagggucuagugcugacuuguccuuagaaaaggcagccgagguaagcugggaacaggaggcggaacauucuggagcuagccacaauauucugguggagguccaagaugacggcaccaugaaaaucaaggaugaggaacgggacgauacgcucacuauucugcuuaaagccacccuguuggcaguuuccggcguguauccaaugucaaucccugccacacuauucgugugguacuuuuggcagaagaaaaagcagagaagugggguccugugggacacccccagcccaccggagguggaaagggcuguucucgaugacggaauauaucguauucugcagcgcggucuuuuaggccggucucaaguaggggugggagucuuccaggauggcguguuucauacaauguggcacguuacuagaggugcagugcugauguaccaggggaagaggcucgagccuuccugggccucagucaaaaaggacuugaucaguuauggaggcggcuggcgauuccaggggagcuggaacaccggagaggaagugcaaguaaucgcggucgagcccgguaaaaauccaaagaacgugcagacgacacccggcacuuuuaaaaccccugaaggggagguuggagcuauugcccuggacuucaagccaggcacauccgguucucccauagugaaucgggaagggaagaucgucggacucuacggcaacggcgugguuaccacuucggggaccuacgugagcgcaauugcccaggcuaaagccucacaagagggaccucugccggagaucgaaaaugaggucuuuaagaaacgcaaccuuacaauuauggaucugcacccagguuccggcaagacgagaagguauuugcccgcaaucgugcgggaagcuauaaaacgaaagcuaagaacucugauccucgccccuacccgcguaguggcgagugagauggccgaagcauuaaaggggaugccaauuagguaccagacaaccgcuguuaaaucugagcauacuggacgugagaucgucgaccugaugugccacgccacauucaccaugcggcuucugagccccgugagagugccuaauuauaacaugauuaucauggaugaagcucauuuuacggacccggcauccauagccgccaggggcuacauuucaacucgcgucgguaugggggaggcugcggcaaucuucaugacagccacacccccaggaucuguagaggcuuuuccucagagcaaugccgugauccaggaugaggaacgagacauucccgagagaaguuggaacuccggcuaugauuggaucaccgacuucccaggcaagacuguuugguucgugccuagcauaaaaucugggaaugauauugcaaacugucuccggaagaacggaaaaagggucauccaauugucacgcaagacauuugacaccgaguaccagaagaccaaaaauaacgauugggacuaugugguuacuacggacauuuccgaaaugggugccaauuuccgugcugauagagugaucgacccccggaggugccugaagccagucauacucaaagauggcccggagcgcgugauucuggcggggccuaugcccguaaccguggccagugcagcucagcgaagaggacggaucggcaggaaccagaauaaggaaggugaccaauacguuuacauggggcagccacuuaacaaugaugaggaccacgcccauuggacagaggcaaaaaugcuacuggauaacaucaauacucccgaaggcauuaucccugccuuguuugagccagaacgcgagaaaagcgcugccauugacggagaauauagauuaaggggcgaagcgcggaagaccuucgucgagcugaugcgucgcggggaucuccccguguggcugucguacaaaguggcaucugaaggauuucaguauuccgaccgaagauggugcuucgauggugagaggaacaaucagguccuugaagagaacauggacguugaaauauggacaaaggagggcgagcggaaaaagcugcgcccuagauggcucgaugccaggaccuacagcgacccguuggcucugcgggaauuuaaagaguucgccgcugggcgaagaucagugaguggagaccuaauccuggaaauuggcaagcucccacaacaccuuacucugcgcgcacagaaugccuuagauaacuugguaaugcugcacaauucugagcagggugggaaggcuuauaggcaugccauggaggaacuccccgacacgaucgagacccugaugcuucuggcacucaucgcgguguugacaggcggagccacucuguuuuucuuauccggcaaggggcuaggaaagaccagcauuggucugcucugugucacagcuucaagugcccuucuguggauggcaagcguggaaccucacuggauagcugccuccaucauuuuggaguuuuuccugaugguucuccugauccccgaaccagaucggcagcguaccccucaagacaaccagcuugcauacguggucauuggccuccuguuuaugaucuugacuguagccgcuaacgagauggggcuguuagagacaacgaaaaaggaucuaggaauaggcuauguggcggccgaaaaucaucagcacgcaaccaugcuggacguugaucuccaccccgcuucugccuggacucuuuacgccguggcaacaaccgucaucaccccaaugaugagacauacaauugagaacacuacggcuaauaucagccugaccgccauugcgaaccaagcugccaucuugaugggucuggacaaaggguggccuauauccaagauggauauuggcgugccgcuccuggcacuuggaugcuacucacaggucaaucccuuaacacugacugccgcugugcucauguugguugcacacuaugccaucauuggcccagggcugcaggcgaaagcuaccagggaagcccagaagcgcacagcagccggaaucaugaagaacccuaccguggacggcauaguagcuaucgaucuagaccccguggucuacgaugccaaauucgagaagcaacugggucagauuaugcuccuuauccuguguacuucucagauuuugcugaugcggacgacaugggcacucugcgaaaguaucacccuggcuacugggccauuaaccacacuuugggagggaucgccuggcaaauucuggaauacuaccauagccguuagcauggcgaacauuuuucgagguuccuaucuggccggcgcagggcucgcuuucucucuaaugaagucacugggaggcgggagaaggggaacaggcgcccagggugagacguugggggaaaaauggaagcgccaacugaaucagcucagcaaguccgaguuuaacaccuacaaacggaguggaaucauggaaguggacagaucugaggcaaaggaaggccuuaaacguggugagacuacaaagcaugcugucagcaggggcaccgccaaacugcggugguucguggagcgcaauuugguaaagcccgaagggaaggugaucgaccugggauguggccgagggggauggucauauuacugcgccggccucaaaaagguuacugaggugaaagguuauacaaaagggggaccgggccacgaggaaccaauuccuauggcgaccuacggcuggaacuuagucaaacugcauuccgggaaggauguguuuuucaugcccccagaaaaaugugacacgcuucugugcgauaucggagagaguagccccaauccuaccauagaggaagguagaacacuaaggguccucaagaugguggagccguggcugcggggcaaccaguuuuguauuaagaucuugaaucccuacaugccaucuguuguagaaacucuggagcagaugcaacgcaaacacgggggaaugcucgugagaaacccucuuuccagaaauucaacccacgagauguauugggucagcugcggcacagguaacauugugucggcuguuaacaugacuucucgaaugcuguuaaaucgguucaccauggcacaucguaagcccacauacgaaagagacguggaucugggggccggaacccgccacgucgcuguggagccugaaguagccaacuuggacaucauaggccagaggaucgagaauauuaaaaacgaacauaagaguacuuggcacuaugaugaggacaauccauacaaaacgugggcauaucacggcuccuacgaggugaagcccagcgggucagccuccucuaugguuaacggagucgugcggcuccugacaaagccuugggaugugaucccaauggucacccagauugcuaugacugacaccacacccuuuggucaacagagaguuuucaaagaaaagguggauacgcgcaccccgagggcgaaacgaggcacuacacagaucauggagguaaccgccaaguggcuauggggguuucuuagccggaauaaaaagccuagaauuuguacuagggaagaguucacacgcaaggugcguaguaacgcagcuaucggagccgucuuuguggacgaaaaucaguggaacuccgcaaaagaggccguugaggacgaacgguucugggaucuggugcauagagagagggaacuccacaagcaaggcaaaugcgcuaccugcgucuauaauaugauggguaagcgcgagaaaaagcugggggaguucggaaaggccaaaggcagccgagcgauaugguacaugugguugggcgcacgguuucuggaguucgaggcccucggguuuaugaacgaagaccauugguucucuagagaaaauucacuuaguggaguggaaggugagggccugcacaaguuaggguacauucugagggauaucuccaaaaucccaggaggcaacauguaugcugacgauacagccgguugggacacucgcauuaccgaggaugacuugcagaaugaagcaaagauaacggauaucauggagcccgaacaugcucuccuggccaccagcauuuuuaaacuaacauaccagaacaagguaguuagagugcagcggccugcuaaaaacgggacugucauggacgugaucucuaggcgugaucaacgaggaucgggccaggugggcaccuaugggcuuaauacauucacuaacauggagguccagcugauucgccagauggaaucagagggaaucuuucucccaagcgagcuggaaacccccaauuuggccgagagagcauuagacuggcuggaaaagcacggugcggagcggcucaagaggauggccauauccggcgaugacuguguugugaaaccgaucgacgaucgcuucgcuacggcccuuacagcacugaacgacauggggaagguaagaaaagauauuccucaaugggaacccaguaagggauggaaugacuggcaacaggugccauuuugcucucaccauuuccaccagcuaaucaugaaagauggccgggagauugucgugccuuguaggaaccaagacgagcugguuggucgagcucgugugagccagggggccggauggucccucagagaaaccgcaugcuugggcaagucauacgcccagauguggcaacugauguauuuucaucgccgggaucuuaggcuggcggcuaaugccaucuguagugcaguccccguggacuggguaccagccucuagaacuacauggagcauacacgcucaccaucaguggaugaccacugaggauaugcucuccguuuggaaccgcguguggauugaagagaaucccuggauggaagacaagacccacgucucaagcugggaggaggugccuuacuuaggcaaacgggaagaucaguggugcgggucucugaucggauugacagccagggcaacgugggcuaccaacauccagguugccauuaaucaagugcgaagacugauagguaacgagaauuaucucgacuacaugacuuccaugaagcgguucaaaaacgaaagugacccagagggcgcgcuuugguga

SEQ ID NO: 14072 - RNA, 9879 nt, Artificial Sequence
  derived and/or modified CDS sequence (opt3) from DENV-1__KP188541__SS-prME
agcgugaccaugcugcuaaugcuucugcccaccgccuuggcuuuccacuuaacuacgaggggcggggagccucauaugaucgucuccaagcaggaaaggggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauucagaggggaagacggaugcugguacggcauggaaauccgccccguuaaggagaaagaagagaaucuggugcgaaguaugguaagcgccgguucuggcgaaguggauuccuuuucacuugggauucugugugucaguaucaugauagaggaggugaugcggagccguuggucgagaaagauguugaugacuggaacacucgcuguuuuccugcuacugauuaugggccagcucaccuggaacgaccugaucaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaauugggcucagccugguugccucaguggaguugccaaacagucuggaagaguuaggagauggccucgcuaugggcaucaugaugcugaaacuucugaccgaguuccaaccccaccaguuguggacuacccuccugucccuaacauuugucaagacuacccugucucuugacuaugcguggaaaacgacagccaugguacucagcauugugucccuguucccguugugucugucaaccacuagccagaagacaaccugguuaccuguucuccuggggaguuuuggaugcaaaccacuuacuauguucuucauaacagagaacaagaucuggggucgcaagucuuggccccugaaugagggcauuauggcaaucgggauuguguccaucuugcucagcucgcugcucaagaacgaugucccucuggcuggaccccuuauagccggcgguaugcucaucgccuguuacgugauuucagggucuagugcugaccuguccuuggaaaaggcagccgagguaagcugggaacaggaggcggaacauucuggagcuagccacaauaucuuaguggagguccaagaugacggcaccaugaaaauuaaggaugaggaacgggacgauacgcugacuauccuccugaaagccacccuucuggcaguuuccggcguguauccaaugucaauaccugccacauuguuugugugguacuucuggcagaagaaaaagcagagaagugggguccuaugggacacccccagcccaccggagguggaaagggcuguucuggaugacggaauuuaucguauccuccagcgcggucugcuuggccggucucaaguaggggugggagucuuucaggauggcguguuccauacaauguggcacguuacuagaggugcaguguuaauguaccaggggaagaggcuggagccuuccugggccucagucaaaaaggaccucaucaguuauggaggcggcuggcgauuucaggggagcuggaacaccggagaggaagugcaaguaauugcggucgagcccgguaaaaauccaaagaacgugcagacgacacccggcacuuucaaaaccccugaaggggagguuggagcuauagccuuggacuuuaagccaggcacauccgguucucccaucgugaaucgggaagggaagauugucggacuguacggcaacggcgugguuaccacuucggggaccuacgugagcgcaaucgcccaggcuaaagccucacaagagggaccucucccggagauugaaaaugaggucuucaagaaacgcaaccugacaaucauggaucuucacccagguuccggcaagacgagaagguaucugcccgcaauagugcgggaagcuaucaaacgaaaguugagaacucuaauucuggccccuacccgcguaguggcgagugagauggccgaagcacucaaggggaugccaaucagguaccagacaaccgcuguuaaaucugagcauacuggacgugagauugucgacuuaaugugccacgccacauuuaccaugcggcugcuuagccccgugagagugccuaauuauaacaugaucauaauggaugaagcucauuucacggacccggcauccauugccgccaggggcuacaucucaacucgcgucgguaugggggaggcugcggcaaucuuuaugacagccacacccccaggaucuguagaggcuuucccucagagcaaugccgugauucaggaugaggaacgagacauccccgagagaaguuggaacuccggcuaugauuggauaaccgacuucccaggcaagacuguuugguuugugccuagcauuaaaucugggaaugauaucgcaaacugucugcggaagaacggaaaaagggucauucaacucucacgcaagacauucgacaccgaguaccagaagaccaaaaauaacgauugggacuaugugguuacuacggacaucuccgaaaugggugccaauuuucgugcugauagagugauagacccccggaggugcuugaagccagucauucugaaagauggcccggagcgcgugauccucgcggggccuaugcccguaaccguggccagugcagcucagcgaagaggacggaucggcaggaaccagaauaaggaaggugaccaauacguuuacauggggcagccacugaacaaugaugaggaccacgcccauuggacagaggcaaaaaugcuucuagauaacauuaauacucccgaaggcaucauuccugcccuguucgagccagaacgcgagaaaagcgcugccauagacggagaauauagauugaggggcgaagcgcggaagaccuuugucgaguuaaugcgucgcggggaucugcccguguggcucucguacaaaguggcaucugaaggauuccaguauuccgaccgaagauggugcuuugauggugagaggaacaaucagguccuggaagagaacauggacguugaaaucuggacaaaggagggcgagcggaagaaacuucgcccuagauggcuggaugccaggaccuacagcgacccgcucgcuuugcgggaguucaaagaguuugccgcugggcgaagaucagugaguggagaccugauucuagaaaucggcaaacugccacaacaccucacucuucgcgcacagaaugcccuggauaacuuaguaauguugcacaauucugagcagggugggaaggcuuauaggcaugccguggaggaacugcccgacacgaucgagacccucaugcugcuugcacugauugcgguccucacaggcggagugacuuuguucuuucuguccggcaagggguuaggaaagaccagcauaggucuacuguguguuacagccucaagugcucuccuuuggauggccagcguggaaccucacuggaucgcagcuuccauuauccuggaguucuuuuugaugguccugcucauucccgaaccagaucggcagcguaccccucaagacaaccagcuggccuacguagugaucggccuucucuucaugauacugacuguugcagccaacgagaugggguugcuggagacaacgaaaaaggauuuaggaaucggcuauguggcugcggaaaaucaucagcacgccaccaugcuagacgucgaucugcaccccgcaucugcuuggacucucuacgccguggccacaaccgucauuaccccaaugaugagacauacaaucgagaacacuacggcaaauauuagccuuaccgcuaucgccaaccaagcggcuauacugauggguuuggacaaaggguggccuauuuccaagauggauaucggcgugccgcugcucgcccugggaugcuacucacagguuaauccccuuacauuaacugcagccgugcugaugcucguagcucacuaugcaauuaucggcccaggguugcaggccaaagcgaccagggaagcucagaagcgcacagccgcaggaauaaugaagaacccuaccguggacggcaucgucgccauugaucuggaccccguuguguacgaugcuaaauucgagaagcaacuaggucagaucaugcugcucauucuuuguacuucucagauccuguugaugcggacgacaugggcccugugcgaaaguauaacccucgcaacugggccacugaccacauuaugggagggaucgccuggcaaauuuuggaauacuaccauugcugucagcauggccaacaucuuccgagguuccuaucuugcgggcgccgggcuggcauuuucucucaugaagucacuaggaggcgggagaaggggaacaggcgcucagggugagacgcugggggaaaaauggaagcgccaauugaaucagcugagcaaguccgaguucaacaccuacaaacggaguggaaucauggaaguggacagaucugaggccaaggaaggccucaaacguggugagacuacaaagcaugcaguaagcaggggcaccgcuaaacuucggugguuuguggagcgcaaucugguuaagcccgaagggaaggugauugacuugggauguggccgagggggauggucauauuacugcgccggccugaaaaaggucacugaggugaaagguuauacaaaagggggaccgggccacgaggaaccaaucccuauggccaccuacggcuggaaccucgucaaauuacauuccgggaaggauguguucuuuaugcccccagaaaaaugugacacgcugcuuugcgauauaggagagaguagccccaauccuaccauugaggaagguagaacacugaggguucuaaagaugguagagccguggcuccggggcaaccaguucuguaucaagauucugaaucccuacaugccaucuguggucgaaacuuuggagcagaugcaacgcaaacacgggggaaugcuggugagaaacccucucuccagaaauucaacccacgagauguauuggguuagcugcggcacagguaacaucgugucggcggucaacaugacuucucgaaugcuucugaaucgguuuaccauggcucaucguaagcccacauacgaaagagacguggauuuaggggcaggaacccgccacguagccguggagccugaaguugcuaaccuggacauaaucggccagaggauugagaauaucaaaaacgaacauaagaguacuuggcacuaugaugaggacaauccauacaaaacgugggccuaucacggcuccuacgaggucaagcccagcgggucagcauccucuauggugaacggagugguccgguugcucacaaagccuugggauguuauuccaauggugacccagaucgccaugacugacaccacacccuucggucaacagagaguauuuaaagaaaagguggauacgcgcaccccgagggcuaaacgaggcacuacacagauuauggaggucaccgcgaaguggcuguggggguuccuaagccggaauaaaaagccuagaaucuguacuagggaagaguuuacacgcaaggugcguaguaacgccgcaauaggagcuguuuucguggacgaaaaucaguggaacuccgccaaagaggcagucgaggacgaacgguucugggaucuugugcauagagagagggaacugcacaagcaaggcaaaugcgcaaccugcguauauaauaugauggguaagcgcgagaaaaagcucggggaauuuggaaaggcuaaaggcagccgagccauuugguacauguggcugggcgcgcgguucuuggaguuugaggcacugggguucaugaacgaagaccauugguuuucuagagaaaauucacucaguggaguugaaggugagggccuucacaagcugggguacaucuuaagggauaucuccaaaauuccaggaggcaacauguaugccgacgauacagcugguugggacacucgcauaaccgaggaugaccugcagaaugaagccaagaucacggauauuauggagcccgaacaugcauugcucgcuaccagcaucuucaaacugacauaccagaacaagguggucagagugcagcggccugccaaaaacgggacugugauggacgucauuucuaggcgugaucaacgaggaucgggccagguuggcaccuaugggcuaaauacauuuacuaacauggaggugcagcuuauccgccagauggaaucagagggaauauuccugccaagcgagcucgaaacccccaaucuggcugagagagccuuggacugguuagaaaagcacggugcagagcggcugaagaggauggcgaucuccggcgaugacuguguagugaaaccgauugacgaucgcuuugccacggcucucacagcccuuaacgacauggggaaggucagaaaagauaucccucaaugggaacccaguaagggauggaaugacuggcaacaggugccauucugcucucaccauuuucaccagcugauuaugaaagauggccgggagaucguugugccuuguaggaaccaagacgagcuagucggucgagcacgugugagccagggggcuggauggucccugagagaaaccgccugccucggcaagucauacgcacagauguggcaauugauguauuuccaucgccgggaucugaggcuugccgcgaaugcuauauguagugccguacccguugacugggugccagcaucuagaacuacauggagcauucacgcccaccaucaguggaugaccacugaggauaugcuguccgucuggaaccgcguguggaucgaagagaaucccuggauggaagacaagacccacguuucaagcugggaggaggugccuuaccucggcaaacgggaagaucaguggugcgggucuuuaaucggacugacagcuagggccacgugggcaaccaacauucaggucgcuauaaaucaagugcgaagauugaucgguaacgagaauuaucuggacuacaugacuuccaugaagcgguuuaaaaacgaaagugacccagagggcgcccucugguga

SEQ ID NO: 14073 - RNA, 9879 nt, Artificial Sequence
  derived and/or modified CDS sequence (opt3) from DENV-1__KP188543__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagagguagaaccggacgauguggacuguuggugcaaugccaccgauacuugggucacauaugggaccuguagucaaacgggagagcaccgccgagacaagcguagcguggcgcuggcuccccauguuggcuugggucucgagacuagaaccgaaacauggauguccucugagggggccuggaaacagauccagaagguggaaacuugggcacugaggcacccuggauucaccgucauugcccuguuucucgcucaugcaaucggcacaucgauuacccagaagggcaucauauucaucuuacugaugcuugugacgccaucaauggccaugcggugcguagggauuggaaaccgcgauuuuguugaggguuugagcggcgcuacuuggguggacgucgugcuggagcacgggaguugugugacaaccauggccaaaaauaagcccacucuagauaucgaacuccugaaaacagaggucaccaacccugcgguucuuagaaagcugugcauugaagcaaaaaucuccaauacgaccacagacucuagguguccaacucaaggagaggccaccuugguggaagagcaggaugcuaacuucguaugccggcgcacauuuguggaccgaggcugggguaauggguguggacucuucggcaagggcagccuguuaacuugcgccaaguuuaaaugcgucaccaagcuggaggggaaaauagugcaguacgaaaaccucaaguauuccguuauugugacaguccacaccggagaucagcaucaaguggguaaugagacuacggaacacggcacaaucgcaaccauuacuccccaggcuccuaccucagagauccagcuuacagacuacggggcccugaccuuggacuguaguccaagaacuggacuagauuucaacgaaaugguacugcucacaaugaaagagaagagcuggcugguucauaaacagugguuucuugaccugccguugcccuggacgucuggcgcguccaccucacaagagacuuggaauaggcaggaucuccuggugacauucaagaccgcccacgcaaagaaacaggaagucguggucuuagguagccaagagggggcuaugcacacagcccugacuggcgcuaccgaaauccagacgaguggaaccacaacuauuuuugccggccaucuaaagugccggcucaaaauggacaagcugacccuuaaagggaugucuuaugugauguguacaggauccuucaaguuggagaaggaaguugcagagacucagcacgguaccgugcugguacaggucaaauacgagggcacggaugccccuugcaagauaccauuccucacacaagacgaaaaaggggugacccagaacggacgucugaucacugcuaaucccauuguuacagauaaggagaaaccugugaacaucgaaaccgagccacccuuuggcgagagcuauauagucgugggugcgggggaaaaggcacuuaagcugucgugguucaaaaagggcucuuccauuggaaaaauguuugaggccacugcucgcggcgccagaaggauggcaaucuugggggacaccgccugggauuucggaucaaucgguggccucuuuacaaguguagggaagcugauucaucagguguucggaacggcuuacggcguuuuauuuagcggugucuccuggaccaugaaaaucgggauuggcauacugcuaacuuggcucggacugaauucucggagcacaucacuuaguaugaccuguaucgccgugggcauggugacauuguaccugggggucaugguucaggcagacuccggaugcgugauuaacuggaagggccgagaacucaagugugguagcgggaucuucgugacuaacgagguacacaccuggacggaacaauauaaauuucaggcggauucuccgaagcgccugucagcugccaucggaaaagcaugggaggagggcgucugcgguauuagaagugccacaagguuagaaaauauaauguggaagcagaucagcaacgagcugaauuacauucuuuuggaaaacgacaugaaauucaccgugguugugggcgacgucaaugggauccucgcucagggaaagaaaaugauucggccucaacccauggagcauaaguauuccuggaagucuuggggcaaagccaagaucauaggggcagauauccagaacacuaccuuuauuaucgacggaccagauacaccugaaugucccgacgaucagcgcgcuuggaauauuugggagguggaggacuacggcuucgguaucuuuacuaccaacauauggcugaaacuaagagauucgcacacacagaugugcgaccacaggcugaugagcgccgcgauuaaggauuccaaagccguucaugcugacaugggguauuggaucgaaucagagaagaaugaaacguggaagcucgcacgugccaguuucauugaggugaaaaccuguaucuggccaaagucucacacucuguggagcaacggaguacuugaauccgagauggucauacccaaaaucuacggcgguccuauuucacaacauaauuaucggccaggcuacuucacacagaccgcugggccguggcacuugggaaagcuggaguuagauuuugaccucugcgaaggcacuacagugguggucgaugagcacugcggguaccgaggacccagccugagaaccacgacuguuaccggcaaaaucauucaugaaugguguugcaggucuuguacacuuccuccacugcgcuuccggggugaggacgggugcugguauggaauggagaucagacccgugaaggaaaaggaggaaaacuugguaagguccauggugagugccggcagcggugagauggacucuuuuucccucggcauacugugugucucaauucuaaucgaagaggugaugcgcagucgauggagccggaaaaugcugaugaccgggacucucgcaguuuuccugcuuuugaucaugggacagcugacauggaaugauuuaauucgucucugcaucauggugggcgcgaacgccucggacagaauggggaugggaaccacauaccuggcucuuauggccacuuuuaagaugaggccuauguucgcagucggccugcuauuucgccggcucaccuccagagaggugcuguugcugacgguugguuuaucucucguggcuagcgucgaacugccaaauucacuugaggaacugggggauggauuggccaugggcauuaugaugcucaaacugcuaacagacuuccaaccccaccagcuguggaccacucuucucagucugaccuuuauaaggacauccuugucucuggauuaugcauggaagacuauggccauggcuuuaagcaucguaucccucuucccgcugugucuuucaaccacgagccagaaaacaaccuggcugccuguguugcucggcaguuuugggugcaagccacugacuauguuccuaauuacagagaacaagaucuggggacgaaaaucuuggcccauuaacgaagguaucauggcgguuggcauaguguccauccugcuuagcucgcuccugaagaaugacgucccuuuggccgggcccuuaauugcaggaggcaugcugaucgcuuguuacgugauuucagguucuagugccgaucucucccuggagaaagccgcugagguaagcugggaagaggaagcagagcauucugggaccagccacaacauccuuguggaaguccaggacgauggaacuaugaagauaaaagacgaggagcgcgaugacacacugaccauuuugcuaaaggccacgcugcucgcgguuuccggcguguauccaaugucaaucccugcuacucuguuugugugguacuucuggcaaaaaaagaagcagcggaguggcguccuuugggauacccccagcccaccggaaguggagagagccguuuuagacgacgggaucuauaggauucugcagcguggacucuugggucgcucucagguaggcgugggggucuuccaagauggaguguuucauacaauguggcacguuacccggggcgcagugcugauguaccaggguaaaagacucgaaccuuccugggccucagucaagaaagaccugauaaguuacgggggaggcuggagguuccagggcagcuggaauacaggggaggaggugcagguaaucgcugucgaacccggaaagaacccaaaaaaugugcaaacuacccccgguacguuuaagacaccugagggcgaaguuggggcaauugcccuugauuucaagccaggaacuuccggcucucccaucgugaaccgagaggguaaaauugucgggcuguauggaaauggcgugguuaccacaucgggcaccuacgugagcgcgaucgcucaggccaaggcaacucaggaagggccuuugccggagauagaggacgaagucuuuaaaaagcggaaccuaaccaucauggaucugcacccaggaucagguaaaacacgcagauaucuccccgccauugugagggaggcuaucaagcggaaguuacgaacgcugauucuugccccuacuagaguaguggcauccgaaauggcugaggcccugaaaggcaugccaauccgcuaccaaaccacagcgguuaagagugaacauaccgggagggagauagucgaccucaugugccacgccacuuucacaaugcguuugcugucucccgugcgggugccuaauuauaacaugauuaucauggaugaggcacauuuuaccgacccggcuagcaucgccgcuagaggauacauuuccacgagggucggcaugggugaagcagccgccaucuucaugacugcuacacccccagggucaguagaggcguuuccucagucuaaugcagugauacaggaugaagagcgcgacauucccgaacgaagcuggaacaguggauaugauuggaucaccgacuucccaggcaaaaccguuugguuugugccuuccauuaagagcggcaaugacaucgccaacugucucagaaaaaaugggaagcgggucauacagcugucuaggaagacuuucgauacagaguaccaaaaaaccaagaacaacgacugggauuacgugguuacaacugacauuucagagaugggagcuaauuuccgcgccgaucgugugaucgaccccagacggugccuuaaaccagucauccuaaaggaagguccggagagggugauucuggcaggcccuaugcccguaacgguggccuccgcugcgcagcgccgagggagaaucggacggaaccagaauaaagaaggcgaucaguauauuuacaugggucaaccauugaacaaugacgaggaucacgcccauuggaccgaggcaaagauguuacuggacaacauaaauacacccgaagggaucauuccugcucucuuugagccagaaagggagaagagugccgcaaucgauggcgaauaucgccugagaggagaggccaggaaaacuuucguugagcuuaugcggcguggcgaccugcccgucuggcucagcuacaagguggcuucggaaggguuucaguauucugaucgccgauggugcuucgacggagagagaaacaaucagguguuggaagagaacauggacgucgaaaucuggaccaaagagggugagaggaagaaacugcggccucgcuggcuagaugccagaacauacuccgacccgcuggcgcucagggaauuuaaggaguucgcagccggccggcgaagcguuucaggggaucuuauucuggaaauaggaaaauuaccacagcacuugacccugagagcucaaaaugcccucgacaaccuggugaugcuucacaauagugagcagggcgguaaggcuuaucgccaugcaauggaagagcugcccgauacuaucgagacgcucauguugcuggccuuaauugcuguacuaaccgggggcgugacacuguuuuuccucucuggaaagggccuugggaaaacuuccaucggacuguugugugucauggccagcucagcacugcucuggauggcgaguguggaaccucacuggauugccgcuagcaucauacuggaguuuuuccuuaugguucuccugauccccgaaccagacaggcagcggaccccucaggauaaccaauuggccuacguggucauuggucuguuauuuaugauccuaacaguagcagcuaaugagaugggccugcucgagaccacuaagaaagaccuugggauuggacauguggccguugaaaaccaccaccaugcaacaaugcuggauguggacuugcgucccgccuccgcuuggacgcuguacgcggucgccaccacugugaucacaccaaugaugagacacaccauagagaacaccacagcaaauauuucucucacugcuaucgccaaccaggccgcaauucugaugggccuugauaaggguuggccuaucagcaaaauggacauaggggucccguuacuggcucucggcugcuauucccaggugaaucccuugacgcugaccgccgcgguucuaaugcugguggcucauuacgccaucauuggaccaggccuccaagcaaaggccacaagggaagcucagaagcgcacugcagccgggaucaugaaaaacccuaccguagauggaauugugacaaucgaccuugaccccgucguuuaugaugcgaaguucgagaaacagcugggccagauaauguugcugauucucuguaccucacaaauccuguuaaugcggacuacgugggcucuuugcgaaucuaucacacuggccaccgguccacucacuacccuaugggaggggaguccuggaaaguuuuggaauacaacuauugcagugucgauggccaacaucuuccgaggcagcuaccuggcuggugccggcuuggcauucucccugaugaaaucucucgggggaggcagaagggggaccggagcucagggcgagacacuuggugaaaaguggaagcgccagcugaaucaguugucaaaaagcgaguuuaacacguauaagaaauccgggauaauggaagucgaccggagugaggccaaggaaggacugaaaagaggcgagaccacuaagcacgcggugucucgugguacagccaagcucaggugguucguagagcggaauuuagugaaacccgaaggcaagguuguggaucugggguguggacgcggcggguggagcuacuauugcgcaggacuuaaaaaggucaccgaggugaaaggcuacacuaagggugggccgggacaugaagagccaauuccuauggcuacauacggcuggaaccuggucaaacuacacucaggcaaggacguguuuuucacccccccagaaaagugugauacgcuccugugcgacaucggggaguccagucccaauccuaccauugaggaaggacgaacauugagaguucugaaaaugguagagccguggcucagggguaaccaauuuuguaucaagauacuuaaucccuauaugccaagcguggucgaaacucuggagcagaugcagcggaaacacggcgggauguuagugcgcaacccucugucuagaaauuccacccaugagauguacuggguuucaugcggaacaggcaacaucgugagcgccgucaauaugacuucgaggauguugcucaaccgauucaccauggcacaccggaagcccacauaugaacgugauguggaccugggugcugggaccagacauguagccguggagccugaaguugccaaccuagauauuaucggacagcgcauugagaauaucaaaaacgaacacaagucuacuuggcacuacgacgaggauaauccauauaagacgugggcguaccauggcaguuaugaggucaaacccuccggcagcgcuucauccauggugaacgggguggucaggcuucugacaaagccuugggacguuauuccaauggugacccaaaucgcaaugacugacaccacacccuuuggacagcagcggguauucaaagaaaagguggauacgagaaccccgcgcgccaaaagggguacugcucaaauaauggaggucacagccaaguggcucuggggcuuucugucucgaaauaagaaaccucggauuuguaccagagaagaguucacuaggaaggugcgcagcaacgcagccaucggggcuguuuuuguggacgaaaaucaguggaacagugcgaaagaggccgucgaggaugaacguuucugggacuuggugcaccgggagagagaacugcauaagcagggaaaaugcgcaacaugcguauacaauaugaugggcaagagggagaagaaacucggugaauuugggaaggcuaaaggaucccgcgccaucugguacauguggcuuggcgcacgauuccuggaguucgaggccuuaggcuuuaugaacgaagaucacugguucagccgggagaauucucugucagggguugaaggagaggguuugcauaagcucggcuauauucugagagacauaaguaaaaucccagggggaaacauguacgcugaugacaccgccggcugggauacaaggauuacugaggacgaucuacagaaugaagcgaagaucaccgacauuauggagcccgaacacgcacuucuggccacguccaucuuuaaacucaccuaucaaaacaaggugguccgcgugcagagaccugcuaagagcgguacagugauggaugucauaucucggagggaccagcgugggucgggacagguuggcacuuacggccugaauaccuucacaaacauggaggugcaauugauccgacagauggaaucagaggggauuuuuagcccauccgaguuagaaacucccaaccuggccaaaaagguacucgacuggcuugagaaacacggagcagaacgccugaagagaauggcuaucaguggugaugacuguguggucaaaccgauugaugaccgguucgccaccgcucuaacggcccugaaugauaugggcaaggugaggaaggacaucccucagugggagcccucuaaaggguggaacgauuggcagcaaguuccauuuugcagccaucacuuccaucagcucauaaugaaggacggacgcgaaauuguggucccuuguagaaaucaggaugaguuggugggccgggcaaggguaucccagggugcgggguggucacugcgagagacagccugccuuggaaaaaguuaugcucaaauguggcagcugauguacuuucaccguagagaccuccgcuuagccgcaaacgcuaucuguucugccguucccguggauugggucccaaccagccggacuacaugguccauccacgcacaucaccaguggaugaccacugaagacaugcugucaguguggaauaggguuuggauugaggaaaaccccuggauggagaauaagacccaugugagcucuugggaagaggucccuuauuugggcaaaagagaggaccaauggugcggcucccugauagggcucacagcccgcgcgacgugggcuaccaacauccagguggccauuaaucagguacggaggcuuaucggaaacgaaaauuaccuggauuacaugacuaguaugaagcgauucaagaacgagagcgacccagaaggugcacuaugguga

SEQ ID NO: 14074 - RNA, 9879 nt, Artificial Sequence
  derived and/or modified CDS sequence (opt3) from DENV-1__KP188544__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucgcacacacagaugugcgaccacaggcugaugagcgcggccauuaaggauuccaaagcugugcaugcagacaugggguauuggaucgaaucagagaagaaugaaacguggaagcucgcccgugcuaguuucauugagguuaaaaccuguaucuggccaaagucucacacucuguggagcaacggagugcuugaauccgagaugguaauacccaaaaucuacggcgguccuauuucacaacauaauuaucggccaggcuacuucacacagaccgccgggccguggcacuugggaaagcuggaguuagauuuugaccucugcgaaggcacuacagucgugguggaugagcacugcggguaccgaggacccagccugagaaccacgacugucaccggcaaaaucauucaugaaugguguugcaggucuuguacacuuccuccacugcgcuuccggggugaggacgggugcugguauggaauggagaucagacccguuaaggaaaaggaggaaaacuuggugagguccaugguaagugcaggcagcggugagguggacucuuuuucccucggcauacugugugucucaauucuaaucgaagaggugaugcgcagucgauggagccggaaaaugcugaugaccgggacucucgcgguuuuccugcuuuugaucaugggacagcugacauggaaugauuuaauucgucucugcaucauggugggcgccaacgcuucggacagaauggggaugggaaccacauaccuggcccuuauggcaacuuuuaagaugaggccuauguucgcugucggccugcuauuucgccggcucaccuguagagaggugcuguugcugacgguugguuuaucccucguggccucugucgaacugccaaauagccuugaggaacugggggauggauuggcaaugggcauuaugaugcucaaacugcuaacagacuuccaaccccaccagcuguggaccacucuucucucacugaccuuuauaaggacaaguuugucccuggauuaugccuggaagacuauggcuauggcguuaucuaucguaagccucuucccgcugugccuuuccaccacgucacagaaaacaaccuggcugccuguguugcucggcagcuuuggguguaagccacugacuauguuccuaauuacagagaacaagaucuggggacgaaaaaguuggcccauuaacgaagguaucauggccguuggcauagugucuauccugcuuuccagccuccugaagaaugacgucccuuuggcagggcccuuaauugcuggaggcaugcugaucgccugcuacgugauuucggguucaucugccgaucucagucuggagaaagcugcagagguauccugggaagaggaagccgagcauagcgggaccucucacaacauccuuguggaaguccaggacgauggaacuaugaagauaaaagacgaggagcgcgaugacacacugaccauuuugcuaaaggcgacgcugcucgcuguuagcggcguguauccaauguccaucccugccacucuguuugugugguacuucuggcaaaaaaagaagcagcggucaggcguccuuugggauacccccaguccaccggaaguggagagagcaguuuuagacgacgggaucuauaggauucugcagcguggacucuugggucgcagccagguaggcgugggggucuuccaagauggaguguuucauacaauguggcacguuacccggggcgccgugcugaugcaccaggguaaaagacucgaaccuucuugggcuuccgucaagaaagaccugauaucauacgggggaggcuggagguuccagggcaguuggaauacaggggaggaggugcagguaaucgcagucgaacccggaaagaacccaaaaaaugugcaaacuacccccgguacguuuaagacaccugagggcgaaguuggggccauugcgcuugauuucaagccaggaacuagcggcucccccaucgugaaccgagaggguaaaauugucgggcuguacggaaauggcgugguuaccacaucuggcaccuaugugucggcuaucgcccaggcaaaggccacucaggaagggccuuugccggagauagaggacgaagucuuuaaaaagcggaaccuaaccaucauggaucugcauccaggaagcgguaaaacacgcagauaccuccccgcuauugugagggaggccaucaagcggaaguuacgaacgcugauucuugcaccuacuagaguaguggcuucagaaauggccgaggcgcugaaaggcaugccaauccgcuaucaaaccacagccguuaaguccgaacacaccgggagggagauagucgaccucaugugucaugcaacuuucacaaugcguuugcugagucccgugcgggugccuaauuacaacaugauuaucauggaugaggcucacuuuaccgacccggccucuaucgcugcaagaggauauauuagcacgagggucggcaugggugaagccgccgcuaucuucaugacugcgacacccccaggguccguagaggcauuuccucagucaaaugccgugauacaggaugaagagcgcgacauucccgaacgaucuuggaacagcggauacgauuggaucaccgacuucccaggcaaaaccguuugguuugugccuaguauuaaguccggcaaugacaucgcuaacugccucagaaaaaaugggaagcgggucauacagcugagcaggaagacuuucgauacagaguaucaaaaaaccaagaacaacgacugggauuacgugguuacaacugacauuucugagaugggagccaauuuccgcgcagaucgugugaucgaccccagacggugccuuaaaccagucauccuaaaggaagguccggagagggugauucuggccggcccuaugcccguaacgguggcuucagcggcccagcgccgagggagaaucggacggaaccagaauaaagaaggcgaucaguacauuuauaugggucaaccauugaacaaugacgaggaucaugcacacuggaccgaggcuaagauguuacuggacaacauaaauacacccgaagggaucauuccugcccucuuugagccagaaagggagaaguccgcagccaucgauggcgaauaccgccugagaggagaggcuaggaaaacuuucguugagcuuaugcggcguggcgaccugcccgucuggcucaguuauaagguggccagcgaaggguuucaguacucggaucgccgaugguguuucgacggagagagaaacaaucagguguuggaagagaacauggacgucgaaaucuggaccaaagagggugagaggaagaaacugcggccucgcuggcuagaugcgagaacauauucugacccgcuggcacucagggaauuuaaggaguucgccgcuggccggcgauccguuagcggggaucuuauucuggaaauaggaaaauuaccacagcacuugacccugagagcccaaaaugcucucgacaaccuggugaugcuucauaauucagagcagggcgguaaggcauaccgccacgccauggaagagcugcccgauacuaucgagacgcucauguugcuggcuuuaauugccguacuaaccgggggcgugacacuguuuuuccucaguggaaagggccuugggaaaacuucuaucggacuguugugcgucauggcauccagcgcgcugcucuggauggccucaguggaaccucauuggauugcugccaguaucauacuggaguuuuuccuuaugguucuccugauccccgaaccagacaggcagcggaccccucaggauaaccaauuggcauauguggucauuggucuguuauuuaugauccuaacaguagcugccaaugagaugggccugcucgagaccacuaagaaagaccuugggauuggacacguggcaguugaaaaccaccaucacgccacaaugcuggauguggacuugcgucccgcuagcgcguggacgcuguacgccgucgcaaccacugugaucacaccaaugaugagacauaccauagagaacaccacagcuaauauuucccucacugccaucgccaaccaggcagcuauucugaugggccuugauaaggguuggccuaucucuaaaauggacauaggggucccguuacuggcccucggcuguuacagccaggugaaucccuugacgcugaccgcggcuguucuaaugcugguggcccacuaugcaaucauuggaccaggccuccaagccaaggcuacaagggaagcacagaagcgcacugccgcggggaucaugaaaaacccuaccguagauggaauugugacaaucgaccuugaccccgucguuuacgaugcuaaguucgagaaacagcugggccagauaauguugcugauucucugcaccucccaaauccuguuaaugcggacuacgugggcccuuugugaaucaaucacacuggcaaccgguccacucacuacccuaugggaggggucuccuggaaaguuuuggaauacaacuauugccgugaguauggcuaacaucuuccgaggcucguaucuggccggugcaggcuuggcuuucagccugaugaaaucccucgggggaggcagaagggggaccggagcccagggcgagacacuuggugaaaaguggaagcgccagcugaaucaguugucuaaaucagaguuuaacacguacaagaaaagcgggauaauggaagucgaccgguccgaggcgaaggaaggacugaaaagaggcgagaccacuaagcaugccgugagucgugguacagcaaagcucaggugguucguagagcggaauuuagugaaacccgaaggcaagguuauugaucuggggugcggacgcggcggguggucuuauuacugugcuggacuuaaaaaggugaccgaggucaaaggcuauacuaagggugggccgggacacgaagagccaaucccuauggccacauacggcuggaaccuggugaaacuacacagcggcaaggacgucuuuuucacccccccagaaaagugcgauacgcuccugugugacauuggggagucaucccccaauccuaccaucgaggaaggacgaacauugagagugcugaaaaugguugagccguggcucagggguaaccaauuuugcauaaagauccuuaaucccuacaugccaaguguaguggaaacucuggagcagaugcagcggaaacauggcgggauguuaguccgcaacccucugagcagaaauucuacccacgagauguauuggguguccuguggaacaggcaacauuguuucagcagugaauaugacuagcaggauguugcucaaccgauucaccauggcucaucggaagcccacauacgaacgugaugucgaccugggugccgggaccagacacguggccguagagccugaaguggcgaaccuagauaucauuggacagcgcaucgagaauauuaaaaacgaacacaagucgacuuggcaucacgacgaggauaauccauauaagacgugggcuuaccauggcucuuaugagguuaaacccaguggcuccgcaagcucaauggucaacgggguggugaggcuucugacaaagccuugggacgucaucccaaugguuacccaaauagccaugacugacaccacacccuuuggacagcagcggguguucaaagaaaagguagauacgagaaccccgcgcgcuaaaagggguacugcccaaauuauggaggugacagcaaaguggcucuggggcuuucugucccgaaauaagaaaccucggaucugcaccagagaagaguucacuaggaagguccgcucuaacgccgcuaucggggcgguguuuguugacgaaaaucaguggaacagcgccaaagaggcaguggaggaugaacguuucugggacuugguccaccgggagagagaacugcauaagcagggaaaaugcgcuacauguguguacaauaugaugggcaagagggagaagaaacucggugaauuugggaaggccaaaggaagucgcgcaauuugguauauguggcuuggcgcccgauuccuggaguucgaggcuuuaggcuuuaugaacgaagaucacugguucucccgggagaauagccugucugggguagaaggagaggguuugcacaagcucggcuacauacugagagacaucucaaaaauuccagggggaaacauguacgccgaugacaccgcgggcugggauacaaggaucacugaggacgaucuacagaaugaagcaaagauuaccgacaucauggagcccgaacaugcccuucuggcuacgaguauauuuaaacucaccuaucaaaacaagguugugcgcguccagagaccugccaaguccgguacagugauggaugugaucagccggagggaccagcgugggucuggacaggucggcacuuacggccugaauaccuucacaaacauggagguucaauugauucgacagauggaaucggaggggaucuuuucaccaagcgaguuagaaacucccaaccuggcaaaaaaggugcucgacuggcuugagaaacacggagcugaacgccugaagagaauggccauuuccggugaugacugcguagugaaaccgaucgaugaccgguucgcuaccgcccuaacggcacugaaugauaugggcaaggucaggaaggacauaccucagugggagcccaguaaaggguggaacgauuggcagcaagugccauuuuguucucaucacuuccaccagcucauuaugaaggacggacgcgaaaucguugugccuugcagaaaucaggaugaguuggucggccgggcgagggugagccagggugccggguggucccugcgagagacagcuugucuuggaaaaucauaugcccaaauguggcagcugauguacuuucaucguagagaccuccgcuuagcagcuaacgccaucugcagugcaguacccguugauugggugccaaccucucggacuacauggagcauucacgcccaucaccaguggaugaccacugaagacaugcuguccgucuggaauaggguguggauagaggaaaaccccuggauggaggacaagacccauguuucaagcugggaagaggugccuuauuugggcaaaagagaggaucaaugguguggcucucugaucgggcucacagcgcgcgcuacgugggccaccaauauucaggucgcaaucaaccaggugcggaggcuuauuggaaaugaaaacuaccuggacuauaugacuuccaugaagcgauucaagaaugagagugauccagaaggugcccuaugguga

SEQ ID NO: 14075 - RNA, 9879 nt, Artificial Sequence
  derived and/or modified CDS sequence (opt3) from DENV-1__KP188547__SS-prME
agcgugacaaugcugcucaugcuucugcccacagccuuggcuuuccacuuaacuacgagaggcggggagccucauaugaucgucuccaagcaggaaagaggaaaaucucugcuguuuaagacaucaguuggugugaacaugugcacacucauugccauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaauucuuagaaagcugugcaucgaagccaaaauauccaauacgaccacagacucuagguguccaacucaaggagaggcuaccuuggucgaggaacaggaugccaacuucguuugccggcgcacauuuguggaccgaggcugggguaauggguguggacucuucggcaagggcagccuguuaacuugcgcaaaguuuaaaugcguaaccaagcuggaggggaaaauugugcaguacgaaaaccucaaguauuccgucaucgugacaguucacaccggagaucagcaucaaguggguaaugagacuacggaacacggcacaauugcuaccaucacuccccaggccccuaccucagagauccagcuuacagacuacggggcgcugaccuuggacuguaguccaagaacuggacuagauuucaacgaaaugguccugcucacaaugaaagaaaagagcuggcuggugcauaaacagugguuucuugaccugccguugcccuggacgucuggcgccuccaccucacaagagacuuggaauaggcaggaucuccugguaacauucaagaccgcacacgcuaagaaacaggaaguuguggucuuagguagccaagagggggccaugcacacagcucugacuggcgccaccgaaauucagacgaguggaaccacaacuauauuugcaggccaucuaaagugccggcucaaaauggacaagcugacccuuaaagggaugucuuaugugauguguacaggauccuucaaguuggagaaggaagucgccgagacucagcacgguaccgugcugguucaggugaaauacgagggcacggaugcuccuugcaagaucccauuccucacacaagacgaaaaagggguaacccagaacggacgucugauuacugcgaaucccaucgucacagauaaggagaaaccugugaacauagaaaccgagccacccuuuggcgagagcuauauuguugugggugcaggggaaaaggcccuuaagcugucgugguucaaaaagggaucuuccaucggaaaaauguuugaggcuacugcccgcggcgcaagaaggauggccaucuugggggacaccgcuugggauuucggaucaauugguggccucuuuacaagugucgggaagcugauccaucagguguucggaacggccuacggcguauuauuuagcgguguguccuggaccaugaaaauugggauaggcauccugcuaacuuggcucggacuaaauucucggagcacaucacuuaguaugaccuguauugcaguuggcauggucacauuguaccugggggugauggugcaggcggacuccggaugcgucaucaacuggaagggccgagaacucaagugugguagcgggaucuucguuacuaacgaggugcacaccuggacggaacaauauaaauuucaggcugauucuccgaagcgccugucagccgcaauuggaaaagccugggaggagggcgugugcgguauaagaagugcuacaagguuagaaaauaucauguggaagcagauuagcaacgagcugaauuacauccuuuuggaaaacgacaugaaauucaccguagucgugggcgacguuaaugggauucucgcccagggaaagaaaaugaucaagccucaacccauggagcauaaguauuccuggaaaucuuggggcaaggcaaaaauaaucggggcugauauucagaacacuaccuuuaucauugacggaccagauacaccugaaugucccgacgaucagcgggccuggaauaucugggagguggaggacuacggcuucgguauauuuacuaccaacauuuggcugaagcuacgcgauucgcacacacagaugugcgaccacagacugaugagcgcggccaucaaagauuccaaggcuguccaugcagacaugggguauuggauugaaucagagaagaaugaaacguggaaacucgccagggcuaguuucaucgaggugaagaccuguauauggccaaaaucucacacucuguggagcaacggaguucuugaauccgagauggugauccccaagauuuacggcgguccuaucucacaacauaauuaucguccaggcuacuucacacagaccgccgggccguggcacuugggaaaacuggaguuagauuuugaccucugcgaaggcacuacaguagucguggaugagcacugcggguaccggggacccagccugcgaaccacgacugugaccggcaagauuauccaugaaugguguugcagaucuuguacacuuccuccacugagguuccgcggugaggacgggugcugguauggaauggagauacggcccgucaaggaaaaagaggaaaacuugguuagauccauggugagugcaggcagcggugagguagacucuuuuucccucggcauucugugugugucaauccuaaucgaagaggucaugaggagucgcuggagccgaaagaugcugaugaccgggacucucgcgguguuccugcuuuugauuaugggacagcugacauggaaugauuuaauccggcucugcauuaugguuggcgccaacgcucuggaccguauggggaugggaaccacauaccuugcccugauggcaacuuuuaaaaugagaccuauguucgcugugggccuacucuuuaggcgccugaccucgcgggaggucuugcuguuaacggugggucucucccugguugccucuguggaacuuccaagcucacuggaggaauugggggauggacucgcaaugggcauaaugaugcugaagcuacugacagacuuccaaccccaccagcuuuggaccacucuccugaguuugaccuuuaucagaacaucccugucuuuagauuaugccuggaaaacuauggcuauggcgcucagcauugucucccuguucccgcuuugucugucaaccacgagccagaagacaaccugguugccuguacuccugggcaguuuugggugcaagccacuaacuauguuccugaucacagagaauaaaauuuggggaaggaagucuuggcccaucaacgaagguauaauggccgugggcaucguuuccauucuucucagcucgcuguugaaaaacgacgugccuuuagcagggccccugaucgcuggaggcaugcucauugccuguuacgucaucucagguucuagugccgaucugucccuugagaaggcugcagaggugagcugggaagaggaagccgagcauucugggaccagccacaauauacugguagaagugcaggacgauggaacuaugaaaauuaaggacgaggagcgagaugacacauugaccauccuacugaaagcgacgcuccuggcugucuccggcguuuauccaaugucaaucccugccacucuuuuugugugguacuucuggcaaaagaagaaacagcgcaguggcguguuaugggauacccccagcccaccggaagucgagcgggcagugcuggacgacgggauuuauagaauacuccagaggggauugcugggucguucucagguuggcguagggguguuccaagauggagucuuucauacaauguggcacgugacccgcggcgccguucucauguaccaggguaagcggcuggaaccuuccugggcuucagugaaaaaggaccuuaucaguuacgggggaggcuggagauuccagggcagcuggaacacaggggaggagguccaggugauugcaguagaacccggcaagaauccaaagaacguccaaacuacccccgguacguuuaagacaccugagggcgaagugggggccaucgcgcuggauuucaaaccaggaacuuccggcucucccauuguuaauagggaggguaagaucgugggguuguauggaaacggcgucgugaccacaucgggcaccuacguuagcgcuauagcccaggcaaaagccacucaggaagggacccuaccugagaucgaggacgaaguguuuaagaaacgaaaucugacaauuauggaucuccacccgggaucagguaagacgcggcgcuauuuaccagcuaucgucagagaggccauuaagaggaaacugcggacucuuauccuggcacccacccgagugguagcuuccgaaauggccgaggcgcucaagggcaugccuauaagauaccaaacaaccgccgugaaaagugaacauacugggcgcgagauuguugacuugaugugccacgcaacauucaccaugaggcugcucucuccaguccgugugcccaacuauaauaugaucaucauggaugaggcucauuuuacggacccugccagcauugcugcacggggauacaucuccacuagagugggcaugggugaagccgccgcuauauucaugacagcgaccccgcccgggucagucgaggcauuuccacagucuaacgccguaauucaggaugaagagagggacaucccugaacgcagcuggaauaguggauaugauuggauuaccgacuuccccggcaagacugugugguuuguuccauccaucaaaagcggcaacgacauagcuaauugucugcgaaagaacgggaagagagugauucagcuuucucggaaaacauucgauaccgaguaccaaaagaccaaaaauaacgacugggauuacgucgugacuacggacaucucagagaugggagccaacuucagggcagaucgcguuaucgacccucguagaugccuaaagcccgugauucugaaagaagguccagagcgggucaucuuggccggcccgaugccugugaccguagcuuccgcggcccagaggcgcgggcgaauuggaagaaaucagaacaaggaaggcgaucaguauauauacaugggucaacccuuaaauaacgacgaggaucacgcacauuggacagaggcuaagaugcugcucgacaauaucaacacuccagaagggauuauccccgcccuguuugagccugaacgggagaaaagugcagccaucgauggcgaauauaggcuucgcggagaggcuagaaagaccuucguggagcugaugaggcggggcgaccucccaguuugguugagcuacaaagucgccucggaaggguuucaguauucugaucgucgcuggugcuucgacggagagcgaaauaaccaggugcuggaagagaauauggacguggaaauuuggacaaaggagggugagaggaaaaagcuaaggccccgguggcuggaugcgcgcaccuacuccgacccucucgcacuuagagaauuuaaagaguucgccgcuggcaggcggagcgucucaggggaucugauauuagaaaucggaaaguugccgcagcaccugacucuccgagcccaaaacgcucuggacaaucuuguuaugcugcacaacagugagcagggcgguaaggcauauagacaugccauggaggaacucccagauacgauugagaccuugaugcuguuagcucuaaucgccgugcugacagggggcguaacucucuuuuuccuuucuggaaaaggccuggggaagaccuccauuggauugcugugugugauggcaagcucagcgcuccuguggauggccagugucgaaccccacuggaucgcugccagcauaauccuugaguuuuuccucauggugcuguugauuccugaacccgaccgccagaggacaccacaggauaaucaacuggcauacguugugaucgguuuacuauuuaugauucugaccgucgcugccaacgagaugggccuccuugagacuaccaaaaaggaccuggggaucggacauguagcaguggaaaaucaccaccaugccacgauguuggauguugaccugcggccugcuuccgcguggacccucuacgccguggcaacuacagucauaacccccaugaugcgucacaccauugagaacacaacugcuaacaucucucugacggccauugccaaucaggcagcuauccuuaugggcuuagauaaagguuggccaauaagcaagauggacaucggggugccucugcucgccuugggcugcuauucccaggucaacccgcugacccuaacagcggcugugcugaugcucguugcccauuacgcaauuaucggacccggccuucaagccaaggcuacuagagaagcacagaaaaggaccgccgcggggauuaugaagaauccaacaguggauggaaucguaaccauagaccuggacccuguggucuaugaugcuaaauucgagaagcaguugggccagauuaugcugcucauccuguguacuucacaaaucuuacuuaugcgcacgacaugggcccugugcgaaucuauuacccucgcaacugguccccuaaccacacugugggaggggaguccaggaaaauuuuggaacacuaccaucgccguuucgauggcuaauauauuccggggcagcuacuuggccggugcaggccuggcuuucucccucaugaagucucuugggggaggccgaagagggacaggagcccagggcgagacgcugggugaaaaguggaaaaggcaguugaaccagcugucaaagagcgaguuuaauaccuauaaaaaguccgggauuauggaaguggaccgcagugaggcgaaagaaggacucaagcggggcgagacuacaaagcacgccgucucuagagguaccgcaaaauuacguugguucguggagaggaaccugguaaagccugaaggcaaagugaucgaucuuggguguggacggggcggguggagcuacuauugcgcuggacugaagaaaguuacugaggugaagggcuacacaaaaggugggcccggacaugaggagccgauuccaauggccaccuacggcuggaaucuagucaagcuccacucaggcaaggacguguuuuucacgccucccgaaaaaugugauacccuguugugcgacaucggggaguccaguccaaaccccacaauagaggaaggacgcacucugcgaguccucaagaugguggagccuuggcuuagagguaaucaauuuuguaucaaaauucugaacccguauaugcccagcguuguagaaaccuuagagcagaugcagaggaagcacggcgggaugcuggugcggaauccauugucucgcaacuccacacaugagauguacugggucucaugcggaacuggcaauaucgugagcgcaguuaacaugaccucgagaaugcuccugaauagguucacaauggcucaccgaaaaccuaccuaugaacgggauguggaccuaggugccgggacucgucaugucgccguggagcccgaaguagcgaaccuugauauuaucggacagagaauugagaacaucaagaaugaacacaagucuacguggcacuacgacgaggauaacccuuauaaaacaugggcuuaccauggcaguuaugaggugaagccauccggcagcgcaucauccaugguuaauggggucgugcgccugcucaccaaacccugggacgugauaccuauggucacucaaauugccaugaccgacacaacgccauuuggacagcagaggguuuucaaggaaaaaguggauacccggacucccagagcuaagcgcgguacagcccaaaucauggagguaaccgcaaaguggcuguggggcuuuuugucuaggaacaaaaagccgcgaaucuguacucgggaagaguucacaagaaaagugaggagcaaugccgcuauuggggcggucuuuguggacgaaaaccaguggaauagugccaaggaggcaguugaggaugaacgcuucugggaccuggugcaccgugagcgggaacuccauaaacagggaaagugcgcuaccugcgucuacaacaugaugggcaagagagagaagaaacuuggugaauuugggaaagccaaaggauccagggcaauaugguacauguggcugggcgcccgcuucuuagaguucgaggcucugggcuuuaugaaugaagaucacugguucagccgagagaacucuuugucagggguggaaggagagggucuccauaaacugggcuauauccuacgggacauuaguaagaucccugggggaaauauguacgccgaugacacagcgggcugggauacuagaauuaccgaggacgaucuucagaacgaagcaaaaaucacggacauaauggagccagaacacgcccugcucgcuaccuccaucuuuaagcugacauaucaaaauaagguaguuagggugcagcgccccgccaaaagcgguacugucauggaugugauuucuagacgggaccagagggggucgggacaggugggcaccuacggcuugaacacauucacuaauauggagguccaauuaauccgucagauggaaucagaggggauuuuuagcccuuccgagcuggaaaccccaaaccucgcaaagaaaguucuugacuggcuggagaagcacggagcugaacgacuaaaacgcauggccaucaguggugaugacugugugguaaagcccauagaugacagauucgcuacggcccugacagcacucaacgauaugggcaaggugcggaaagacauuccgcagugggagccuucuaagggguggaaugauuggcagcaaguccccuuuugcagccaucacuuccaucaguugaucaugaaagacggaagggaaaucgugguuccaugucgcaaccaggaugagcuggugggcagagcgcgggucucccagggugccggguggucacuuagggagaccgcuugccugggaaagaguuaugcccaaauguggcagcucauguacuuucaccgacgugacuuaagacuggcagcuaaugccauuuguucugcagugccuguagauuggguucccacuagccgcacaaccugguccauacacgcccaucaccaguggaugacuaccgaagacauguugucaguguggaaccgggucuggaucgaggaaaauccauggauggaggacaaaacacaugugagcucuugggaagagguucccuaucugggcaagagggaggaucaauggugcggcucccucauugggcuuacggcgagagcuaccugggccacuaacauccagguggcaauuaaucagguccgccggcugaucggaaacgaaaauuaccuagacuacaugacaaguaugaagagguucaaaaacgagagcgauccugaaggugcccugugguga

SEQ ID NO: 14076 - RNA, 9879 nt, Artificial Sequence
  derived and/or modified CDS sequence (opt3) from DENV-1__KP723473__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaagcuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguuuuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacuagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcaaaaaaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagagcgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacaaaaaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagugugauucacgcuggcucgacgcaagaaccuauagugaucccuuggcccugagggaguuuaaagaauucgcugccggccggcgaucuguuuccggggaccuaauccuggagauuggaaagcucccucagcaccuuacucugagagcucaaaaugcauuagauaacuuggugaugcugcacaauagcgaacagggcgguaaagccuaccgccaugcuauggaggaacucccggacacgauagagacccugaugcuucuggcccucaucgcaguauugacagggggcgugacucuguuuuucuuaucaggaaagggccuagggaagaccaguauuggacugcucugcgucauggcgagcuccgugcuucuguggauggccucuguugagccacacuggaucgcugccagcauuaucuuggaauuuuuccugauggugcuccugauacccgagccugauaggcagcggacaccccaggacaaccaacuugcauaugucguaaucggucuccuguuuaugauuuugaccguggcugccaacgaaaugggccuguuagagacuacaaaaaaggaucuagggaucggacauguuguggcagagaaucaccaccaugccacgaugcuggacauugaucuccacccagcuuccgcguggacccuuuacgccgucgcaacuacaaucauaaccccuaugaugcgucauaccauugaaaacacaacugcuaauaucucacugacggccauugccaaccaggcagcuaucuugaugggccuggacaaagguuggcccauaucuaagauggauaucggggugccacuccuggcccuuggcuguuacagucaggucaauccuuuaacccugacagcggcugugcucauguugguugcccacuaugcaauuaucggaccgggccugcaagccaaagcuacuagagaggcacagaagaggaccgccgcggggauuaugaagaaccccacaguggacggaaucguagcuauagaccuagauccaguggucuacgacgccaaauucgaaaagcagcugggccagauuaugcuccuuauccugugcaccucgcaaaucuugcugaugcgcacuacgugggcacucugugagagcauuacacuggccaccgguccuuuaacuacccuuugggaagggucccccggaaaauuuuggaauacaacuaucgcuguuucuauggccaacauauuccggggcucauaucuggcaggugcuggccucgccuucagccuaaugaagucccuggggggaggccgaagagggaccggagcgcagggcgagacauugggugagaaauggaagaggcagcugaaucagcucaguaagucugaauuuaacacguacaaacgcagcgggauuauggagguggaucggucagaagccaaggagggacuuaaaagaggcgaaaccacuaagcaugcagucucccgugguacagcuaaacugaggugguucguggagcggaauuugguaaagccagagggcaaggugaucgaccuggggugcggacgcggcggguggaguuauuacugugccggacucaaaaagguuaccgaagugaaaggcuauacuaagggugggccuggacacgaggaacccauuccgauggcaacauacggcuggaacaucgucaaauuacacagcggccgagauguguuuuucaccccaccugagaagugcgacacgcugcuuugugauauaggggaaucuucccccaauccaaccaucgaggagggaagaacacugaggguccuaaaaaugguggaacccuggcuccgggguauucaauuuugcaucaagauucugaacccuuacaugccgucaguuguagagacuuuggaacagaugcagcgcaagcauggcgggaugcuggugagaaauccccucagcaggaacucgacccacgagauguauugggucucuuguggaacaggcaauaucgugagugcuguuaacaugacuucccgaaugcuucugaaccgguucaccauggcccaucguaaaccaacauacgagagagacguggauuuaggugccgggacccgccacgucgcgguggaaccugagauugcuaaucuggacaucauaggacagaggauugaaaacaucaagaaugagcacaaaagcacuuggcauuaugaugaagacaaccccuacaagacgugggcauaucacggcucauacgagguaaaaccuuccggcacagccucuagcauggugaaugggguuguccgguugcucaccaagccaugggacgugauccccauggugacucaaauugcuaugaccgauacaacgccuuuuggacagcagagagucuucaaggagaaaguugacacccgcacuccaaggcccaagcgagguacagcccaaauaauggaagugaccgcaaaauggcuguggggcuuucuaagucggaacaagaaaccgagaaucugcacuagggaggaauucacacgcaagguacguuccaaugccgcuauuggggcgguguuugucgaugagaaccaguggaauagcgccaaggaagcaguggaggacgagcgguucugggaucuuguucauagagaaagggagcugcacaaacagggaaagugcgcuaccuguguguauaacaugaugggcaaacgcgaaaagaaacucggugaguuugggaaggccaagggaucucgagcaaucugguacauguggcugggcgcccgguucuuggaauucgaggcucugggcuuuaugaaugaggaccauugguucucaagagaaaacagucucuccggggucgagggagaaggucuucacaaacugggcuacauuuuaagggauaucagcaagauaccugggggaaauauguaugccgacgauacagcgggcugggacacucgcaucaccgaggaugaccugcagaacgaggcaaaaauuacggauaucauggaaccagagcacgccuugcucgcuaccucuauuuuuaagcugacauaccaaaauaaagugguaagaguucagcggcccgccaagucggguacugugauggacgucaucucaaggcgugaccagcgagggagcggacaggugggcaccuauggccuaaacacauucacuaacauggaagugcaacuuauacgccagauggaguccgaagggauuuuuaguccuucugagcuggagaauagcaaccucgcagaaagaguccuggauugguuggagaaacauggaguugaacgguuaaagaggauggcuaucuccggugacgauugcgugguaaagccaaccgacgaucgcuucgccacggcucugacagcccucaaugacaugggcaaagugagaaaggauaucccccagugggagccgucaaaaggguggaacgacuggcagcaagucccuuuuuguagucaccauuuccaccagcuuauuaugaaggauggacgggaaauagugguucccugcaggaaucaggacgagcuggugggccgagcacgugucucucagggugcgggguggagccuaagagagaccgccugucugggaaaauccuacgcucaaauguggcagcucauguauuuucaccgccgggauuugaggcuggccgcaaacgcuaucugcucagccgugccaguaaauuggguuccuacuagcagaacaaccuggucuauucaugcacaccaucaguggaugacuaccgaagacaugcuuuccguguggaaccgcgucuggaucgaggaaaaucccuggauggaggacaagacacacgugaguagcugggaagauguuccauaccugggcaagcgggaggaccaaugguguggcucgcucauuggguuaacggccagggcgaccugggcuacuaacauccagguggccauaaaucagguccgaagacugaucggaaacgagaauuauuuggauuacaugacauccaugaaacgguucaagaacgaaucugaccccgagggugcacugugguga

SEQ ID NO: 14077 - RNA, 9879 nt, Artificial Sequence
  derived and/or modified CDS sequence (opt3) from DENV-1__KT187564__SS-prME
agcgugacaaugcugcucaugcuuaugcccacagcacuggcuuuccacuugacuacgagaggaggggagccucauaugauggucuccaagcaggaaaggggaaaaucuuuacuguuuaagacaucagccgguguuaacaugugcacacugaucgccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauacagaggguggaaacuugggcucuccggcacccuggauucaccguuaucgcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacuacucaagacagaggugaccaacccugccgugcugaggaaacuuugcaucgaagcuaagauuucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaucacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaagggcaaaucuuggcuggugcauaagcagugguuucucgaucugccgcuucccuggaccuccggugcaucaacuagccaagagacauggaaucggcaggaccuguugguaaccuucaaaacagcucacgccaagaagcaggagguugugguccucgggagucaagaaggcgcuaugcacacugcccugaccggagcaacggagauccagaccucuggcacaacuaccaucuuugccgggcauuuaaaaugccgucugaagauggauaaacuaacacucaagggaauguccuaugugauguguacugguagcuucaaacuggaaaaggaggucgcugaaacccagcacggcacggugcuuguucagauuaaguacgaggggacagacgcgccuugcaaaauaccauucucgacccaagaugagaagggagugacucagaacggccgcuugaucacagcaaaucccauuguaaccgacaaagaaaagccugucaacaucgaggccgaaccacccuuuggugagucuuauauagugauuggggcuggcgagaaagcccugaagcucuccugguucaagaaaggaucaaguaucggcaagauguuugaagcaacugccagaggggcuaggcggauggccauccugggagauaccgcaugggacuucgguagcauuggcgggguuuuuacauccgugggaaaacuuguccaucagaucuucggcacggcguacggugugcuguuuucugggguaagcuggaccaugaagauuggcauaggaguguugcucacuuggcugggcuuaaauucacgaaguacaucccugagcaugaccuguaucgcuguugggcuagucacacucuaccugggagugauggugcaggccgauucuggcugcgucauuaacuggaaaggucgcgagcuuaagugugggucaggaaucuucguuacuaaugaagugcacaccuggacggagcaauauaaguuucaggcagacaguccgaaaagauugagcgccgcuaucggcaaggccugggaagagggugugugcggcauuagguccgcaacacggcuggagaacauaauguggaaacagaucucuaacgaacucaaucauauucuguuagagaacgacaugaaguucaccguagucgugggggauguugcuggaauccuggcccagggcaaaaagaugauucgcccucaacccauggaauacaaauauucguggaaaagcugggggaaggcgaagaucauaggagccgacgugcagaauacuaccuuuaucauugauggcccaaacacaccugagugucccgacgaucagagagcuuggaauaucugggaagucgaggacuacgguuucgggauuuuuacuaccaacaucuggcuuaaguugagggauuccuauacacaggugugcgaccaccgucucaugucagcagccauaaaagauaguaaggcuguucacgccgacaugggauacuggauugagucugagaagaaugagacguggaagcuggcacgggcgagcuucaucgaagugaagaccuguauuuggccaaaaucccauacucuauggucaaacggcguacuggagagcgaaaugaucauacccaagaucuaugguggcccuauuucucaacacaauuaccgaccaggguacuucacacagaccgccggaccguggcaucucggcaaacuggagcuugauuuugacuugugcgaggggacuacagucgugguggaugaacacugcggaaacagaggccccucccugaggaccacgacugucaccgguaagaucauucacgagugguguugccgcaguuguacauuaccuccacuccgguucagaggggaagacggaugcugguauggcauggagaucaggcccguuaaagagaaggaagagaaucuggugaagucgaugguaucugcugguuccggcgaaguggacucauuuagucuugggcuguuguguauaagcauuaugaucgaggaagucaugcgcucgcgauggucccggaaaaugcucaugaucggaacccuggccguguucuuucuacugauuaugggccagcucacuuggaacgaucugauccgucuuugcauuaugguuggggcaaaugcuucugacagaaugggaaugggcacaaccuacuuggcccugauggcaacauucaagaugaggccuauguuugccguggguuuacucuuccgccggcugacuagcagagagguccuucugcuaaccauagggcucucacugguggcuagugcggaguugccaaacucccuggaagaguuaggagauggccucgccaugggcaucaugauucugaaacuucugacggacuuucaaucucaucaguugugggcaacacuccugagccuaaccuucaucaagacuaccuuuucccugcacuaugcuuggaaaacaauggccaugguucuuucaauugugagccucuucccccuguguuugaguacuaccucucagaagacgacauggcugccggucuuacucgggucccugggaugcaagccucuuaccauguuucugaucgccgaaaauaaaauaugggguagaaaguccuggccauugaacgagggcaucauggcuguagggauugugucgauccuccugucaucucuacugaaaaacgauguuccccuugcaggaccucucauugccggcgguaugcugaucgcguguuacgugauaaguggguccagcgcugacuugucuuuagaaaaggccgcagaggucagcugggaggaagaggccgaacauuccggagcuucacacaauauucugguggagguacaggaugacggcacuaugaaaaucaaggaugaagaacgagacgauacacucaccauccugcuuaaagcaacucuguuggccgugaguggcgucuucccccuaagcauuccagcgacacuguucguuugguauuuuuggcaaaagaagaaacagcgcucuggggugcucugggacaccccuucacccccagagguggaacgggcuguccuggaugacggaauauacagaaucaugcagaggggucuuuuaggccguagccagguggggguuggaguauuccaagagaacguguuucauacgauguggcacgucacucgcggcgccgugcugauguaucaggguaagcggcucgaaccgaguugggcaagcguuaaaaaggacuugauuuccuacgggggaggcuggagacugcagggcucuuggaauaccggggaggaggugcaggucaucgccguggaaccuggcaaaaaucccaagaauguacaaacagcuccagguaccuucaagacacccgagggcgaagucggggccauugcacucgauuuuaaaccuggaacuucgggcagcccaaucgugaacagggaggguaagauaguugggcuguacggaaauggcguggucaccacgucaggcacauauguguccgcuaucgcccaggcgaaagccagucaggaagggccccuuccugagauugaggacgaaguuuuccgaaagcggaaccugacuaucauggauuugcacccgggaucugguaaaacccgcagauaccuaccagcaauugugagggaggcuaucaagcggaagcugcgaacacucauauuagcccccaccagagucguggcuagcgaaauggcagaggcccugaaaggcaugccuauucgcuaucaaacuaccgccguaaaguccgaacauacagggaaagagaucguggaccuuaugugccacgcuacguuuacuaugaggcugcucucaccaguucguguccccaauuacaacaugaucauuauggaugaggcgcauuucaccgacccuucuagcaucgcagcccggggauauauaaguacaagagugggcaugggugaagcugccgcaauuuuuaugaccgccacuccgcccggguccguggaggcuuucccacagagcaaugcggucauccaggaugaagagagggacauuccugaacgcucuuggaacucaggauacgaguggaucacagauuuucccggcaagaccguaugguucgugccauccauaaaaaguggcaaugacauugccaacuguuugcgaaagaaugggaagagaguuauccagcugagccggaaaacguucgauacugaguaucaaaagaccaaaaacaacgacugggacuacguggucaccaccgauaucucggaaaugggagcaaauuuuagggcugaccgcgugauugauccucguagaugccucaagcccguuauccugaaagacgguccagagcgggugauucuugccggcccgaugccugucacuguggcaucugccgcucagaggcgcgggcgaauaggaagaaaccacaauaaggaaggcgaucaguacaucuauaugggucagccccuaaacaaugacgaggaucaugcccacuggacagaggcgaagaugcuguuggacaacauuaauaccccagaagggaucauccccgcauuauucgagccugaacgggagaaauccgccgcuauugauggcgaauacaggcugcgcggagaggccagaaagacauuuguagagcucaugaggcggggcgaccugccaguguggcuuagcuauaaaguugcuucagaaggguuccaauacagugaucgucgcuggugcuuugacggagagcgaaacaaucagguccuggaagagaacauggauguggaaauauggacuaaggagggugagaggaaaaagcucaggccccggugguuggacgcacgcacguauucugacccucuggcccuaagagaguucaaagaguuugcugccggcaggcgguccgugagcggggaucugauccucgaaauuggaaaacuuccgcagcaccugacccagcgagcacaaaaugcguuagacaacuuggucaugcugcauaauucagagcagggcgguagagccuaccgccacgcuauggaagaacucccagauacaaucgagacucugaugcuucuggcccucauugcaguuuugaccgggggcgugacacuguucuuuuuaaguggaaggggccuagggaagaccagcaucggacugcucuguguaauggcuuccucugugcuucuguggauggccagcgucgaaccccauuggauagcagccuccaucauuuuggaguucuuucugauggugcuccugaucccugaacccgaccggcagcguacuccacaggauaaccaacuugcuuauguugugauuggucuccuguucaugaucuugacggucgcggccaaugagaugggccuguuagagaccaccaaaaaggaccuagggauaggacacguagcaguggaaaaccaccaucacgcugccaugcuggauguugaccuccauccugccucagcauggacucuuuacgcuguggccaccacaauuaucacccccaugaugagacacacuauugagaacacaacggcgaauaucucucugaccgcuauagccaaccaggcagccaucuugaugggccuggauaaagguuggccaauuaguaagauggacaucggggucccucuccuggcucuuggcugcuacagccaggugaauccguuaacucugacagcagccguccucauguugguggcgcauuaugcuauuaucggacccggccugcaagccaaagcaaccagggaagcccagaagcgcaccgcugccgggauaaugaagaacccaacaguugauggaauuguggcaaucgaccuagauccuguaguguacgacgcuaaauuugagaagcagcugggccagaucaugcuccuuauucuguguacuagccaaaucuugcugaugcggacgaccugggcccucugcgaauccauaacacuggcgacuggucccuuaaccacacuuugggaggggucuccaggaaaauucuggaauaccacuauugccgucucaauggcaaacaucuuccgaggcagcuaucuggcuggugccggccucgcauuuucccuaaugaagagucuagggggaggcagaagggggacgggagcucagggcgagacauugggugaaaaauggaagcgccggcugaaucagcucucuaagagcgaguucaacaccuacaaaagaucagggauuauggaaguugaccguuccgaggccaaggaaggacuuaaaaggggcgagacuaccaagcacgccgugagucgggguacagcgaaacugcgcugguuugucgagcgaaauuuggugaagccugaaggcaagguaaucgaucugggguguggaagaggcggguggagcuauuacugcgcuggacucaaaaaggugacugagguuaaaggcuauaccaagggugggcccggacacgaggaaccgauaccaauggcaacauacggcuggaacuuagugaaacugcauucuggcaaggacgucuucuuuaucccucccgaaaaaugugauacgcuucugugcgacauuggggaguccucaccaaaucccaccaucgaggaaggaaggacucuacgggugcucaagauggucgagccuuggcugcgcgguaaccaguucuguauuaagaucuugaauccguacaugcccagcgugguugaaacacuggagcaaaugcagagaaaacacggcgggaugcucguaaggaacccacuuucgcgaaauucuacccaugagauguauugggugaguugcggaacuggcaacauugucuccgccgugaauaugacaagccggaugcuguuaaaccguuuuaccauggcucacagaaagccuacguacgaacgcgauguugaccugggugccgggaccaggcacguggcagucgagcccgaaguggccaacuuggauaucauaggacagcggauugagaauaucaaacaugaacacaagucaacauggcauuaugacgaggauaacccuuacaaaacuugggcuuaucacggcuccuacgagguaaagccaucuggcagcgcgaguuccauggugaaugggguugucaagcuccugaccaaacccugggacgugaucccuauggugacacagauugccaugacugauaccacaccauucggacaacagagagucuuuaaggaaaaaguugacacccgcacucccaaggcaaaaagggguacggcucagauaauggaggugacagcccgauggcuauggggcuuccuuagccggaacaagaagccgagaaucuguaccagggaagaguuuacucgcaaaguacguucuaaugcagccauuggggcuguguucaucgacgaaaaccaauggaacucagccaaggaggcggucgaggaugaacgguuuugggaccuggugcauagagagagggaacuccacaaacagggaaagugcgcaaccugcguuuauaacaugaugggcaaacgcgagaagaagcugggugaguucgggaaagccaagggaagucgagcuauuugguacaugugguugggcgcccgguuccuggaguuugaggcacucggcuucaugaaugaagaucacugguuuuccagagagaacagccuuucugggguggaaggagagggucugcauaaauuaggcuacauccugagggacauaucgaagaucccugggggaaauauguaugcugaugacacagccggcugggauacgcgcauuaccgaggacgauuugcagaacgaagcuaaaaucacugacauuauggagccagaacacgcccuccuggcaaaggcgaucuucaaacuaacauaccagaauaaggucgugagaguacaacggcccgccaagaacgguaccguuauggaugugauaucaaggcgugaccagcgagggagcggacaggucggcacuuauggccuuaauacauuuaccaacauggaggcucagcugauucgccaaauggaauccgaggggaucuucaguccuucugagcucgaaacaccaaaccuggccgagagaguguuggauugguuaggaaaauacgguguggaacggcugaagaggauggcaaucagcggcgacgacugugucguuaaacccauugaugaccgcuuugcuacugcccucaccgcacuuaaugauauggggaaggugagaaaagacauaccgcagugggagccuuccaagggauggaacgauuggcagcagguacccuucugcucacaucacuuucaccaacugaucaugaaggacggccgggaaauuguggucccauguaggaaucaggaugagcuagugggucgagcccguguuagucagggggcgggauggucucugagagagacggcuugccucggcaaaagcuaugcccagauguggcaauugauguacuuccaucgccgggaccugaggcuugcagccaacgcuaucuguuccgccgugccugucgauugggugcccaccucaagaacaacuuggagcauucacgcacaucaccaguggaugaccacagaagacaugcugucuguauggaaucgcguuuggaucgaggaaaacccauggauggaggauaagacucauauauccaauugggaagacgugcccuaucucggcaaacgggaggaccaguggugcgggaguuuaaucggacugaccgcuagggccacgugggcgacaaacauucaagucgcuaucaaucaggugcgaagauugauugguaacgagaauuaccuggauuacaugaccagcaugaagcgguuuaaaaacgaaucggacccugagggcgcccucugguga

SEQ ID NO: 14078 - RNA, 9879 nt, Artificial Sequence
  derived and/or modified CDS sequence (opt3) from DENV-1__KT187560__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaagcuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguuuuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacuagucagaagacaaccuggcucccgguucugcuuggcucucuggggugcaaaccuuugacuauguuucucauuacagagaauaagaucuggggacgcaaguccuggccacugaacgaagguauuauggcggugggcaucgucagcauacuacugucgucacuucucaaaaaugaugugccccuggccgggccuuugaucgcaggaggcauguuaauugcuuguuauguaaucucugguaguuccgccgaccugagccucgagcgggccgcugaggugucuugggaagaggaagcagagcauagcggggccucccacaacauucuggucgaaguucaggaugacggaaccaugaagaucaaagaugaggagagagacgauacgcuuacuauacuguugaaggcgacccuacuggcugugucaggcguguaccccaugaguauuccagccacacucuucgucugguauuuuuggcaaaaaaagaaacagaggagcggcgugcugugggacaccccuucucccccagaaguugagcgugcaguacuugaugacgggaucuaccgcaucuuacagcggggacugcucgguagaucccaggugggcgucgggguguuccaagacggaguuuuccauacaauguggcacgugacuaggggcgccgucuugauguaucaggguaagcgacuggaaccgucaugggcuagugugaagaaagaucucauuagcuacgggggaggcuggcgguuucagggcuccuggaauaccggggaggagguacaggucauagcaguggaaccuggaaagaaccccaaaaauguucaaacgacaccagguacuuucaagacccccgagggcgaagugggggccaucgcgcuggacuuuaaaccuggaacaucuggcucgccaauugucaaccgcgaggguaagaucguggggcuuuacggaaauggcguugugaccacuagcggcaccuaugucucagcuauugcccaggcaaaggccucccaggaagggccccugccugagaucgaggaugaaguguucaaaaagagaaacuugacaauaauggaccuacacccgggaagugguaaaacgaggcgguaccugccagcuaucguacgagaggccauuaagagaaaacuccgcacuuuaauccuggcacccaccagggugguugcuucugaaauggccgaggcgcuuaagggcaugccuauucguuaucaaacaaccgccgucaagagcgaacauacugggaaagagaucguggaucugaugugccacgcaacauuuaccaugcggcucuuguccccagugagaguccccaauuacaacaugauaauuauggacgaggcucauuucacggauccugccucaaucgcugcaaggggauauaucucuacucgcguaggcaugggugaagccgccgcuauuuuuaugacagcgaccccgcccgggagcguggaggcauucccacagaguaaugccguuauccaggacgaagagcgagauauaccugaaagauccuggaacagcggauacgacuggauuaccgauuuucccggcaagacugugugguucgucccaucuaucaaaucaggcaaugacauugcuaacugucugcggaagaacgggaaaagggugauccagcucucccgcaagacauuugacaccgaguaucaaaagacaaaaaauaacgauugggacuacguugugacuacggauauaagugagaugggagccaauuuccgugcagacagagucauugauccucggaggugccugaagcccgugauccuuaaagacgguccagaacgcguaauccuagccggcccgaugccugugaccgcugcgagcgccgcacagcgaagagggcggauuggaaggaaccagaauaaggagggcgaucaguacaucuauaugggucaaccccugaacaaugacgaagaucacgcucauuggacagaggccaaaauguuguuagacaacauuaauacuccagaggggauaauccccgcacuguucgaaccugagcgcgaaaagucggccgcuauugauggcgaguacagacucaggggagaagcccggaagaccuuuguugagcugaugcgucgcggcgaccuuccagucuggcugucuuauaaaguggcguccgagggguuccaguacagcgaucgaagauggugcuuugacggagaaaggaacaaucaggugcucgaggaaaacauggacgucgagaucuggacaaaggaaggugagcggaaaaaguugcgccccagauggcuggaugcaaggaccuauucagacccucuagcccugcgggaguucaaagaauuugcugccggccgaagaaguguuucuggggaucucauccuugagauuggaaagcugccgcagcacuuaacuuugcgcgcucaaaaugcacuggacaaccucgugaugcugcacaauuccgaacagggcgguaaagccuacaggcaugcuauggaggaacuuccagauacgauagagacccugaugcucuuggcccugaucgcaguauuaacagggggcgugacucuauucuuucugagcggaaagggccucgggaagaccucaauuggacuucugugugucauggcgaguagcguguugcuguggauggccuccguugagccccacuggaucgcugccucuauuauccucgaauucuuucugauggugcuucucauaccugagcccgaccggcagcguacaccacaggauaaccaacuggcauaugucguaaucgguuugcuguucaugauuuuaaccguggcugccaacgaaaugggccuacuggagacuacaaaaaaggaccucgggaucggacauguuguggcagagaaucaccaccaugccacgaugcuugauauugaccugcacccugcuagcgcguggaccuuguacgccgucgcaacuacaaucauaacccccaugaugagacauaccauugaaaacacaacugcuaauaucucccugacggccauugccaaccaggcagcuauccucaugggccuggauaaagguuggccaauaucaaagauggacaucggggugccucuuuuagcccugggcugcuacucucaggucaauccgcucaccuugacagcggcugugcugaugcuaguugcccacuaugcaauuaucggacccggccugcaagccaaagcuacuagggaggcacagaagcgcaccgccgcggggauuaugaagaacccaacaguggauggaaucguagcuauagaccucgacccuguggucuacgaugccaaauuugaaaagcagcuuggccagauuaugcuguugauccuguguaccagucaaauccuccugaugcggacuacgugggcauuaugcgagucgauuacacuugccaccgguccccugacuacccucugggaagggagcccaggaaaauucuggaauacaacuaucgcuguuuccauggccaacauauuucgaggcucuuaucuagcaggugcuggccuggccuucucauugaugaagagccuggggggaggcagaagggggaccggagcgcagggcgagacacucggugagaaauggaagcgccagcuuaaucagcuguccaagagugaauucaacacguacaaacggucugggauuauggagguggacagaagcgaagccaaggagggauugaaacguggcgaaaccacuaagcaugcagucucaagggguacagcuaaacugcggugguuuguggagcgcaaucucguaaagccugagggcaaggugaucgauuuaggguguggacgaggcgggugguccuauuacugcgccggacugaaaaagguuaccgaagugaaaggcuauacuaagggugggcccggacacgaggaaccgauuccaauggcaacauacggcuggaacaucgucaaacuucacaguggcagagacguguucuuuaccccucccgagaagugugauacgcugcuaugcgacauaggggaaagcucuccaaaucccaccaucgaggagggaaggacacuccggguccugaaaaugguggaaccuugguugcgcgguaaccaauucuguauuaagauccugaauccguacaugcccuccguuguagagacucucgaacagaugcagagaaagcauggcgggaugcuugugaggaacccacugucacgaaauagcacccacgagauguauugggucucgugcggaacaggcaacauugugucugcuguuaacaugacuagucggauguuacugaaucguuuuaccauggcccauagaaaaccuacauacgagcgcgauguggacuugggugccgggaccaggcacgucgcgguggaacccgagaucgcuaaccucgauauuaucggacagcggauagaaaauauuaagaacgagcacaaauccacuuggcauuaugacgaagauaauccuuacaagacgugggcauaucacggcagcuacgagguaaaaccaucaggcuccgccucuagcauggugaacgggguugucagacugcuaacaaagcccugggacgugaucccuauggugacccaaaucgcuaugacugacaccacaccauucggacagcagcgcgucuuuaaggagaaaguugauacgaggaccccccgaccgaagcgggguacugcccaaauuauggaagugacagcaaaauggcuuuggggcuuccugaguagaaauaagaaaccuaggauauguacccgcgaggaauuuacucguaagguacgguccaacgccgcuaucggggcgguguucgucgacgagaaucaguggaacagcgccaaggaagcaguggaggaugagagauuuugggaccucguucauagggaacgcgagcugcacaaacagggaaagugcgcuacaugcguguauaauaugaugggcaaacgagaaaagaaauugggugaguucgggaaggccaagggaucucgggcaauuugguacauguggcugggcgccagauuucucgaauucgaggcucuuggcuucaugaacgaggaucauugguuuucaagggaaaauagucuguccggggucgagggagaagguuuacacaaacugggcuacaucuugcgcgacauuagcaagaucccagggggaaacauguaugccgaugacaccgcgggcugggauacaagaauaacugaggacgaucuccagaaugaggcaaaaaucaccgacauuauggaacccgagcacgcccugcuagcuacgucuaucuucaagcuuaccuaccaaaacaaagugguacggguucagaggccugccaagucggguacagugauggaugucauuucacgucgagaccagcgcgggagcggacaggugggcacuuauggccugaacaccuuuacaaauauggaagugcaacucaucagacagauggaguccgaagggauauucaguccaucugagcuggagaacagcaauuuggcagaacgggucuuagacuggcuggagaaacauggaguugaaaggcucaagcgcauggcuauuuccggugaugacugugugguaaagcccacugaugacagauuugccaccgcucuuacggcccugaacgauaugggcaaagugcggaaggacaucccgcagugggagccuucaaaaggguggaaugauuggcagcaaguccccuucugcagucaccauuuucaccagcuaaucaugaaggacggaagggaaauugugguuccaugucgaaaccaggaugagcuggugggccgugcaagagucucucagggugcgggguggagccuccgcgagacagccugcuugggaaaauccuacgcucaaauguggcagcugauguauuuccaccggagggaccuuagacuggccgcaaaugcuauauguucagccgugccuguaaacuggguucccaccagccgcacuacauggucuauccaugcacaccaucaguggaugaccacugaagauaugcucuccguguggaaucgggucuggauugaggaaaacccauggauggaggacaagacccacgugaguagcugggaagacguucccuacuuaggcaagagggaggaucaauggugcggcucgcugaucggguugacagcccgagcgacgugggcuaccaauauucagguggccaucaaccaggucagacggcugauaggaaaugagaacuaucucgacuacaugacuuccaugaaaagguuuaagaaugaaucugauccugagggugcacuuugguga

SEQ ID NO: 14079 - RNA, 9879 nt, Artificial Sequence
  derived and/or modified CDS sequence (opt3) from DENV-1__KT187561__SS-prME
agcgugaccaugcugcucaugcuucugcccaccgcauuggcuuuccacuuaacuacgagaggaggggagccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaauugcucaagacagaggugaccaacccugccgugcugaggaaacuuugcauugaagcuaagaucuccaauacgaccacagacucucgguguccaacucaaggagaggccacccuggucgaagaacaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaagggggugucuuaugucauguguacaggauccuucaaacuugagaaggaaguggcugagacucagcacgguaccguuuuggugcagguaaaguacgagggcacggaugcgccuugcaaaauaccaaucagcacacaagacgaaaagggggucacccagaacggacgccugauuacugcaaaucccaucgugacagauaaagagaagccuguuaacauagaaaccgagccacccuuuggcgagucguauauugugaucggugccggggaaaaagcucucaagcugucuugguucaagaaaggcuccucaaucggaaagauguuugaggccacugcaagaggcgccaggcggauggcuauucuuggggacaccgccugggauuucggaaguaucgguggcgucuuuacaagcguggggaaacugguacaucagguguucggaacggcauacggcguuuuguuuuccggugucucuuggaccaugaagauugggauaggcauccuccugacuugguuaggacugaauagccgaucaacaagucuauccaugaccuguauugcggugggcauggugacacucuaccugggggucaugguucaggcugacagcggaugcgugaucaacuggaaaggccgcgaacuuaagugugguucugggaucuucgugacuaacgagguacacaccuggacggaacaauauaaguuucaggccgauucaccgaaaagauugagugcagccauuggaaaggcuugggaggagggcgucugcgguauaaggagcgccacacggcuggaaaauaucauguggaaacagauuuccaacgagcucaaucauauccuguuagaaaacgacaugaaguucaccgugguugugggcgacgcaaaugggauucugacucagggcaagaagaugauccgcccucaacccauggagcacaaauacucuuggaagucguggggcaaggcuaaaauaaucggggccgauacccagaacacaacuuuuauuaucgacggaccagauaccccugaaugucccgacgaucagagagcguggaauauuugggaggucgaggacuauggcuucgguguguuuacaacgaacaucuggcuuaaguugagggauagcuacacccagaugugcgaccaccgucucauguccgccgcuauaaaagauucaaaggcaguucaugccgacaugggguauuggauugaaagugagaaaaaugaaacuuggaagcuggcucgggccucuuucaucgaggugaagacauguauuuggccacgaagccacacccuaugguccaacggaguacuggaaucagagaugaucauacccaaaaucuacggcgguccuauuagccaacauaauuauagaccaggcuacuucacucagacagcagggccguggcaccucggaaagcuggagcuugauuuuaacuugugcgaaggcaccacggucgugguggacgagcacugcgggaauaggggacccucucugcgcacuaccacagucaccggcaaaaucauucaugaaugguguugccgguccuguacuuuaccuccacucagauucaggggugaggaugggugcugguacggaauggagauccgccccguuaaggaaaaagaggaaaaccuggugcgaaguaugguaagcgcgggcucuggugagguggacuccuuuucacuuggccuguugugugucaguauaaugauugaagaggugaugcggagccguuggucgagaaagaugcucaugacagggacccuggccguuuucuuucuacugaucaugggacagcucacauggaaugaccugaucaggcuuugcauuauggugggcgcuaacgucuccgaucgcauggggaugggaacuaccuauuuggcccugauggcaacguucaagaugcggccuauguuugcugugggcuuacucuucagaaggcugacaucucgagagguucuucugcuaaccaucggucucagccugguggccucagucgaauugccaaacagucuggaggaauuaggggacggacucgcaaugggcauuaugaugcugaaacuucugacugauuuucaaucccaccaguuguggaccacacuccugucucuaacuuucauaaagaccacgcugagccuugacuacgccuggaaaacaauggcuaugguacucuccaucgugucacuguuucccuugugucugagcaccacaagucagaagacaaccugguuaccgguucuccugggcucuuucgggugcaaaccucuuacuauguuucugauuacagagaauaagaucuggggacgcaaguccuggccauugaacgaagguauuauggcggugggcaucgucagcauacuccugucgucacuacugaaaaaugaugugccccuugccgggccucucaucgcaggaggcaugcugauugcuuguuauguaaucucugguaguuccgccgacuugagcuuagagcgggccgcugaggugucuugggaagaggaagcagagcauagcggggccucccacaacauucuggucgaaguucaggaugacggaaccaugaagaucaaagaugaggagagagacgauacgcucacuauacugcuuaaggcgacccuguuggcugugucaggcguguaccccaugaguauuccagccacacuauucgucugguauuucuggcagaaaaagaaacagaggagcggcgugcugugggacaccccuucucccccagaaguugagcgugcaguacucgaugacgggaucuaccgcauccugcagcggggacuuuuagguagaucccaggugggcgucgggguguuucaagacggaguuuuccauacaauguggcacgugacuaggggcgccguccugauguaucaggguaagcgacucgaaccgucaugggcuagugugaagaaagauuugauuagcuacgggggaggcuggcgguuucagggcuccuggaauaccggggaggagguacaggucauagcaguggaaccuggaaagaaccccaaaaauguucaaacgacaccagguacuuucaagacccccgagggcgaagugggggccaucgcgcuggacuuuaaaccuggaacaucuggcucgccaauugucaaccgcgaggguaagaucguggggcucuacggaaauggcguugugaccacuagcggcaccuaugucucagcuauugcccaggcaaaggccucccaggaagggccccugccugagaucgaggaugaaguguucaaaaagagaaaccuuacaauaauggaccugcacccgggaagugguaaaacgaggcgguacuugccagcuaucguacgagaggccauuaagagaaaacuacgcacucugauccucgcacccaccagggugguugcuucugaaauggccgaggcguuaaagggcaugccuauucguuaucaaacaaccgccgucaagagcgaacauacugggaaagagaucguggaucugaugugccacgcaacauuuaccaugcggcuucuguccccagugagaguccccaauuacaacaugauaauuauggacgaggcucauuucacggauccugccucaaucgcugcaaggggauauaucucuacucgcguaggcaugggugaagccgccgcuauuuuuaugacagcgaccccgcccgggagcguggaggcauucccacagaguaaugccguuauccaggacgaagaacgagauauaccugaaagauccuggaacagcggauacgacuggauuaccgauuuucccggcaagacugugugguucgucccaucuaucaaaucaggcaaugacauugcuaacugucuccggaagaacgggaaaagggugauccaguugucccgcaagacauucgacaccgaguaucaaaagacuaaaaauaacgauugggacuacguugugacuacggauauaagugagaugggagccaauuuucgugcagacagagucauugauccucggaggugccugaagcccgugauccucaaagacgguccagaacgcguaauccuggccggcccgaugccugugaccgcugcgagcgccgcacagcgaagagggcggauuggaaggaaccagaauaaggagggcgaucaguacaucuauaugggucaaccccuuaacaaugacgaagaucacgcucauuggacagaggccaaaaugcuacuggacaacauuaauacuccagaggggauaauccccgcauuguucgaaccugagcgcgaaaagucggccgcuauugauggcgaguacagauuaaggggagaagcccggaagaccuuuguugagcugaugcgucgcggcgaccucccagucuggcugucuuauaaaguggcguccgagggguuccaguacagcgaucgaagauggugcuuugacggagaaaggaacaaucaggugcuugaggaaaacauggacgucgagaucuggacaaaggaaggugagcggaaaaagcugcgccccagauggcucgaugcaaggaccuauucagacccuuuggcccugcgggaguucaaagaauuugcugccggccgaagaaguguuucuggggaucuaauccuggagauuggaaagcucccgcagcaccuuacucugcgcgcucaaaaugcauuagacaacuuggugaugcugcacaauuccgaacagggcgguaaagccuacaggcaugcuauggaggaacucccagauacgauagagacccugaugcuucuggcccucaucgcaguauugacagggggcgugacucuguucuuuuuaagcggaaagggccuagggaagaccucaauuggacugcucugugucauggcgaguagcgugcuucuguggauggccuccguugagccccacuggaucgcugccucuauuaucuuggaguucuuucugauggugcuccugauaccugagcccgaccggcagcguacaccacaggauaaccaacuugcauaugucguaaucggucuccuguucuugauucugaccguggcugccaacgaaaugggcuuacuagagacuacuaaaaaggaccuggggaucggacauguuguggcagagaaucaccaccaugccacgaugcucgauauugaccuucacccugcuagcgcguggacccuguacgccgucgcaacuacaaucauaacccccaugaugagacauaccauugaaaacacaacugcuaauaucuccuugacggccauugccaaccaggcagcuauccugaugggccucgauaaagguuggccaauaucaaagauggacaucggggugccucugcuugccuuaggcugcuacucucaggucaauccgcugacccucacagcggcuguguugaugcugguugcccacuaugcaauuaucggacccggccuacaagccaaagcuacuagggaggcacagaagcgcaccgccgcggggauuaugaagaacccaacaguggauggaaucguagcuauagaccuggacccuguggucuacgaugccaaauuugaaaagcagcucggccagauuaugcuucugaucuuguguaccagucaaauccugcucaugcggacuacgugggcacugugcgagucgauuacauuagccaccgguccccuuacuacccugugggaagggagcccaggaaaauucuggaauacaacuaucgcuguuuccauggccaacauauuccgaggcucuuaucucgccggugcuggccuagccuuuucacugaugaaaagccuagggggaggcagaagggggaccggagcgcagggcgagacacugggugagaaauggaagcgccagcucaaucagcuuuccaagagugaguucaacacguacaaacggucugggauuauggagguggacagaagcgaagccaaggagggacugaaacguggcgaaaccacuaagcaugcagucucaagggguacagcuaaauugcggugguuuguggagcgcaaucugguaaagccugagggcaaggugaucgaucucggguguggacgaggcgggugguccuauuacugcgccggacugaaaaagguuaccgaagugaaaggcuauacuaagggugggcccggacacgaggaaccgauuccaauggcaacauacggcuggaacaucgucaaacuacacaguggcagagacguguucuuuaccccucccgagaagugugauacgcuucugugcgacauaggggaaagcucuccaaaucccaccaucgaggagggaaggacacuacggguccucaaaaugguggaaccuuggcugcgcgguaaccaauucuguauuaagaucuugaauccguacaugcccuccguuguagagacucuggaacagaugcagagaaagcauggcgggaugcucgugaggaacccacuuucacgaaauagcacccacgagauguauugggucucgugcggaacaggcaacauugugucugcuguuaacaugacaagucggaugcuguuaaaucguuuuaccauggcccauagaaaaccuacauacgagcgcgauguggaccugggugccgggaccaggcacgucgcgguggaacccgagaucgcuaacuuggauauuaucggacagcggauagaaaauauuaagaacgagcacaaauccacuuggcauuaugacgaagauaauccuuacaagacgugggcauaucacggcagcuacgagguaaaaccaucaggcuccgccucuagcauggugaacgggguugucagacuccugacaaagcccugggacgugaucccuauggugacccaaaucgcuaugacugacaccacaccauucggacagcagcgcgucuuuaaggagaaaguugauacgaggacaccccgaccgaagcgggguacugcccaaauuauggaagugacagcaaaauggcuauggggcuuccuuaguagaaauaagaaaccuaggauauguacccgcgaggaauuuacucguaagguacgguccaacgccgcuaucggggcgguguucgucgacgagaaucaguggaacagcgccaaggaagcaguggaggaugagagauuuugggaccugguucauagggaacgcgagcuccacaaacagggaaagugcgcuacaugcguguauaauaugaugggcaaacgagaaaagaaacugggugaguucgggaaggccaagggaucucgggcaauuugguacaugugguugggcgccagauuccuggaauuugaggcucucggcuucaugaacgaggaucauugguuuucaagggaaaauagucuuuccggggucgagggagaaggucugcacaaauuaggcuacauccugcgcgacauuagcaagaucccagggggaaacauguaugccgaugacaccgcgggcugggauacaagaauaacugaggacgauuugcagaaugaggcaaaaaucaccgacauuauggaacccgagcacgcccuccuggcuacgucuaucuucaagcuaaccuaccaaaacaaagugguacggguucagaggccugccaagucggguacagugauggaugucauuucacgucgagaccagcgcgggagcggacaggugggcacuuauggccuuaacaccuuuacaaauauggaagugcaacugaucagacagauggaguccgaagggauauucaguccaucugagcucgagaacagcaaucuggcagaacgggucuuggacugguuagagaaacauggaguugaaaggcugaagcgcauggcuauuuccggugaugacugugugguaaagcccacugaugacagauuugccaccgcucucacggcccuuaacgauaugggcaaagugcggaaggacaucccgcagugggagccuucaaaaggguggaaugauuggcagcaaguccccuucugcagucaccauuuucaccagcugaucaugaaggacggaagggaaauugugguuccaugucgaaaccaggaugagcuagugggccgugcaagagucucucagggugcgggguggagccugcgcgagacagccugccucggaaaauccuacgcucaaauguggcaguugauguauuuccaccggagggaccugagacuugccgcaaaugcuauauguucagccgugccuguaaacuggguucccaccagccgcacuacauggucuauccaugcacaccaucaguggaugaccacugaagauaugcuguccguguggaaucgggucuggauugaggaaaacccauggauggaggacaagacccacgugaguagcugggaagacguucccuaccucggcaagagggaggaucaauggugcggcucguuaaucgggcugacagcccgagcgacgugggcuaccaauauucagguggccaucaaccaggucagacgguugauaggaaaugagaacuaucuggacuacaugacuuccaugaaaagguuuaagaaugaaucugauccugagggugcacucugguga

SEQ ID NO: 14080 - RNA, 9879 nt, Artificial Sequence
  derived and/or modified CDS sequence (opt3) from DENV-1__KT187562__SS-prME
agcgugaccaugcugcucaugcuucugcccacagcauuggcuuuccacuuaacuacgagaggaggggaaccucauaugaucgucuccaagcaagaaaggggaaaaucucuguuauuuaagaccucagccgguguuaacaugugcacacucauugccauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggagaagacucugaaacuuucuugguuuaagaaaggcuccucaaucggaaagauguucgaggcuaccgccagaggcgcaaggcggauggccauucugggggacacagcuugggauuuuggaaguaucgguggcgucuucacgagcguggggaaauugguacaucagguguuuggaaccgccuacggcguucucuucuccggugucucuuggacuaugaagauugggauaggcauccuguuaacauggcugggacuaaauagccgaucaaccagucucuccaugacauguauugcagugggcauggugacucuguaccuuggggucaugguucaggcggacagcggaugcgugaucaacuggaaaggccgcgaauugaagugugguucugggaucuuugugaccaacgagguacacacguggacagaacaauauaaguuccaggcugauucaccgaaaagacugagugccgcaauuggaaaggccugggaggagggcgucugcgguauaaggagcgcuacccggcucgaaaauaucauguggaaacagauuuccaacgagcugaaucauaucuuacuggaaaacgacaugaaguuuacugugguugugggcgacgccaaugggauucuuacccagggcaagaagaugauccgcccucaacccauggagcacaaauacucuuggaagucguggggcaaggcaaaaauaaucggggcugauacacagaacacuaccuucauuaucgacggaccagauacaccugaaugucccgacgaucagagagccuggaauauuugggaggucgaggacuauggcuuugguguguucacgaccaacaucugguugaagcucagggauagcuacacucagaugugcgaccaccgucugauguccgcggccauaaaagauucaaaggcuguucaugcagacaugggguauuggauugaaagugagaaaaaugaaacauggaagcuagcccgggcuucuuuuaucgaggugaagaccuguauuuggccacgaagccacacucugugguccaacggaguacucgaaucagagaugaucauacccaaaaucuacggcgguccuauuagccaacauaauuauagaccaggcuacuucacacagaccgccgggccguggcaccugggaaaacuugaguuggauuucaaccugugcgaaggcacgacugucgugguggacgagcacugcgggaauaggggacccucuuuacgcaccacaaccgucacuggcaaaaucauucaugaaugguguugccgguccuguacacucccuccacugagauuuaggggugaggaugggugcugguacggaauggagauccgccccguuaaggaaaaagaggaaaaccuugugcgaaguaugguaagcgcaggcucuggugagguggacuccuucucacugggcuugcucugugucaguauaaugauugaagaggugaugcggagccguuggucgagaaagaugcugaugaccgggacacuagcgguauuuuuccugcucaucaugggacagcugacuuggaaugaccuuaucagguugugcauuauggugggcgccaacgucuccgaucgcauggggaugggaaccacguaucuggcuuuaauggccacauuuaagaugcggccuauguucgcagugggccuccuguuuagaaggcuuaccucucgagagguucugcuacucacuaucggucugagcuugguggcuucagucgaacugccaaacaguuuagaggaacucggggacggacuggccaugggcauuaugaugcuuaaacuguugaccgauuuccaaucccaccagcucuggacaacucugcuaucucugaccuuuauaaagacgacacuuagccucgacuacgcauggaaaaccauggccaugguacuguccaucgugucauuguucccccuguguuuaagcacuacaagucagaagaccacuuggcucccgguucugcuuggcucuuuugggugcaaaccucugacaauguucuugauuaccgagaauaagaucuggggacgcaaguccuggccacucaacgaagguauuauggcugugggcaucgucagcauacugcuaucgucacugcuuaaaaaugaugugccccucgcggggccucugaucgccggaggcauguugauugcauguuauguaaucucugguaguuccgcugacuuaagccuggagcgggccgccgaggugucuugggaagaggaagcugagcauagcggggcaucccacaacauucucgucgaaguucaggaugacggaacgaugaagaucaaagaugaggagagagacgauacucugaccauacuucugaaggccacauugcuagcggugucaggcguguaccccaugaguauuccagcuacccuguuugucugguauuucuggcagaagaagaaacagaggagcggcgugcucugggacacaccuucucccccagaaguugagcgugccguacuggaugacgggaucuaccgcauccuucagcggggauuacuggguagaucccaggugggcgucgggguguuccaagacggaguuuuucauacuauguggcacgugaccaggggcgcaguccucauguaucaggguaagcgauuggaaccgucaugggccagugugaagaaagaucugauuagcuacgggggaggcuggcgguuccagggcuccuggaauacgggggaggagguacaggucauagcuguggaaccuggaaagaaccccaaaaauguucaaacaacuccagguaccuuuaagacacccgagggcgaagugggggcaaucgcccucgacuucaaaccuggaaccucuggcucgccaauugucaaccgcgaggguaagaucguggggcuguacggaaauggcguugugacuaccagcggcacauaugucucagcgauugcucaggccaaggcaucccaggaagggccccuuccugagaucgaggaugaaguguuuaaaaagagaaaccugacgauaauggacuugcacccgggaagugguaaaacuaggcgguaccuaccagccaucguacgagaggcuauuaagagaaaacugcgcacccucaucuuagcccccacaagggugguugcaucugaaauggcugaggcccugaagggcaugccuauucguuaucaaaccacugcggucaagagcgaacauacagggaaagagaucguggaucuuaugugccacgccaccuucacgaugcggcugcucuccccagugagaguccccaauuacaacaugauaauuauggacgaggcacauuuuacugauccugcuucaaucgccgcuaggggauauaucucuacacgcguaggcaugggugaagcagccgccauuuucaugaccgcuaccccgcccgggagcguggaggcguuuccacagaguaaugcaguuauccaggacgaagaacgagauauaccugaaagauccuggaacagcggauacgacuggauuacugauuuccccggcaagacagugugguuugucccaucuaucaaaucaggcaaugacauugccaacuguuugcggaagaacgggaaaagggugauccagcugucccgcaagaccuucgacacagaguaucaaaagacuaaaaauaacgauugggacuacguugugacgaccgauauaagugagaugggagcuaauuuccgugccgacagagucauugauccucggaggugccucaagcccgugauccugaaagacgguccagaacgcguaauccuugcaggcccgaugccugugacagccgcuagcgcggcccagcgaagagggcggauuggaaggaaccagaauaaggagggcgaucaguacaucuauaugggucaaccccuaaacaaugacgaagaucacgcacauuggacugaggcuaaaaugcuguuggacaacauuaauaccccagaggggauaauccccgccuuauuugaaccugagcgcgaaaagucggcagccauugauggcgaguacagacugaggggagaagcucggaagacauucguugagcucaugcgucgcggcgaccugccagucuggcuuucuuauaaaguggccuccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugcgaggacuuauucagacccucuggcacuacgggaguuuaaagaguucgccgcuggccgaagaaguguuucuggggaucugauccucgagauuggaaaacuuccgcagcaccugacguuacgcgcccaaaaugcuuuggacaaccuggugaugcuccacaauuccgaacagggcgguaaagcauacaggcaugccauggaggaacugccagauaccauagagacacuuaugcugcucgcuuugaucgccguacugacugggggcgugaccuuauuuuuccuaagcggaaagggccuggggaagacaucaauuggacuccuuugugucauggcaaguagcgugcuguuguggauggcguccguugagccccacuggaucgccgcuucuauuauccuggaauuuuuccucauggugcugcuuauaccugagcccgaccggcagcguaccccacaggauaaccaacucgccuaugucguaaucggucuguuguuuaugauucugacuguggcagcuaacgaaaugggcuuacuagagacaacgaaaaaggaccuggggaucggacauguuguggccgagaaucaccaccaugcaaccaugcucgauauugaccuucacccugccagcgcuuggacucuguacgcggucgccacaaccaucauaacccccaugaugagacauacaauugaaaacacuacggcaaauaucuccuugaccgcuauugccaaccaggccgcaauccugaugggccucgauaaagguuggccaauaucaaagauggacaucggggugccucugcuugcuuuaggcugcuacucucaggucaauccgcugacacucacugccgcgguguugaugcugguugcucacuaugccauuaucggacccggccuacaagcaaaagccaccagggaggcucagaagcgcacagcagccgggauuaugaagaacccaaccguggauggaaucguagcgauagaccuggacccuguggucuacgaugcuaaauucgaaaagcagcucggccagauuaugcuucugaucuuguguacgagucaaauccugcucaugcggacuacaugggcccugugcgagucgauuaccuuagcaacugguccccuuaccacacugugggaagggagcccaggaaaauuuuggaauacuaccaucgccguuuccauggcuaacauauuccgaggcucuuaucucgccggugcaggccuagcuuucucacugaugaaaagccuagggggaggcagaagggggacaggagcccagggcgagacgcugggugagaaauggaagcgccagcucaaucagcuuuccaagagugaauuuaacaccuacaaacggucugggauuauggagguggacagaagcgaagcgaaggagggacugaaacguggcgaaacuacaaagcaugccgucucaagggguaccgcaaaauugcggugguucguggagcgcaaucugguaaagccugagggcaaggugaucgaucucggguguggacgaggcgggugguccuauuacugcgcuggacuaaagaagguuacugaagugaaaggcuauacaaagggugggcccggacacgaggaaccgauuccaauggccaccuacggcuggaacaucgucaaacugcacaguggcagagacguguuuuucacgccucccgagaagugugauacccuucugugcgacauaggggaaagcucuccaaaucccacaaucgaggagggaaggacucuacggguccucaaaaugguggaaccuuggcugcgcgguaaccaauuuuguauuaagaucuugaauccguacaugcccuccguuguagagacccuggaacagaugcagagaaagcauggcgggaugcucgugaggaacccacuuucacgaaauagcacacacgagauguauugggucucgugcggaacuggcaacauugugucugcaguuaacaugaccagucggaugcuguuaaaucguuucacaauggcucauagaaaaccuaccuacgagcgcgauguggaccugggugccgggacuaggcacgucgccguggaacccgagaucgcgaacuuggauauuaucggacagcggauagaaaauauuaagaacgagcacaaauccacguggcauuaugacgaagauaauccuuacaagacaugggcuuaucacggcagcuacgagguaaaaccaucaggcuccgcaucuagcauggugaacgggguugucagacuccugaccaagcccugggacgugaucccuauggugacucaaaucgccaugaccgacacaacgccauuuggacagcagcgcgucuucaaggagaaaguugauaccaggacuccccgaccgaagcgggguacagcucaaauuauggaagugaccgccaaauggcuauggggcuuucuuaguagaaauaagaaaccuaggauauguacucgcgaggaguucacacguaagguacgguccaacgcagccaucggggcuguguuugucgacgagaaucaguggaacagcgcgaaggaagccguggaggaugagagauucugggaccugguucauagggaacgcgagcuccacaaacagggaaagugcgcaaccugcguguauaauaugaugggcaaacgagaaaagaaacugggugaguuugggaaggcuaagggaucucgggccauuugguacaugugguugggcgcaagauuccuggaguucgaggcccucggcuuuaugaacgaggaucauugguucucaagggaaaauagucuuuccggggucgagggagaaggucugcacaaauuaggcuacauccugcgcgacauuagcaagaucccagggggaaacauguaugcugaugacacagccggcugggauacuagaauaaccgaggacgauuugcagaaugaggcgaaaaucacggacauuauggaacccgagcacgcacuccuggccaccucuaucuuuaagcuaacauaccaaaacaaagugguacggguucagaggccugcuaagucggguacugugauggaugucauuucacgucgagaccagcgcgggagcggacaggugggcaccuauggccuuaacacauucacuaauauggaagugcaacugaucagacagauggaguccgaagggauauuuaguccaucugagcucgagaacagcaaucuggccgaacgggucuuggacugguuagagaaacauggaguugaaaggcugaagcgcauggcaauuuccggugaugacugugugguaaagcccaccgaugacagauucgcuacggcccucacagcucuuaacgauaugggcaaagugcggaaggacaucccgcagugggagccuucaaaaggguggaaugauuggcagcaaguccccuuuugcagucaccauuuccaccagcugaucaugaaggacggaagggaaauugugguuccaugucgaaaccaggaugagcuagugggccgugccagagucucucagggugcaggguggagccugcgcgagaccgcgugccucggaaaauccuacgcccaaauguggcaguugauguauuuucaccggagggaccugagacuugcugccaaugcaauauguucagcugugccuguaaacuggguucccacuagccgcacaaccuggucuauccaugcccaccaucaguggaugacuaccgaagauaugcuguccguguggaaucgggucuggauugaggaaaacccauggauggaggacaagacacacgugaguagcugggaagacguucccuaccucggcaagagggaggaucaauggugcggcucguuaaucgggcugacggcacgagccaccugggcgacuaauauucagguggcuaucaaccaggucagacgguugauaggaaaugagaacuaucuggacuacaugacauccaugaaaagguucaagaaugaaucugauccugagggugcccucugguga

SEQ ID NO: 14081 - RNA, 9879 nt, Artificial Sequence
  derived and/or modified CDS sequence (opt3) from DENV-1__JQ045628__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcauuuuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcugaagaccgaggugacgaacccugcaauucucaggaaacugugcaucgaagccaagauaucuaauaccacaacugauagccgguguccaacccaaggagaggcuacacuuguggaagaacaagacgccaacuuugucugccgccgaacuuucguugauagaggcugggguaauggguguggacuguuuggcaaaggcuccuugauuaccugcgcaaaguucaagugcgugacaaaacucgaggggaagaucguacaguacgaaaaccugaaauauucagugauugucaccgugcacacuggagaccagcaucaaguugguaaugagaguacggaacacggcacaaccgcuacuaucacaccccaagccccuaccaccgagauccaguuaacugacuacggggcgcugacacucgauuguagcccaaggacgggacuugacuuuaacgaaauggugcuguugaccaugaaggagaaaucuuggcuaguccauaagcagugguuccuggaucucccgcugcccuggacuuccggcgccucaacaagccaagagaccuggaaucggcaggaccuucuggugacauuuaaaacugcacacgcuaagaagcaggaaguaguuguguuggguagucaagagggggccaugcacaccgcucucacgggcgccaccgaaauucagacaucuggaacuaccacaauauucgcaggccaucugaaaugccguuuaaagauggauaaacugacucuaaaggggauguccuaugucauguguaccggaucguucaaacucgagaaggaaguggccgagacgcagcacgguacaguccuggugcagaucaaguacgagggcaccgacgcuccuugcaaaauuccauuuucgacucaagaugaaaaggggguuacacagaacggacgccuuaucaccgcgaaucccauagugacugacaaagagaagccuguaaacauugaagcagagccacccuucggcgagucuuauaucgucaucggugccggggaaaaggcuuugaagcuguccugguuuaagaaaggcucaaguauuggaaagauguucgaggccaccgcaagaggcgccaggcggauggcuauccucggggauacagccugggacuuuggaagcauugguggcguguucacguccguugggaaacuggugcaucagauauuuggaaccgcauacggcguccuuuucucuggugugagcuggacuaugaagaucgggauuggcguacuguugacauggcucggacuaaauucacgaaguaccuccuuaagcaugacauguaucgcggugggccugguuacucuauaccucggggucauggugcaggcugauucuggaugcgugaucaacuggaaaggccgcgaacugaagugugguucagggauuuuugucaccaaugagguucacacguggacagaacaauauaaguuccaggccgacaguccgaaaagacuuagcgcagccauaggaaaggcuugggaggagggcgugugcgguaucagguccgccacccgguuggaaaacauuauguggaaacagaucucuaacgagcugaaucauauucuccuggaaaacgacaugaaguuuacugugguagucggcgauguggcagggaucuuagcucagggcaagaaaaugauacgcccucaacccauggaguacaaauauucguggaaaagcuggggcaaggccaagaucauuggggcggacguucagaauaccacauucaucauugauggaccaaacacuccugaaugucccgacgaucagagagccuggaauaucugggagguggaggacuacggcuuugguauauucaccacaaacauuuggcugaaacuuagggauuccuauacgcaggucugcgaccaccguuugaugucagcugcaaucaaagauaguaaggccgugcacgcugacaugggguacuggauugaaucugagaaaaaugaaaccuggaagcucgcccgggcuuccuucaucgagguuaagacuuguauauggccaaaaucccauacacuguggucaaacggagugcuagaaagcgagaugaucauucccaagaucuauggcgguccuauuucucaacacaauuaccgaccaggcuacuuuacccagacugcggggccguggcaucugggaaaacucgagcuggauuucgaccuuugcgaaggcacaaccguagucguggaugagcacugcgggaacagaggacccuccuugaggacgacuaccgugacaggcaagaucauacacgaaugguguugccgcaguuguacccugccuccauuacgguuuagaggugaggacgggugcugguauggaauggagauuaggcccgucaaagaaaaggaggaaaaucucguuaagagcauggugucugccggcuccggugagguagacucauucagucugggccuucuguguaucagcaucaugauugaagaggugaugcgcucgcgauggucccggaaaauguugaugacugggacacucgcugucuuucugcuacugaucaugggacagcucaccuggaacgaucugauucgucuuugcauaauggugggcgccaaugcaucugacagaauggggaugggaacaacuuacuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaucaguugugggcgacucuccugagccuaaccuucauuaagacaacuuuuucccugcacuaugccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuacgugauuagugguuccagcgccgacuugucuuuagagaaagcggcugaggucagcugggaagaggaagccgagcauuccggggcaucacacaauauccugguggaaguacaggaugacggaaccaugaagaucaaagaugaggagcgcgacgauacucucacaauucugcuuaaggccacccuguuggcugugaguggcgucuauccccuaagcauaccagcaacgcuguucguuugguacuucuggcagaagaagaagcagcggucuggcgugcucugggacacuccuucacccccggaaguggagagagccguccuggaugacgggaucuauaggauuaugcagcguggacuuuuaggucgcagccaggugggcguugggguauuucaagaaaacguguuccauaccauguggcacgucacacggggagcggugcugauguaccagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacaacuccaggaaccuuuaagacgcucgaaggugaggucggcgcaaucgcccuggauuucaagcccgggacaucgggaagcccuauagugaaccgagaaggcaaaaucguuggucuuuaugggaauggaguggucacuaccucaggcacauacguguccgcuauugcccaggcaaaggcuagucaggagggcccacugcccgagaucgaagacgagguuuuucggaaacgcaacuugaccauuauggaucuacacccugggucuggaaagacuagaagguaucugccggccaucgugcgggaagcgauaaaacgaaagcucagaaccuuaauucuggccccaacacgcgucguggcaagcgagauggcugaagcccuuaaggguaugcccaucagguaccaaacgacugcuguaaaauccgagcauaccggcaaggagaucguggaccugaugugccacgcaacauucaccaugcgucucuugucaccuguucgggucccaaauuauaacaugauuaucauggaugaagcccauuuuacugaccccucuagcauagccgcuagaggguacauuaguacaagggugggaaugggcgaggcggcagccaucuucaugaccgcuacgccuccggguuccguggaagccuuuccccagagcaaugcagucauucaggaugaggaacgcgacaucccagagcgaucuuggaacucaggguaugaguggauaacugauuucccuggaaaaacaguaugguuugugcccuccauuaagaguggcaaugacaucgccaacugucugaggaagaauggcaagcggguuauccagcucagcaggaagaccuucgauaccgaauaccagaaaacuaagaacaacgacugggacuacguggucacaaccgauauuucggagaugggggcuaauuuccgcgcggaccgugugaucgauccaagacggugccugaaaccuguuauucuuaaggacggacccgaaagggugauacuagccgguccaaugccggucacaguggcaucugcugcccagcgccgaggcagaaucgggcggaaccacaauaaagagggagaucaguauauuuacaugggccagccucugaacaaugacgaggaucaugcacacuggacugaagccaagauguuguuagacaacaucaauacgcccgaggguaucauuccagcucuguuugaacccgagagggaaaaguccgccgcgauagauggggaguaucgccucagaggcgaggcaaggaaaaccuucguagaacugaugcggcguggagaccuuccuguguggcugagcuacaagguugccucagagggcuuucaauauagugaucgccgauggugcuucgacggggaaagaaacaaucagguccucgaggaaaacauggauguggagaucuggacaaaagagggagaaaggaagaaauugcggccacgcuggcuggacgcuagaacuuacucugacccccuagcccugagggaguuuaaggaguucgcugcaggucggcgauccgugagcggcgaucucauucuugagaucgggaaacugccucagcacuuaacccagagagcccaaaaugcuuuggacaaccuggucaugcuccauaauucagaacagggaggccgcgccuauaggcacgcaauggaggagcugccggauacaauugaaacccuuaugcugcucgcguugaucgccguucugacugguggggugacguuauuuuuccuaaguggccggggacugggcaagaccagcauagggcuccuuuguguaaucgcuuccucugugcuguuguggauggccagcgucgagccacauuggauugcagcuuccaucauucuggaauuuuuccucauggugcugcuuauccccgagccugaccgucagagaacaccccaggauaaccaacucgccuacguugugauaggacuguuguuuaugauucugacugucgcagccaaugagauggguuuacuagaaaccacaaagaaagaccugggcaucgggcacguagcugugggaaaccaccaucacgcggccaugcucgauguugaccuucauccagcaucagcuuggacccuguacgccguggccacuacaauuaucacgccuaugaugaggcacaccauagagaacacuacagcaaauaucucuuugaccgcuauugccaaccaggcggcuauccugaugggccucgauaaggguuggcccauuaguaaaauggacaucggggucccacugcuugccuuaggcugcuauagccaggugaauccucugacccucacagcagccgucuugaugcugguggcucauuacgcaauaauuggaccgggccuacaagccaaggcgacucgcgaagcucagaaacggacggccgcagggaucaugaagaaccccaccguugauggaaucguggccauugaccuggauccaguaguguaugacgcuaaguucgagaaacagcucggccagaucaugcuucugauauuguguacaagccaaauucugcucaugcgaacuaccugggcccugugcgaauccaucacauuagcaaccgguccucuuacuacgcugugggaggggucucccggaaaguuuuggaauacaaccauugcugucucaauggccaacaucuucagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguuuaacacauauaagagaucagggauaauggaaguugaccguuccgaggccaaagaaggacugaagaggggcgagacuaccaaacacgcagugagucgggguacagcuaaguugcgcugguucgucgagcgaaaucuggugaaaccagaaggcaagguaaucgaucucggguguggaagaggcggguggagcuacuauugcgccggauuaaagaaagugacggagguuaagggcuacaccaaaggugggccuggacacgaggaacccauuccgauggccacuuacggcuggaaccuggugaaacuucauucuggcaaagacgucuuuuucaucccaccugaaaagugugauacacugcuaugcgacauuggggaguccucacccaauccaaccaucgaggaaggaaggacucuccgggugcugaaaauggucgagcccugguugcgcgguaaccaauuuuguauuaagauccugaauccuuauaugccgagcgugguugaaacacucgagcagaugcagagaaagcacggcgggaugcuuguaaggaacccccugucgcgaaauucuacccaugagauguacugggugaguugcggaacgggcaacauagucuccgcggugaauaugaccagccggauguuacugaaccguuucacaauggcucacagaaaaccaacuuaugaacgcgauguugacuugggugcagggaccaggcacguggccgucgagccugaaguggcuaaccucgauauuaucggacagcggaucgagaauauuaagcaugaacacaaaucaacauggcauuacgacgaggauaaccccuauaagacuugggccuaccacggcuccuaugagguaaaaccuucuggcagcgcaaguuccauggugaaugggguugucaagcugcuaaccaagccaugggacgugauacccauggugacacaaaucgccaugaccgauacuacgccuuuuggacagcagagagucuucaaagaaaagguugacacacgcaccccaaaagcuaagagggguacugcgcaaauuauggaggugaccgccaaauggcuuuggggcuuucugagccgaaacaagaagccccggaucuguacaagagaagaguucacgaggaaaguacgcucuaaugcagcuauuggggccguguuugucgacgaaaaccaguggaacucagcaaaggaggccguggaggaugaacguuucugggaccucguucaucgggagagagaacugcacaaacagggaaagugcgcuaccugcguguacaacaugaugggcaaaagggagaagaaguugggugaauuugggaaagccaagggaagucgcgcgaucugguacauguggcugggcgcacgauuccucgaguucgaggcccuuggcuuuaugaaugaagaucacugguucucccgggagaacagccugucuggggucgaaggagaggguuuacauaaacugggcuauauauugagagacaucucgaagauuccagggggaaauauguacgcugaugacacugccggcugggauacaaggaucaccgaggacgaucuccagaacgaagcacgcauuacugacaucauggagccugaacacgcucugcuagccaaaucaauauuuaaacuuacauaucaaaauaaagugguaagaguucagcggccagcuaagaacgguaccgugauggaugucauuagcaggcgugaccagcgaggguccggacaggugggcacauacggccugaauacuuucaccaacauggaggcccaacucauccgccagauggaaagugaggggaucuuuucucccagcgagcuggaaacgccuaacuuggcagagagaguguuagauuggcuggaaaaguauggagucgagcggcucaaaaggauggcgauuuccggugacgacuguguugugaagccaauagaugaccgcuucgccaccgcucuuacagcccugaaugauaugggcaaaguaagaaaggacaucccccagugggaaccgucaaaaggguggaacgauuggcagcaagugccuuuuugcagucaucacuuccaccagcuaauuaugaaggacggacgggagaucgucgugcccuguaggaaucaggaugagcugguuggccgagcacgugugucucagggugcuggguggagccucagagaaacugccugcuugggaaaguccuacgcacaaauguggcagcugauguauuuucaucgccgggaccuuaggcuggccgcgaacgcuauuuguucagccgucccaguggauuggaucccuaccagcagaacaacuuggucuauacacgcacaucaccaguggaugaccacggaggacaugcucuccguauggaaucgcguuuggaucgaagagaaccccuggauggaagauaaaacacauauuaguagcuggggcgacgugccauacuuaggcaagcgggaggaccaauggugcgggucgcugaucggauugaccgccagggcuacuugggccacaaauauucaggucgcaaucaaccaggugcgaagacugauugguaaugagaacuaccucgauuauaugaccuccaugaaacgguucaagaaugaaucugaccccgagggcgcucuuugguga

SEQ ID NO: 14082 - RNA, 9879 nt, Artificial Sequence
  derived and/or modified CDS sequence (opt3) from DENV-1__JQ045629__SS-prME
agcgugaccaugcugcucaugcuuaugcccacggcccuggcuuuccacuugacuacgagaggaggggaaccucauaugauggucuccaagcaggaaagaggaaaaucuuuacuguuuaagaccucagccgguguuaauaugugcacacugaucgccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuaucgcucuguuucuggcacaugccauuggcaccucgaucacgcagaagggcauuaucuucauacucuuaaugcuggugacuccaucaauggcuaugcgcugcgucgggaucggaagcagagauuuuguggagggucuuaguggcgccacauggguagacguuguguuggagcacggguccugugucaccacuauggcgaaggauaaacccacacuggacauugaacuacucaagaccgaggugacgaacccugcagugcugaggaaacuuugcaucgaagccaagauuucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauagugcaguacgaaaacuuaaaauauucagucauugugaccguucacacuggagaccagcaucaaguggguaaugagaguacggaacacggcacaaccgcuacuaucacaccccaagccccuaccaccgagauucagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaaucuuugcaggccauuuaaaaugccgucugaagauggauaaacuaacucucaaggggauguccuaugugauguguaccgggucguucaaacuggagaaggaacuugccgagacgcagcacgguacagucuuggugcagauuaaguacgagggcaccgacgcuccuugcaaaauaccauucucgacucaagaugaaaaggggguuacacagaacggacgccugaucaccgcgaaucccauugugacugacaaagagaagccuguaaacaucgaagcagagccacccuuuggcgagucuuauauagucauuggugccggggaaaaagcucucaagcuguccugguucaagaaaggcucaaguaucggaaagauguuugaggccaccgcaagaggcgccaggcggauggcuauccuuggggauacagccugggacuucggaagcauugguggcguguuuacguccguugggaaacuggugcaucagaucuucggaaccgcauacggcgucuuguuuucuggugugagcuggacuaugaagauugggauaggcguacuccugacaugguuaggacuaaauucacgaaguaccucccuaagcaugacauguaucgcggugggccucguuacucuguaccuuggggucauggugcaggcugauucuggaugcgugauuaacuggaaaggccgcgaauugaagugugguucagggaucuucgucaccaaugagguucacacguggacagaacaauauaaguuucaggccgacaguccgaaaagacugagcgcagccaucggaaaggcuugggaggagggcgugugcgguauuagguccgccacccggcucgaaaacauaauguggaaacagaucucuaacgagcugaaucauauuuuacuggaaaacgacaugaaguucacugugguagucggcgauguggcagggauccuugcucagggcaagaagaugauucgcccucaacccauggaguacaaauauucguggaaaagcuggggcaaggccaagaucauaggggcggacguucagaauaccacauuuaucauugauggaccaaacacuccugaaugucccgacgaucagagagccuggaauaucugggagguggaggacuacggcuucgguauuuuuaccacaaacaucugguugaagcucagggauucccacacgcaggucugcgaccaccgucugaugucagcugcaauaaaagauaguaaggccgugcaugcugacaugggguauuggauugaaucugagaaaaaugaaaccuggaagcuagcccgggcauccuucaucgagguuaagacuuguauuuggccaaaaucccacacacuguggucaaacggagugcucgaaagcgagaugaucauacccaagaucuacggcgguccuauuucucaacauaauuaucgaccaggcuacuucacccagacugcggggccguggcaccugggaaaacuugaguuggauuuugaccugugcgaaggcacaaccguagucguggaugagcacugcgggaacagaggacccuccuuaaggacgacuaccgugacaggcaagaucauucaugaaugguguugccgcaguuguacccucccuccacugcgguucagaggugaggacgggugcugguacggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgauggucccggaaaaugcugaugacugggacacuagcugucuucuuucugcucaucaugggacagcugaccuggaacgaucuuauucguuugugcaucauggugggcgccaaugcaucugacagaauggggaugggaacaacuuaucuggcuuuaauggccaccuucaagaugaggccuauguuugcaguuggccuccuguuccgccggcuuacgagcagagaggugcugcuacucacaauuggucugucauuggucgccaguguggaacugccaaacuccuuagaggaacucggggauggacuggcuaugggcauaaugauccuuaaacuguugaccgacuuucaaucucaccagcucugggcgacucugcuaagccugaccuucauuaagacaacuuuuucccuucauuacgccuggaaaaccauggcaaugguucucucaaucgugagccuguuccccuugugucugaguacgacaucucagaagaccacuugguuaccgguccuccugggcucccuugggugcaagccucugacaauguuuuugauugcugagaauaaaaucuggggaaggcgaagcuggccacucaacgaagguauaauggccguaggcaucgugucgauucugcuaucaucucugcuuaagaacgauguuccccucgccgggccucugaucgcuggaggcauguugauugcauguuaugugaucagugguuccagcgccgacuuaucucuggagaaagcggcugaggucagcugggaagaggaagccgagcacuccggggcaucacauaauauacucguggaaguacaggaugacggaaccaugaagauuaaagaugaggagcgcgacgauacucugacaauccuucugaaggccaccuugcuagcugugaguggcgucuacccccugagcaucccagcaacacucuucguuugguauuucuggcagaagaagaagcagcggucuggcgugcugugggacacuccuucacccccagaaguggagagagccguccuugaugacgggauuuacaggauaaugcagcguggauuacugggucgcagccaggugggcguugggguauuucaagaaaacguguuccacaccauguggcacgucacacggggagcggugcucauguaucagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacagcaccaggaacuuuuaagacccccgaaggugaggucggcgccaucgcucuggauuucaagccugggacgucgggaagcccaauugugaaccgagaaggcaaaaucguuggucuuuacgggaauggaguggucacaacuucaggcaccuauguguccgccauagcacaggcuaaggccagucaggagggcccccugccugagaucgaagacgagguuuuucggaaacgcaacuugacaauuauggaucuacauccggggucuggaaagaccagaagguaccugccagcgaucgugcgggaagccauuaaacgaaagcucagaacuuuaauccuggcacccacccgcgucguggcuagcgagauggccgaagcucuuaaggguaugccuauaagguaucaaacaacggcaguaaaauccgagcacacuggcaaggagauuguggaccugaugugccaugccaccuucacaaugcgucucuugucaccaguucggguccccaauuacaacaugaucaucauggaugaagcccacuuuaccgacccuucuagcauugcugcgagaggguauaucaguacuagggugggaaugggcgaggcagccgcuauauucaugacagccaccccgcccgguuccguggaagcauuuccacagagcaaugccgucauucaggaugaggaacgcgacaucccugagcgaucuuggaacucaggguacgaguggauuacggauuuccccggaaaaacuguaugguuugugccauccaucaagaguggcaaugacauagcuaacugucugaggaaaaauggcaagcggguuauucagcucagcaggaagacauucgauaccgaauaucagaaaaccaagaacaacgacugggacuacguggucacuacagauaucucggagaugggggcgaauuuccgcgccgaccgugugaucgauccuagacggugccugaaacccguuauucuuaaggacggaccagaaagggugauccuagcagguccgaugccugucaccguggcuucugccgcacagcgccgaggcagaauugggcggaaccauaauaaagagggagaucaguacauauauaugggccagccccugaacaaugacgaggaucacgcccacuggacagaagcuaagauguuguuagacaacaucaauacuccagaggguauuauccccgcccuguuugaaccugagagggaaaaguccgcggcaaucgauggggaguaccgccucagaggcgaggccaggaaaacguucguagaacugaugcggcguggagaccuuccaguguggcugagcuauaagguugcuucagagggcuuucaauacagugaucgccgauggugcuucgacggggaaagaaacaaucagguccucgaggaaaacauggauguggagauuuggaccaaagagggagaaaggaagaaauugcggccccgcuggcuggacgccagaacauauucugacccucuagcucugagggaguuuaaggaguucgcagccggucggcgauccgugagcggcgaucucauacuugagaucgggaaacugccgcagcauuuaacucagagagcucaaaaugccuuggacaaccuggucaugcuccacaauucagaacagggaggccgcgcauacaggcaugcgauggaggagcugccagauaccauugaaacacuuaugcugcucgccuugaucgcuguucugaccgguggggugacuuuauuuuuccuaaguggccggggacugggcaagacgagcauugggcuccuuuguguaauggccuccucugugcuguuguggauggcaagcgucgagccccacuggaucgcugccuccauaauccuggaauuuuuccucauggugcugcuuauuccugagcccgaccgucagagaaccccacaggauaaccaacucgcauauguugugaucggacuguuguuuaugauucugacagucgccgcuaaugagauggguuuacuagaaacuaccaagaaagaccugggcaucgggcacguagcgguggagaaccaucaccaugccgcaaugcucgauguugaccuucacccugcuucagccuggacacuguacgccguggcaaccacuauaauuacacccaugaugaggcauacgaucgaaaacaccacugcuaauauuucuuugacagccaucgcgaaccaggcugccauacugaugggacucgauaagggcuggccaaucaguaaaauggacauuggugucccucugcuugcauuagggugcuacagccaggugaauccgcugacccucaccgccgcugucuugaugcugguggcacacuaugccaucauuggccccggacuacaagcgaaggcuacacgcgaggcccagaaacggacugcagccggcaucaugaagaacccaacgguugaugggauaguggcuauugaccuggauccuguaguguacgacgccaaguucgaaaaacagcucggacagaucaugcuucugaucuuguguaccagccaaauucugcucaugcgaacaacuugggcacugugcgaguccaucaccuuagcuacaggcccccuuaccacucugugggaggguucuccagggaaguuuuggaauacgacaauagccgucucaauggcgaacauuuucagaggaagcuaucucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuacaagagaucagguaucauggagguugaccguuccgaagcaaaagaggggcugaagaggggagagacaacuaaacacgcugugagucggggcaccgccaaguugcgcugguucgucgaacgaaaucuggugaaaccugaggguaagguaauugaucucggcugugggagaggaggcuggagcuauuacugcgccggguuaaagaaagugacagaaguuaagggauauacgaaaggcggucccgggcaugaggaaccgaucccaauggcgaccuacggauggaaccuggugaaacuucacucuggcaaagacgucuuuuucauaccucccgagaagugugauacucugcuaugcgacaucggcgaguccucaccaaaucccacaauugaagaggggaggacccuccgggugcugaaaauggucgaaccuugguugcgcggaaaccaauuuuguaucaagauucugaauccguacaugcccagcgugguugagacucucgagcagaugcagagaaagcaugguggcaugcuuguaaggaacccacugucgcgaaauucuacacacgaaauguauugggugaguugcgggaccggaaacaucgucuccgcugugaauaugacgagccggauguuacugaaccguuucaccauggcacacagaaaaccuacauacgagcgcgauguugacuugggcgccgguacuaggcauguggcugucgaacccgagguggccaaccucgauauuaucgggcagcggauagaaaauauuaagcacgagcauaaaucaaccuggcacuaugacgaggauaacccuuacaagacaugggcauaucauggauccuacgaaguaaaaccaucuggcagcgccaguuccauggugaauggcguugucaagcugcuaacuaagcccugggacgugaucccuauggugacccaaaucgcuaugacagauaccacuccauuugggcagcagagagucuucaaagagaagguugacacgcgcacacccaaagcgaagaggggaaccgcccaaauuauggaagugacugcaaaauggcuuugggguuuucugagccgaaacaagaagccgcggauauguaccagagaggaguucacaaggaaaguacgcucuaaugcugccaucggcgcaguguuugucgacgagaaccaguggaacucagccaaggaggcuguggaagaugagcguuucugggaccucguucaccgggaaagagagcugcacaaacaggggaagugcgccacgugcguguauaacaugaugggaaaaagggaaaagaaguugggcgaguuugguaaagcgaaggggagucgcgcaauuugguacauguggcugggagcccgauuccucgaguucgaagcucuuggcuuuaugaaugaggaucauugguucucccgggaaaacagccugucuggcgucgagggggagggauuacacaaacuggguuacaucuugagagacauuucgaagaucccuggcgggaauauguaugccgaugacaccgcaggaugggauacuaggauaacagaagacgaucuccagaacgaggcucgcaucaccgacauuauggaaccagagcaugcccugcuagcuaaaucaaucuuuaaacuuacuuaccaaaauaaagugguaagaguucagcggcccgccaagaacggcacagugauggaugucauuagcaggcgugaccagcgagguuccggacaggugggaaccuauggccugaauacauucacuaacauggaagcacaacucauccgccagauggagagugagggcauauuuucuccuagcgaacuggagaccccaaacuuggcggaaagaguguuagauuggcuggagaaguacggggucgaacggcucaaaaggauggccauuuccggagacgacuguguugugaagcccaucgaugaccgcuucgcuacggcccuuaccgcacugaaugauauggguaaaguaagaaaggacaucccgcagugggagccuucaaaaggcuggaacgauuggcagcaagugcccuuuugcagucaccacuuccaucagcuaauuaugaaggacgggcgggagauagucgugccauguaggaaucaggaugaacugguuggacgagcucgugugucucagggcgccgguuggagccucagagagacagcaugcuuggggaaguccuaugcccaaauguggcagcugauguacuuucaccgccgggaccuuaggcuggcggcuaacgccaucuguucagcagucccuguggauuggauucccacuagcagaaccacauggucuauccaugcccaccaucaguggaugacuaccgaagacaugcucuccguauggaaucgcguuuggauugaggaaaacccauggauggaggauaaaacgcacaucaguagcuggggagacgugcccuauuuaggcaagcgggaggaccaauggugcggcucgcugauaggguugacagcuagggccaccugggcaacuaauauccaggucgcuauuaaccaggugcgaagacugaucggaaaugaaaacuaccucgauuacaugacauccaugaaacgguucaagaaugagucugacccugaaggugcccuuugguga

SEQ ID NO: 14083 - RNA, 9879 nt, Artificial Sequence
  derived and/or modified CDS sequence (opt3) from DENV-1__JQ045630__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaagaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacaacuccaggaaccuucaagacgcccgaaggugaggucggcgcaaucgcccuggauuuuaagccugggacaucgggaagcccaauagugaaccgagaaggcaaaaucguuggucuuuaugggaauggaguggucacuaccucaggcacauacguguccgcuauugcccaggcaaaggcuagucaggagggcccccugccugagaucgaagacgagguuuuccggaaacgcaacuugaccauuauggaucuacacccggggucuggaaagacuagaagguaucugccagccaucgugcgggaagcgauaaaacgaaagcucagaaccuuaauucuggcccccacacgcgucguggcaagcgagauggcugaagcccuuaaggguaugccuaucagguaccaaacgacugcuguaaaauccgagcauaccggcaaggagaucguggaccugaugugccacgcaacauuuaccaugcgucucuugucaccaguucggguccccaauuauaacaugauuaucauggaugaagcccauuucacugacccuucuagcauagccgcuagaggguacauuaguacaagggugggaaugggcgaggcggcagccaucuuuaugaccgcuacgccgcccgguuccguggaagccuucccacagagcaaugcagucauucaggaugaggaacgcgacaucccugagcgaucuuggaacucaggguaugaguggauaacugauuuucccggaaaaacaguaugguucgugccauccauuaagaguggcaaugacaucgccaacugucugaggaaaaauggcaagcggguuauccagcucagcaggaagaccuuugauaccgaauaccagaaaacuaagaacaacgacugggacuacguggucacaaccgauauuucggagaugggggcuaauuuccgcgcggaccgugugaucgauccuagacggugccugaaacccguuauucuuaaggacggaccagaaagggugauacuagccgguccgaugccugucacaguggcaucugcugcccagcgccgaggcagaaucgggcggaaccacaauaaagagggagaucaguauauuuacaugggccagccccugaacaaugacgaggaucaugcacacuggacugaagccaagauguuguuagacaacaucaauacgccagaggguaucauucccgcucuguucgaaccugagagggaaaaguccgccgcgauagauggggaguaucgccucagaggcgaggcaaggaaaaccuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacaaaagagggagaaaggaagaaauugcggccccgcuggcuggacgcuagaacuuacucugacccucuagcccugagggaguucaaggaauuugcugcaggucggcgauccgugagcggcgaucucauucuugagaucgggaaacugccgcagcacuuaacccagagagcccaaaaugcuuuggacaaccuggucaugcuccauaauucagaacagggaggccgcgccuauaggcacgcaauggaggagcugccagauacaauugaaacccuuaugcugcucgcguugaucgccguucugacugguggggugacguuauucuuucuaaguggccggggacugggcaagaccagcauagggcuccuuuguguaaucgcuuccucugugcuguuguggauggccagcgucgagccccauuggauugcagcuuccaucauucuggaguucuuucucauggugcugcuuaucccugagcccgaccgucagagaacaccacaggauaaccaacucgccuacguugugauaggacuguuguucaugauucugacugucgcagccaaugagauggguuuacuagaaaccacaaagaaagaccugggcaucgggcacguagcugugggaaaccaccaucacgcggccaugcucgauguugaccuucauccugcaucagcuuggacccuguacgccguggccacuacaauuaucacgcccaugaugaggcacaccauagagaacacuacagcaaauaucucuuugaccgcuauugccaaccaggcggcuauccugaugggccucgauaaggguuggccaauuaguaaaauggacaucggggucccucugcuugccuuaggcugcuauagccaggugaauccgcugacccucacagcagccgucuugaugcugguggcucauuacgcaauaauuggacccggccuacaagccaaggcgacucgcgaagcucagaaacggacggccgcagggaucaugaagaacccaaccguugauggaaucguggccauugaccuggauccuguaguguaugacgcuaaguuugagaaacagcucggccagaucaugcuucugauauuguguacaagccaaauucugcucaugcgaacuaccugggcccugugcgaauccaucacauuagcaaccgguccccuuacuacgcugugggaggggucuccaggaaaguucuggaauacaaccauugcugucucaauggccaacaucuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggauaauggaaguugaccguuccgaggccaaagaaggacugaagaggggcgagacuaccaaacacgcagugagucgggguacagcuaaguugcgcugguuugucgagcgaaaucuggugaaaccugaaggcaagguaaucgaucucggguguggaagaggcggguggagcuacuauugcgccggauuaaagaaagugacggagguuaagggcuacaccaaaggugggcccggacacgaagaaccgauuccaauggccacuuacggcuggaaccuggugaaacuucauucuggcaaagacgucuucuuuaucccucccgaaaagugugauacacugcuaugcgacauuggggaguccucaccaaaucccaccaucgaggaaggaaggacucuccgggugcugaaaauggucgagccuugguugcgcgguaaccaauucuguauuaagauccugaauccguauaugcccagcgugguugaaacacucgagcagaugcagagaaagcacggcgggaugcuuguaaggaacccacugucgcgaaauucuacccaugagauguacugggugaguugcggaacgggcaacauagucuccgcggugaauaugaccagccggauguuacugaaccguuuuacaauggcucacagaaaaccuacuuaugaacgcgauguugacuugggugcagggaccaggcacguggccgucgagcccgaaguggcuaaccucgauauuaucggacagcggaucgagaauauuaagcaugaacacaaaucaacauggcauuacgacgaggauaacccuuauaagacuugggccuaccacggcuccuaugagguaaaaccaucuggcagcgcaaguuccauggugaaugggguugucaagcugcuaaccaagcccugggacgugauaccuauggugacacaaaucgccaugaccgauacuacgccauucggacagcagagagucuuuaaagaaaagguugacacacgcacccccaaagcuaagagggguacugcgcaaauuauggaggugaccgccaaauggcuuuggggcuuccugagccgaaacaagaagccgcggaucuguacaagagaagaguuuacgaggaaaguacgcucuaaugcagcuauuggggccguguucgucgacgaaaaccaguggaacucagcaaaggaggccguggaggaugaacguuuuugggaccucguucaucgggagagagaacugcacaaacagggaaagugcgcuaccugcguguacaacaugaugggcaaaagggagaagaaguugggugaguucgggaaagccaagggaagucgcgcgaucugguacauguggcugggcgcacgauuucucgaguucgaggcccuuggcuucaugaaugaagaucacugguuuucccgggagaacagccugucuggggucgaaggagaggguuuacauaaacugggcuauauauugagagacaucucgaagauuccugggggaaauauguacgcugaugacacugccggcugggauacaaggaucaccgaggacgaucuccagaacgaagcacgcauuacugacaucauggagccagaacacgcucugcuagccaaaucaauauucaaacuuacauaucaaaauaaagugguaagaguucagcggcccgcuaagaacgguaccgugauggaugucauuagcaggcgugaccagcgaggguccggacaggugggcacauacggccugaauacuuuuaccaacauggaggcccaacucauccgccagauggaaagugaggggaucuucucuccuagcgagcuggaaacgccaaacuuggcagagagaguguuagauuggcuggaaaaguauggagucgagcggcucaaaaggauggcgauuuccggugacgacuguguugugaagcccauagaugaccgcuuugccaccgcucuuacagcccugaaugauaugggcaaaguaagaaaggacaucccgcagugggaaccuucaaaaggguggaacgauuggcagcaagugcccuucugcagucaucacuuucaccagcuaauuaugaaggacggacgggagaucgucgugccauguaggaaucaggaugagcugguuggccgagcacgugugucucagggugcuggguggagccucagagaaacugccugcuugggaaaguccuacgcacaaauguggcagcugauguauuuccaucgccgggaccuuaggcuggccgcgaacgcuauuuguucagccgucccuguggauuggauccccaccagcagaacaacuuggucuauacacgcacaucaccaguggaugaccacggaggacaugcucuccguauggaaucgcguuuggaucgaagagaacccauggauggaagauaaaacacauauuaguagcuggggcgacgugcccuacuuaggcaagcgggaggaccaauggugcgggucgcugaucggauugaccgccagggcuacuugggccacaaauauucaggucgcaaucaaccaggugcgaagacugauugguaaugagaacuaccucgauuauaugaccuccaugaaacgguuuaagaaugaaucugacccugagggcgcucuuugguga

SEQ ID NO: 14084 - RNA, 9879 nt, Artificial Sequence
  derived and/or modified CDS sequence (opt3) from DENV-1__JQ045632__SS-prME
agcgugaccaugcugcucaugcuuaugcccacggcccuggcuuuccacuugacuacgagaggaggggaaccucauaugaucgucuccaagcaggaaagggggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaacuugccgagacgcagcacgguacagucuuggugcagauaaaguacgagggcaccgacgcuccuugcaaaaucccauuccugacucaagaugaaaaggggguuacacagaacggacgccucauuaccgcgaaucccaucgugacugacaaagagaagccuguaaacauagaagcagagccacccuuuggcgagucguauauugucaucggugccggggaaaaagcucugaaacuuucuugguucaagaaaggcuccucaaucggaaagauguuugaggccaccgcaagaggcgccaggcggauggcuauucugggggauacagccugggacuucggaaguaucgguggcguguuuacgagcauugggaaauugguucaucagauauucggaaccgcauacggcgugcucuuuuccggugucucuuggacuaugaagaucgggauuggcgugcuguuaacauggcugggacuaaauagccgaucaaccagucucuccaugacauguaucgcgguaggccuggugacucuuuacuuggggguuaugguccaggcugauagcggaugcgugaucaacuggaaaggccgcgaacugaagugugguucugggauuuucgugaccaaugagguccacacguggacagaacaauauaaguuucaggccgacucaccgaaaagacucagugcagccauaggaaaggcuugggaggagggcguuugcgguaucaggagcgccacccggcuggaaaacauuauguggaaacagaucuccaacgaguuaaaucauauucugcuugaaaacgacaugaaguucacuguggugguaggcgaugucgcagggaucuuggcucagggcaagaagaugauacgcccucaacccauggagcacaaauacucuuggaagucguggggcaaggccaaaaucauuggggcggacgugcagaauaccacauuuaucauugauggaccaaacacuccugaaugucccgacgaucagagagccuggaauaucugggagguugaggacuauggcuucgguauauuuaccacaaacauuuggcucaagcugagggauagcuacacacaggugugcgaccaccgucuaauguccgcugcaaucaaagauucaaaggccguccaugcugacaugggguauuggauugaaagugagaaaaaugaaaccuggaagcuggcccgggcaucuuucaucgaggugaagacuuguauauggccaaaaagccacacacucugguccaacggaguucuggaaucagagaugaucauucccaagaucuacggcgguccuauuagccaacauaauuaucgaccaggcuacuucacccagacugcggggccguggcaccuuggaaaauuggagcuggauuuugacuuaugcgaaggcacaaccgugguagucgaugagcacugcgggaacagaggacccucucucaggacgacuaccgugacaggcaagaucauacaugaaugguguugccgcuccuguacccugccuccacuucgguucagaggugaggacgggugcugguacggaauggagauuaggcccgugaaagaaaaggaggaaaaucuggucaagaguaugguuagcgccggcucuggugagguggacuccuuuucauugggccuccuguguaucaguaucaugauugaagagguaaugcgcagccgauggucgcggaaaaugcuaaugacugggacacuggcuguguucuuucuccugaucaugggacagcuuaccuggaacgauuugauucgucugugcauaauggucggcgccaaugcauccgacagaauggggaugggaacaacuuauuuagcucucauggccaccuucaagaugaggccuauguuugcagugggccugcuuuuccgccggcugacgucuagagagguucuacuccugacaaucgguuugagccugguggccucagucgaauuaccaaacagucucgaggaacugggggauggacuugcuaugggcauuaugauccugaaauugcucaccgacuuucaaucccaccagcugugggcgacucuacugucucuuaccuucauuaagacaacuuuuagccuccauuacgccuggaaaaccauggcaauggugcuguccaucguuucauuguucccccuguguuuaagcacgacaagucagaagaccacuuggcucccggugcugcuuggcucucuggggugcaagccuuugacaauguuucucauagcugagaauaaaaucuggggaaggcgauccuggccacugaacgaagguauuauggccgucggcaucguaagcauucuacugucgucacuucucaagaacgaugugccccuggccgggccuuugaucgcuggaggcauguuaauagcauguuauguuauuucugguaguuccgccgaccugagccucgagaaagcggcugaggugucuugggaagaggaagccgagcacagcggggcaucccauaauauccuggucgaagugcaggaugacggaaccaugaagaucaaagaugaggagcgcgacgauacucuuacaauucuguugaaggccacccuacuggcuguaucaggcguguacccccucaguauaccagcaacgcuguucgucugguauuucuggcagaaaaagaagcagcggagcggcguucuuugggacacuccuucucccccagaaguggagagagccguguuagaugacgggaucuacaggauuaugcagcguggacugcucggucgcucccaggucggcguggggguuuuucaagaaaacguauuccacaccauguggcacgugacacggggagcggucuugauguaucagggcaaaagacuggagccgucaugggcuagugugaagaaagaccucaucagcuacggugggggauggaggcugcagggcuccuggaauaccggcgaggaaguucaggugauugccgucgagccugggaagaaccccaaaaaugugcaaacagcaccaggaacuuuuaagacccccgaaggugagguaggcgccaucgcucuugauuucaagccugggacgucuggaucgccaauagucaaccgagaaggcaaaaucgugggucuguacgggaauggaguugugacaacuagcggcaccuaugucucagccauugcacaggcuaaggccucccaggagggccccuugccugagaucgaagacgagguguuucggaaacgcaaccuaacaauuauggaucugcauccggggaguggaaagaccagaagguaccucccagcgaucguucgggaagccauaaaacgaaaguuaagaacucugauucuugcacccacccgcguggucgcuucugagauggccgaagcucugaaggguaugccuaucagguaucaaacaacggcagugaaaagcgagcacacuggcaaggagaucguagaccucaugugccaugccaccuucacaaugcguuugcuguccccagugcggguucccaauuacaacaugauuaucauggaugaagcccacuuuaccgacccuucaucuauagcugcgagaggguauauuagcacuagggucggaaugggcgaggcagccgcuaucuucaugacagccaccccgcccgguaguguggaagcauuuccacaguccaaugccgugauucaggaugaggaacgcgacaucccugagcgaagcuggaacucuggguacgaguggauaacggauuuccccggaaaaacugucugguuuguaccaucaauuaaguccggcaaugacaucgcuaacugucucaaaaagaauggcaagagagugauccagcugagucggaaaacauucgauaccgaauaucaaaagaccaaaaacaacgacugggacuacguugugacuacagauauuagcgagaugggggcgaauuucagggccgaccgcgucaucgauccucguagaugccuuaagcccgugauucuaaaagacggaccagaacggguuauacuggcagguccgaugccugugaccgucgcuucggccgcacagaggcgcggccgaaucgggagaaaccauaauaaggagggagaucaguacauuuauaugggccagcccuugaacaaugacgaggaucacgcccacuggacagaagcuaagauguuacuggacaacaucaauacuccagaggguaucauucccgcccucuuugaaccugagcgggaaaaaucugcggcaauagauggggaguacaggcugcgcggcgaggccagaaagacguucguggaacuuaugaggcggggagaccugccaguauggcucuccuauaaaguggcuagcgagggcuuucaauacucagaucgucgcuggugcuucgacggggaacgaaacaaucagguuuuggaggaaaacauggaugucgagaucuggaccaaggagggagaaaggaaaaagcugaggccccgguggcuagacgcccgcacauauagugacccucuggcucucagagaguuuaaagaguucgcagccgguaggcggucuguguccggcgaucuuauucuggagaucgggaaguuaccgcagcauuugacucagcgagcucaaaaugcccuggacaaccucgugaugcugcacaauagcgaacagggaggcagagcauaccgccaugcgauggaggagcuuccagauaccauugaaacacugauccucuuggcccugauagcugucuuaaccggugggguuacucuauuuuuccugucaggcaggggacucggcaagacgaguaucgggcuucugugugugauggccagcuccguauugcuguggauggcaucuguggagccccacuggauugcugccagcaucauucucgaauuuuuccugaugguccuucucaucccugagcccgaccggcagcguaccccacaggauaaccaacuggcauaugugguuauaggauugcuguuuaugauuuuaacaguggccgcuaaugagaugggucuacuggaaacuaccaaaaaggaccucggcaucgggcacgucgcgguagagaaccaucaccaugccgcaaugcuugauguggaccugcacccugcuuccgccuggacauuguacgccguugcaaccacuauuaucacacccaugaugagacauacgauagaaaacaccacugcuaauaucucacugacagccauugcgaaccaggcugccauccucaugggacuggauaaaggcuggccaauuucuaagauggacaucggugugccucuuuuagcacuggggugcuacagucaggucaauccgcucaccuugaccgccgcugugcugaugcuagucgcacacuaugccauaauuggccccggacugcaagcgaaagcuacaagggaggcccagaagcgcacugcagccggcaucaugaagaacccaacgguggaugggaucguugcuauugaccucgauccugugguauacgacgccaaauucgaaaagcagcuuggacagaucaugcuguugauacuguguaccucgcaaauucuccugaugcggacaacuugggcauuaugcgagagcaucacccuugcuacaggcccccugaccacucucugggaggguuccccagggaaauuuuggaauacgacaauugccgugucuauggcgaacaucuuccgaggaucauaucuagccggcgcaggucuggcuuucagcuugaugaagucccugggcgggggaagaaggggcaccggggcccagggagaaacucucggcgagaaauggaagcgccagcuuaaucagcugaguaagucugaauuuaacaccuacaaacggagcgguauaauggaggucgacagaucagaagcaaaggagggguugaaacguggagagacaacuaagcacgcuguuuccaggggcaccgccaaacugcggugguucguggaacgcaaucucgucaagccugaggguaaggugaucgauuuaggcugugggcgaggaggcuggaguuauuacugcgccgggcugaaaaagguaacagaagugaaaggauauacgaagggcggucccgggcaugaggaaccgauuccaauggcgaccuacggauggaaccuuguuaaacugcacagcggcaaggacguguuuuucaucccucccgagaaaugugauacucuacucugcgacauuggcgagucuuccccaaaucccacaaucgaagaggggagaacccugagggucuugaagaugguggaaccuuggcugcggggaaaccaauuuuguauuaagguccucaauccguacaugcccucagugguugagacucuugagcagaugcagcgcaaacaugguggcaugcugguaagaaacccauuaagcagaaauucgacacacgaaauguauugggugucuugcgggaccggaaacaucgucagugcugugaauaugacgucccgaaugcuguugaaccgguucaccauggcacaccguaagccuacauacgagagagauguugaccucggcgccgguacucgccauguggcugucgaacccgagguggccaaccuggauauaauugggcagaggaucgaaaauaucaaacacgagcauaagagcaccuggcacuaugacgaggauaacccuuacaaaacaugggcauaucauggaucauacgaaguaaagccauccggcucugccagcaguauggugaauggcguugucaagcuacuuacuaaacccugggacgugauuccuauggugacccaaauagcuaugacagauaccacuccauuugggcagcagcgggucuucaaggagaaaguugacacgagaacacccaaggcgaaacgcggaaccgcccaaaucauggaagugacugcaaaguggcugugggguuuucucuccaggaacaagaaaccgcgaauuuguacccgggaggaguucacaagaaagguaaggagcaaugcugccaucggcgcaguguuugucgacgagaaccaguggaacucugccaaagaggcuguggaagaugagcgcuucugggaccugguucaccgugaacgggaguugcacaagcaggggaaaugcgccacgugcguguauaacaugaugggaaagagagaaaagaaacugggcgaguuugguaaggcgaaagggucaagggcaauuugguacauguggcucggagcccgcuuccuugaguucgaagcucugggcuuuaugaaugaggaucauugguucagucgagaaaacuccuuaagcggcgucgagggggagggacugcacaaguuggguuacauccuccgggacauaucuaaaaucccuggcgggaauauguaugccgaugacaccgcaggaugggauacuagaauuacagaagacgaucugcagaacgaggcuaggaucaccgacauuauggaaccagagcaugcccuacuugcuaagucgaucuuuaaacugacuuaccaaaauaaggugguacgcguucagagacccgccaagaacggcacagugauggaugucauaucacggagggaccagcgugguagcggacaggugggaaccuauggccucaauacauucacuaacauggaagcacaacugauucgacagauggaguccgagggcaucuuuaguccuucugaauuggagaccccaaacuuagcggaacgcgugcuggauuggcucgagaaauacggggucgaaagacuuaagcggauggccaucagcggagacgacuguguugugaaacccauugaugacagguucgcuacggcccugaccgcacuaaaugauauggguaagguacgcaaagacauaccgcagugggagccuuccaagggcuggaacgauuggcagcaagugcccuuuugcucacaccacuuccaucagcugaucaugaaggacgggagagagauugucgugccaugucggaaucaggaugaacucguuggaagggcucgagugagucagggcgccgguuggucuuugcgugagacagcaugccuggggaaaagcuaugcccaaauguggcagcuuauguacuuucacagacgcgaccugcggcucgcggcuaacgccaucuguuccgcagucccuguggauuggauucccacuucaaggaccacauggagcauccaugcccaccaucaguggaugacuaccgaagacauguuaucuguauggaauagaguuuggauagaggaaaacccauggauggaggauaagacgcacaucuccaguuggggagacgugcccuaucugggcaaacgcgaggaccaauggugcggcagcuugauugggcugacagcucgggccaccugggcaacuaauauccaggucgcuauuaaccaggugaggcgacucaucggaaaugaaaacuaccuugauuacaugacaucgaugaagagauucaaaaaugaguccgacccugaaggugcccugugguga

SEQ ID NO: 14085 - RNA, 9879 nt, Artificial Sequence
  derived and/or modified CDS sequence (opt3) from DENV-1__JQ045633__SS-prME
agcgugaccaugcugcucaugcuuaugcccaccgcccuggcuuuccacuugacuacgagaggaggggaaccucauaugaucgucuccaagcaggaaagaggaaaaucuuuacuguuuaagaccucagccgguguuaauaugugcacacucauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcgcaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcuggcggacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaacuugcugagacccagcacgguacggucuuggugcagauaaaguacgagggcacagacgcgccuugcaaaaucccauucucgacccaagaugaaaaggggguuacucagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccguugggaaacuggugcaucagauuuucggagcggcuuacggcgucuuguuuucuggugugagcuggacgaugaagauagggaucggcguacuccugaccugguuaggacuaaauucacgaaguacuucccuaagcaugacauguauugccgugggccucguuacccuguaccuuggggucauggugcaggcagauucuggaugcgugaucaacuggaaaggccgcgaauugaagugugguucagggaucuucgucacaaaugagguucacacuuggaccgaacaauauaaguuucaggccgacaguccgaaaagacugagcgcugccauuggaaaggcaugggaggagggcgugugcgguauaagguccgcuacgcggcucgaaaacaucauguggaaacagauuucuaacgagcugaaucauaucuuacuggaaaacgacaugaaguucacagugguagucggcgauguggccgggauucuugcgcagggcaaaaagaugauccgcccucaacccauggaguacaaauauucguggaaaagcuggggcaaggccaagauaaucggggcugacguucagaauaccacuuuuauuaucgauggacagaacaccccagaauguccugacgaucagagagcauggaauauuugggagguggaggacuacggcuucgguaucuuuacaacuaacauaugguugaagcucagggauuccuauacccaagucugcgaccaccgucugaugucagccgcuauuaaagauaguaaggccgugcacgcagacaugggguacuggaucgaaucugagaaaaaugaaacauggaagcuagcgcgggccagcuucauugagguuaagacguguaucuggcccaaaucccauacccuguggucaaacggagugcucgaaagcgagaugauaaucccaaagauuuauggcggucccaucucucagcacaauuaccgaccuggcuacuucacucagacagcugggccauggcaucugggaaaacuugaguuggauuuugaccugugcgaaggcaccacuguagucguggaugagcacugcgggaacagaggaccguccuuaaggacaaccacggugacuggcaagauuauccacgaaugguguugccgcaguuguacccuacccccucugcgguucagaggugaggacgggugcugguauggaauggagauaaggccagucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacagggacccuagcagucuuccugcuccugauuaugggacaacuuacuuggaacgauuugauccgucugugcauuauggugggcgcuaaugccucugacagaauggggaugggaacaaccuacuuagcacucauggccacauuuaagaugaggcccauguucgcuguuggccugcuuuuucgccggcugacuagcagagaggugcuacuccugaccauagguuugucacuggucgcgaguguggaauuaccuaacucccucgaggaacugggggauggacuugccaugggcaucaugauucugaaauugcucacggacuuccagucucaucagcugugggcaacacuacugagccuuaccuuuaucaagacuaccuucucccuccacuaugcuuggaaaacaauggccaugguucugucaauugugagcuuguuuccacuguguuuaaguacuaccucucagaagacgacauggcuccccguccugcuuggcucccuggggugcaagccguugaccauguuccucaucgccgagaauaaaauauggggaaggcgaagcuggccucugaacgaagguaucauggcuguaggcauugugucgauccuacugucaucucuucucaagaacgauguuccacuggcagggcccuugauugccggaggcauguuaaucgcguguuacgugauaagugguuccagcgcugaccugucucucgagaaagccgcagaggucagcugggaagaggaagccgagcauuccggggcuucacacaauauucugguggaaguacaagaugacggaacuaugaagaucaaagaugaggagcgcgacgauacacuuaccauccuguugaaggcaacucuacuggccgugaguggcgucuauccucucagcauucccgcgacacuguuuguuugguacuucuggcagaaaaagaagcagcggucuggcgugcuuugggacaccccauccccucccgaaguggagagagcugucuuagaugacgggauauauaggaucaugcagcguggacugcucggucgcucacaagugggcguugggguauuccaggaaaacguguuucauacgauguggcacgucacucggggagccguguugauguaccagggcaaaagacuggagccaaguugggcaagcguuaagaaagaccucauuuccuacggugggggauggaggcugcagggcucuuggaauaccggcgaggaagugcaagucaucgccguggagccggggaagaacccuaaaaauguacagacagcucccggaaccuucaagacaccagaaggugaggucggcgccauugcacuugauuuuaagcccgggacuucgggaagcccuaucgugaaccgagaaggcaaaauaguuggucuguaugggaauggaguggucaccacgucaggcacauacguguccgcuaucgcccaggcgaagguuagucaagagggcccauugcccgagauugaagacgagguguuccggaaacgcaaccuaacuaucauggaucugcacccugggucuggaaagaccagaagguaucucccggccauuguccgggaagcaaucaaacgaaaguuaagaacacugauacuugcuccaacccgcgugguagccagcgagauggcugaagcacugaaggguaugcccauuagguaccagacuaccgccgugaaauccgagcauacaggcaaggagaucguugaccucaugugccacgccacguuuacuaugcguuugcugucaccuguccgggugccaaauuauaacaugaucauuauggaugaagcucauuucaccgaccccucuagcaucgcggcaagaggguacauaaguacaagggugggaaugggcgaggccgcugccauuuuuaugaccgcaacuccuccggguuccgucgaagccuucccccagagcaaugcuguaauccaggaugaggaacgcgacauuccagagcgaucuuggaacucaggguaugaguggaucacagauuuuccuggaaaaaccgugugguucguucccuccauaaagaguggcaaugacauugcgaacugucucaggaaaaauggcaagcgggugauccaacugagcaggaagacguuugauacugaauaccagaaaacaaagaacaacgacugggacuacgucgugaccaccgauaucucggagaugggggccaauuuccgcgcagaccguguuauugauccaagacggugccuuaaaccugugauccuaaaggacggacccgaaagggucauucuggcugguccaaugccggugacuguagccucugcagcccagcgccgaggcagaauagggcggaaccacaauaaagagggagaucaguauaucuacaugggccaaccuuugaacaaugacgaggaucaugcucacuggacagaagccaagauguuacuggacaacauuaauacccccgaggguaucaucccagcacucuucgaacccgagagggaaaaguccgcagccauugauggggaguaucgccugagaggcgaggcuaggaaaacauuuguggaacuuaugcggcguggagaccugccuguuuggcucagcuacaaggucgccucagagggcuuccaguauagugaucgccgauggugcuuugacggggaaagaaacaaucagguguuggaggaaaacauggauguggagauauggacuaaagagggagaaaggaagaaacugcggccacgcuggcuagacgcuagaacguacucugacccccuggcacucagggaguucaaggaauuugccgcuggucggcgauccgucagcggcgaucuuauccuggagauugggaaauuaccucagcacuugacccaaagagcccagaaugcacuggacaaccucguuaugcugcauaauucagaacagggaggccgcgcguauaggcacgccauggaggagcuuccggauacaaucgaaacucugaugcucuuggcucugauugccguguuaaccggugggguaacacuauucuuucugaguggccggggacucggcaagaccagcaucgggcuucugugugugauggcauccucugucuugcuguggauggcuagcguggagccacauuggauagccgcauccaucauucucgaguucuuucugaugguucuucucauccccgagccugaccgucagagaacuccccaagauaaccagcuggccuacguggucauuggauugcuguucaugaucuuaacgguagcugcgaaugagaugggucuacuggaaaccacaaagaaagaccucggcauagggcacguggccguugagaaccaccaucacgcagcuaugcuugauguggaccugcauccagccucagccuggacuuuguacgcagucgcuaccacaauuaucaccccuaugaugaggcacacuauugaaaacacaacggccaauaucucucugaccgcgauagcuaaccaggccgcaauccucaugggacuggauaagggcuggcccauuaguaaaauggacaucggugugccacuuuuagcccuggggugcuauucgcaagucaauccucucacuuugacagcugcagugcugaugcuaguugcccauuacgcgauuaucggcccgggacugcaggcuaaggccacccgcgaggcacagaaacggaccgccgcuggcauaaugaagaaccccacaguggaugggauuguagccaucgaccucgauccaguggucuaugacgcaaaguuugaaaaacagcuuggacaaaucaugcuguugauucuguguacuagccagauccuccugaugcgaacgaccugggcuuuaugcgaguccauaacacuugccacuggcccucugaccacacucugggaggguucucccgggaaguucuggaauaccacuauugcgguuucaauggccaacaucuuuagaggaagcuaccuagcaggcgcuggucuggccuucuccuugaugaaaagucugggcgggggaaggcgcggcacgggggcacagggagaaacacucggcgagaaguggaaacggcagcuuaaucaacugucuaagagcgaguucaacaccuauaagagaucagguauuauggagguggaccguuccgaagcuaaagagggguugaagaggggagagacuaccaaauacgccgucagucggggcacagccaagcugcgcugguuuguggaacgaaaucucguaaaaccagaggguaaggugaucgauuuaggcugugggagaggaggcuggagcuauuacugcgcggggcugaagaaaguuacugaagugaagggauacaccaaaggcgguccugggcacgaggaacccauaccgauggcuacauauggauggaaccuugucaagcugcacucuggcaaagacguguucuuugucccaccugagaagugugauacgcuacucugcgacaucggcgaguccucacccaauccaaccauugaagaggggaggacucugcggguguugaaaaugguugaacccuggcugcgcggaaaccaguucuguaucaagauucucaauccuuacaugccgagcguaguggagacacuugagcagaugcagagaaagcaugguggcaugcuggucaggaaccccuuaucgcgaaauucuacccacgaaauguauugggugaguugcgggacuggaaacaucguuuccgcagugaauaugacaagccggaugcuguugaaccguuuuaccauggcccauagaaaaccaacguacgagcgcgaugucgaccucggcgcugguaccaggcacguggccguagaaccugagguggcaaaccuggauauuaucgggcaacggauagaaaauauuaagcacgagcauaaaucaacauggcacuaugacgaggauaaccccuacaagacuugggccuaucauggauccuacgaaguuaaaccuucuggcagcgcuaguuccauggucaauggcguggugaagcuacuuaccaagccaugggacgucauccccaugguuacacagaucgcgaugacugauaccacaccuuucgggcagcaaagaguguuuaaagagaagguagacacccgcacuccaaaagccaagaggggaacggcacagauuauggaagugacagcuaaauggcugugggguuuccucagccgaaacaagaagccccggauauguaccagagaggaauuuacuaggaaaguccgcucuaaugccgcaaucggcgccguguucguugacgagaaccaguggaacucagcuaaggaggccguggaagaugagcguuuuugggaccugguccaccgggaaagagaguugcauaaacaggggaagugcgcgaccugcguguacaacaugaugggaaaaagggaaaagaagcugggcgaguucgguaaagcaaaggggagucgcgccauuugguauauguggcucggagcucgauuucuugaguucgaagcccugggcuucaugaaugaggaucacugguuuucccgggaaaacagcuuaucuggcguagagggggagggacugcacaaauuggguuacauccucagagacauuucgaagaucccgggcgggaauauguaugcagaugacacagcuggaugggauacgaggauaaccgaagacgaucugcaaaacgaggcccgcaucacugacauuauggaaccugagcaugcucuacuugccaaaucaaucuucaagcugacauaccagaauaaaguugugagaguccagcggccagcaaagaacggcaccgugauggaugugauuagcaggcgugaccagcgagguuccgggcaagucggaacuuauggccucaauacauuuaccaacauggaagcgcagcugauccgccagauggagagugagggcauauucucucccagcgaauuggagacaccuaacuuagccgaaagaguucuggauuggcucgagaaguacgggguggaacggcuuaaaaggauggcuauuuccggagacgacuguguagugaagccaaucgaugaccgcuuugccacugcacugaccgcucuaaaugauauggguaaagucagaaaggacaucccccagugggagccgucaaaaggcuggaacgauuggcaacaggugccuuucugcagucaccauuuucaccagcugauuaugaaggacgggcgggagauaguugugcccuguaggaaucaggaugaacucgucggacgagcccgugugucucaaggcgcagguuggagcuugagagagacggccugccuggggaaguccuaugcgcagauguggcagcuuauguacuuccaccgccgggaccugaggcucgcugccaacgcaaucuguucagccguaccaguugauuggauuccuaccagcagaacaacuuggucuauccaugcucaccaucaauggaugaccacagaagacauguuauccguguggaaucgcgucuggauugaggaaaaccccuggauggaggauaaaacucacaucaguagcuggggagacgugccauaccugggcaagcgggaggaccaguggugcggcucguugauagggcugaccgccagggcaacgugggcuacaaauauccagguugccauuaaccaggugcgaagacucaucggaaaugaaaacuaucuugauuacaugaccuccaugaaacgguuuaagaaugagucugaccccgaaggugcgcugugguga

SEQ ID NO: 14086 - RNA, 9879 nt, Artificial Sequence
  derived and/or modified CDS sequence (opt3) from DENV-1__JQ045634__SS-prME
agcgugaccaugcugcucaugcuuaugcccaccgcccuggcuuuccacuugacuacgagaggaggggaaccucauaugaucgucuccaagcaggaaagagggaaaucuuuacuguuuaagaccucagccgguguuaauaugugcacacucauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcgcaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcuggcggacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaacuugcugagacccagcacgguacggucuuggugcagauaaaguacgagggcacagacgcgccuugcaaaaucccauucucgacccaagaugaaaaggggguuacucagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccguugggaaacuggugcaucagauuuucggagcggcuuacggcgucuuguuuucuggugugagcuggacgaugaagauagggaucggcguacuccugaccugguuaggacuaaauucacgaaguacuucccuaagcaugacauguauugccgugggccucguuacccuguaccuuggggucauggugcaggcagauucuggaugcgugaucaacuggaaaggccgcgaauugaagugugguucagggaucuucgucacaaaugagguucacacuuggaccgaacaauauaaguuucaggccgacaguccgaaaagacugagcgcugccauuggaaaggcaugggaggagggcgugugcgguauaagguccgcuacgcggcucgaaaacaucauguggaaacagauuucuaacgagcugaaucauaucuuacuggaaaacgacaugaaguucacagugguagucggcgauguggccgggauucuugcgcagggcaaaaagaugauccgcccucaacccauggaguacaaauauucguggaaaagcuggggcaaggccaagauaaucggggcugacguucagaauaccacuuuuauuaucgauggacagaacaccccagaauguccugacgaucagagagcauggaauauuugggagguggaggacuacggcuucgguaucuuuacaacuaacauaugguugaagcucagggauuccuauacccaagucugcgaccaccgucugaugucagccgcuauuaaagauaguaaggccgugcacgcagacaugggguacuggaucgaaucugagaaaaaugaaacauggaagcuagcgcgggccagcuucauugagguuaagacguguaucuggcccaaaucccauacccuguggucaaacggagugcucgaaagcgagaugauaaucccaaagauuuauggcggucccaucucucagcacaauuaccgaccuggcuacuucacucagacagcugggccauggcaucugggaaaacuugaguuggauuuugaccugugcgaaggcaccacuguagucguggaugagcacugcgggaacagaggaccguccuuaaggacaaccacggugacuggcaagauuauccacgaaugguguugccgcaguuguacccuacccccucugcgguucagaggugaggacgggugcugguauggaauggagauaaggccagucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacagggacccuagcagucuuccugcuccugauuaugggacaacuuacuuggaacgauuugauccgucugugcauuauggugggcgcuaaugccucugacagaauggggaugggaacaaccuacuuagcacucauggccacauuuaagaugaggcccauguucgcuguuggccugcuuuuucgccggcugacuagcagagaggugcuacuccugaccauagguuugucacuggucgcgaguguggaauuaccuaacucccucgaggaacugggggauggacuugccaugggcaucaugauucugaaauugcucacggacuuccagucucaucagcugugggcaacacuacugagccuuaccuuuaucaagacuaccuucucccuccacuaugcuuggaaaacaauggccaugguucugucaauugugagcuuguuuccacuguguuuaaguacuaccucucagaagacgacauggcuccccguccugcuuggcucccuggggugcaagccguugaccauguuccucaucgccgagaauaaaauauggggaaggcgaagcuggccucugaacgaagguaucauggcuguaggcauugugucgauccuacugucaucucuucucaagaacgauguuccacuggcagggcccuugauugccggaggcauguuaaucgcguguuacgugauaagugguuccagcgcugaccugucucucgagaaagccgcagaggucagcugggaagaggaagccgagcauuccggggcuucacacaauauucugguggaaguacaagaugacggaacuaugaagaucaaagaugaggagcgcgacgauacacuuaccauccuguugaaggcaacucuacuggccgugaguggcgucuauccucucagcauucccgcgacacuguuuguuugguacuucuggcagaaaaagaagcagcggucuggcgugcuuugggacaccccauccccucccgaaguggagagagcugucuuagaugacgggauauauaggaucaugcagcguggacugcucggucgcucacaagugggcguugggguauuccaggaaaacguguuucauacgauguggcacgucacucggggagccguguugauguaccagggcaaaagacuggagccaaguugggcaagcguuaagaaagaccucauuuccuacggugggggauggaggcugcagggcucuuggaauaccggcgaggaagugcaagucaucgccguggagccggggaagaacccuaaaaauguacagacagcucccggaaccuucaagacaccagaaggugaggucggcgccauugcacuugauuuuaagcccgggacuucgggaagcccuaucgugaaccgagaaggcaaaauaguuggucuguaugggaauggaguggucaccacgucaggcacauacguguccgcuaucgcccaggcgaagguuagucaagagggcccauugcccgagauugaagacgagguguuccggaaacgcaaccuaacuaucauggaucugcacccugggucuggaaagaccagaagguaucucccggccauuguccgggaagcaaucaaacgaaaguuaagaacacugauacuugcuccaacccgcgugguagccagcgagauggcugaagcacugaaggguaugcccauuagguaccagacuaccgccgugaaauccgagcauacaggcaaggagaucguugaccucaugugccacgccacguuuacuaugcguuugcugucaccuguccgggugccaaauuauaacaugaucauuauggaugaagcucauuucaccgaccccucuagcaucgcggcaagaggguacauaaguacaagggugggaaugggcgaggccgcugccauuuuuaugaccgcaacuccuccggguuccgucgaagccuucccccagagcaaugcuguaauccaggaugaggaacgcgacauuccagagcgaucuuggaacucaggguaugaguggaucacagauuuuccuggaaaaaccgugugguucguucccuccauaaagaguggcaaugacauugcgaacugucucaggaaaaauggcaagcgggugauccaacugagcaggaagacguuugauacugaauaccagaaaacaaagaacaacgacugggacuacgucgugaccaccgauaucucggagaugggggccaauuuccgcgcagaccguguuauugauccaagacggugccuuaaaccugugauccuaaaggacggacccgaaagggucauucuggcugguccaaugccggugacuguagccucugcagcccagcgccgaggcagaauagggcggaaccacaauaaagagggagaucaguauaucuacaugggccaaccuuugaacaaugacgaggaucaugcucacuggacagaagccaagauguuacuggacaacauuaauacccccgaggguaucaucccagcacucuucgaacccgagagggaaaaguccgcagccauugauggggaguaucgccugagaggcgaggcuaggaaaacauuuguggaacuuaugcggcguggagaccugccuguuuggcucagcuacaaggucgccucagagggcuuccaguauagugaucgccgauggugcuuugacggggaaagaaacaaucagguguuggaggaaaacauggauguggagauauggacuaaagagggagaaaggaagaaacugcggccacgcuggcuagacgcuagaacguacucugacccccuggcacucagggaguucaaggaauuugccgcuggucggcgauccgucagcggcgaucuuauccuggagauugggaaauuaccucagcacuugacccaaagagcccagaaugcacuggacaaccucguuaugcugcauaauucagaacagggaggccgcgcguauaggcacgccauggaggagcuuccggauacaaucgaaacucugaugcucuuggcucugauugccguguuaaccggugggguaacacuauucuuucugaguggccggggacucggcaagaccagcaucgggcuucugugugugauggcauccucugucuugcuguggauggcuagcguggagccacauuggauagccgcauccaucauucucgaguucuuucugaugguucuucucauccccgagccugaccgucagagaacuccccaagauaaccagcuggccuacguggucauuggauugcuguucaugaucuuaacgguagcugcgaaugagaugggucuacuggaaaccacaaagaaagaccucggcauagggcacguggccguugagaaccaccaucacgcagcuaugcuugauguggaccugcauccagccucagccuggacuuuguacgcagucgcuaccacaauuaucaccccuaugaugaggcacacuauugaaaacacaacggccaauaucucucugaccgcgauagcuaaccaggccgcaauccucaugggacuggauaagggcuggcccauuaguaaaauggacaucggugugccacuuuuagcccuggggugcuauucgcaagucaauccucucacuuugacagcugcagugcugaugcuaguugcccauuacgcgauuaucggcccgggacugcaggcuaaggccacccgcgaggcacagaaacggaccgccgcuggcauaaugaagaaccccacaguggaugggauuguagccaucgaccucgauccaguggucuaugacgcaaaguuugaaaaacagcuuggacaaaucaugcuguugauucuguguacuagccagauccuccugaugcgaacgaccugggcuuuaugcgaguccauaacacuugccacuggcccucugaccacacucugggaggguucucccgggaaguucuggaauaccacuauugcgguuucaauggccaacaucuuuagaggaagcuaccuagcaggcgcuggucuggccuucuccuugaugaaaagucugggcgggggaaggcgcggcacgggggcacagggagaaacacucggcgagaaguggaaacggcagcuuaaucaacugucuaagagcgaguucaacaccuauaagagaucagguauuauggagguggaccguuccgaagcuaaagagggguugaagaggggagagacuaccaaauacgccgucagucggggcacagccaagcugcgcugguuuguggaacgaaaucucguaaaaccagaggguaaggugaucgauuuaggcugugggagaggaggcugggcguauuacugcgcugggcugaagaaaguuacugaagugaagggauacaccaaaggcgguccugggcacgaggaacccauaccgauggcaacauauggauggaaccuugucaagcugcacagcggcaaagacguguucuuugucccaccugagaagugugauacgcuacucugcgacaucggcgagucuucccccaauccaaccauugaagaggggaggacucugcggguguugaaaaugguugaacccuggcugcgcggaaaccaguucuguaucaagauucucaauccuuacaugccgucaguaguggagacacuugagcagaugcagagaaagcaugguggcaugcuggucaggaaccccuuaagccgaaauucgacccacgaaauguauugggugucuugcgggacuggaaacaucguuagugccgugaauaugacaucccggaugcuguugaaccguuuuaccauggcucauagaaaaccaacguacgagcgcgaugucgaccucggcgccgguaccaggcacguggcaguagaaccugagguggccaaccuggauauuaucgggcaacggauagaaaauauuaagcacgagcauaaaagcacauggcacuaugacgaggauaaccccuacaagacuugggcuuaucauggaucauacgaaguuaaaccuuccggcucugcgagcaguauggucaauggcguggugaagcuacuuaccaagccaugggacgucauccccaugguuacacagaucgccaugacugauaccacaccuuucgggcagcaaagaguguuuaaagagaagguagacacccgcacuccaaaagcaaagaggggaacggcucagauuauggaagugacagccaaauggcugugggguuuccucucccgaaacaagaagccccggauauguaccagagaggaauuuacuaggaaaguccgcagcaaugcagccaucggcgcuguguucguugacgagaaccaguggaacucugccaaggaggcgguggaagaugagcguuuuugggaccugguccaccgggaaagagaguugcauaaacaggggaagugcgcaaccugcguguacaacaugaugggaaaaagggaaaagaagcugggcgaguucgguaaagccaaggggucacgcgcuauuugguauauguggcucggagcccgauuucuugaguucgaagcacugggcuucaugaaugaggaucacugguuuagucgggaaaacuccuuaagcggcguagagggggagggacugcacaaauuggguuacauccucagagacauuucuaagaucccgggcgggaauauguaugcugaugacacagccggaugggauacgaggauaaccgaagacgaucugcaaaacgaggcucgcaucacugacauuauggaaccugagcaugcccuacuugcaaaaucgaucuucaagcugacauaccagaauaaaguugugagaguccagcggccagcgaagaacggcaccgugauggaugugauuucaaggcgugaccagcgagguagcgggcaagucggaacuuauggccucaauacauuuaccaacauggaagcccagcugauccgccagauggaguccgagggcauauucagucccucugaauuggagacaccuaacuuagcugaaagaguucuggauuggcucgagaaguacgggguggaacggcuuaaaaggauggccauuagcggagacgacuguguagugaagccaaucgaugaccgcuuugcaacugcucugaccgcccuaaaugauauggguaaagucagaaaggacaucccccagugggagccguccaaaggcuggaacgauuggcaacaggugccuuucugcucacaccauuuucaccagcugauuaugaaggacgggcgggagauaguugugcccuguaggaaucaggaugaacucgucggacgagcacgugugagucaaggcgccgguuggucuuugagagagacggcgugccugggaaagagcuaugcucagauguggcagcuuauguacuuccaccgccgggaccugaggcucgccgcaaacgccaucuguuccgcuguaccaguugauuggauuccuaccucaagaacaacuuggagcauccaugcccaccaucaauggaugaccacagaagacauguuaucuguguggaaucgcgucuggauugaggaaaaccccuggauggaggauaaaacucacaucuccaguuggggagacgugccauaccugggcaagcgggaggaccaguggugcggcagcuugauagggcugaccgcaagggcuacgugggccacaaauauccagguugcgauuaaccaggugcgaagacucaucggaaaugaaaacuaucuugauuacaugaccucgaugaaacgguuuaagaaugaguccgaccccgaaggugcucugugguga

SEQ ID NO: 14087 - RNA, 9879 nt, Artificial Sequence
  derived and/or modified CDS sequence (opt3) from DENV-1__JQ045636__SS-prME
agcgugaccaugcugcucaugcuuaugcccaccgcacuggcuuuccacuugacuacgagaggaggggaaccucauaugaucgucuccaagcaggaaagagggaagucuuuacuguuuaagaccucagccgguguuaacaugugcacccuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgauugccacaaucacaccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggcaggaccuucugguaacuuuuaaaacagcucacgccaagaagcaggaaguuguggucuuggguucucaagagggggcuaugcacaccgcccucacaggcgcaacugaaauucagaccuccggaacgaccacaauauucgccggccaucugaaaugccguuuaaagauggauaaacugacucuaaaggggaugagcuaugugauguguaccggaucguucaaacucgagaaggaagucgcugagacacagcacgguacugugcugguucagaucaaguacgagggcaccgacgcgccuugcaaaauuccauuuucuacgcaagaugaaaagggggcaacacagaacggacgccuuaucaccgccaaucccauagugacugacaaagagaagccuguaaacauugaagcugagccacccuucggcgaguccuauaucgucaucggugccggggaaaaagcauugaagcugucaugguuuaagaaaggcaguagcauuggaaagauguucgaggccacagcuagaggcgccaggcggauggcaauccucggggauaccgcgugggacuuuggauccauugguggcguguucacuucuguugggaaacuggugcaucagauauuuggaaccgcuuacggcguccuuuucagcggugugucauggacaaugaagaucgggauuggcguacuguugacguggcucggacugaauagucgauccaccagcuuaucuaugacuuguaucgccgugggccugguuacacuauaccucggggucauggugcaggcagauucaggaugcgugaucaacuggaaaggccgcgaacugaagugugguagugggauuuuugucaccaaugagguucacacauggacugaacaauauaaguuccaggccgacagcccgaaaagacuuuccgcugccauaggaaaggcaugggaggagggcgugugcgguaucaggucugcuacccgguuggaaaacauuauguggaaacagaucucgaacgagcugaaucauauucuccuggaaaacgacaugaaguuaacggugguagucggcgauguggccgggauccuggcgcagggcaagaagaugauacgcccucaacccauggaguacaaauauagcuggaaguccuggggcaaggccaaaaucauuggggcugacguucagaauacaaccuuuaucauugauggaccaaacacuccugaaugucccgacgaucagagagcauggaauaucugggagguggaggacuacggcuucgguauauuuaccacaaacauuuggcuuaaguugagggauucauauacucaggucugcgaccaccgucucaugagugccgcuaucaaagauucuaaggccgugcacgcagacaugggguacuggauugaaagcgagaaaaaugaaaccuggaagcuggcgcgggccuccuucaucgagguuaagacauguauauggccaaaaucacauacgcuauggagcaacggagugcuggaaucugagaugaucauucccaagaucuauggcgguccuauuucccaacacaauuaccgaccaggcuacuucacccagacugcugggccguggcaucucggaaaacuggagcuugauuuugacuugugcgaaggcacaaccguagucguggaugagcacugcgggaacagaggacccagucugaggacuacaaccgugacgggcaagaucauacacgaaugguguugccgcagcuguacuuuaccuccacuccgguucaaaggugaggacgggugcugguauggaauggagauuagacccgucaaggaaaaggaggaaaaucugguuaaaucuaugguguccgccggcucaggugagguagacaguuuuagccuuggccuguuguguaucucgaucaugauugaagaggugaugaggucccgcuggucucgaaagaugcucaugaccgggacacuggcagucuucuuucuacugaucaugggacagcucaccuggaacgaucugauucggcuuugcauaauggugggcgcugacgccagcgaucguauggggaugggaacuacauacuuggcacugauggccaccuucaaaaugagaccuauguuugcuguuggcuuacucuucaggcgccugacaucacgggaggugcuucugcuaacuaucggucucagucuggucgcguccguggaauugccaaauucucuggaggaauuaggggacggacucgccaugggcauuaugauccugaaacuucugaccgauuuucaaagccaucaguugugggcaacgcuccugucccuaacauucauuagaaccacuuuuucacugcacuaugcuuggaaaaccauggccaugguucuuagcaucgugagucucuucccccuguguuugucuacaacuucccagaagaccacguggcugccggucuuacucggcagccuggggugcaagccucuuacaauguuucugauagccgagaacaaaaucuggggaaggaagucguggccauugaaugaagguauuauggcuguaggcaucgugucaauucuccugucuagucuacugaaaaacgacguuccccuugcagggccucucaucgccggaggcaugcugauagcguguuacgugauuuccgguagcucugcugauuugagcuuagagaaggccgcagucguguccugggaggaagaggccgaacauucaggggcuagucacaacauccugguagaggugcaggacgauggaaccaugaaaaucaaggacgaagaacgagaugacacucucacaauucugcuuaaagcaacccuguuggccgucagcggcguuuauccccuaucuauaccagcgacucuguucgugugguacuucuggcaaaagaagaaacagcgcuccggcgugcucugggauacaccuucacccccagaggucgaacgggcugugcuggacgacgggaucuauagaauuaugcagaggggacuuuuaggucguagucagguuggcguagggguguuucaagagaaugucuuccauaccauguggcacgugacgcgcggagccguucugauguaccagggcaagcggcucgaaccgagcugggcauccgugaaaaaggauuugaucucuuacggugggggauggagacugcagggcucguggaacacuggcgaggagguccaggugauugccguagaaccugggaaaaaucccaagaacguccaaaccgcuccaggaacauuuaagaccagcgagggugaagugggcgccaucgcacucgacuucaaacccgggacaucaggauccccuauaguuaauagggagggcaagaucgugggucuguaugggaacggagucgugacuaccaguggcacguacguuucugcuauugcccaggcgaaagccagccaggaaggcccacuucccgagaucgaggaugaaguguuucgaaagcggaaucugacaauuauggacuugcacccuggguccggaaaaacucgcagauaucuaccggcaaucgucagggaggcuauaaagcggaagcugcgaacccucauuuuagccccaacaagagugguagcuucagaaauggcagaggcccugaaagguaugcccauccgcuaccaaaccacugccgugaagucugaacauaccggcaaagagaucguugaucuuaugugccacgcuacauucacgaugaggcugcucagcccuguccgugugccaaacuauaauaugauuaucauggacgaggcgcauuuuacugaucccaguuccauagcagcccggggguacauuagcaccagagugggaaugggcgaagcugccgcaaucuucaugacagccaccccuccggguucugucgaggcuuuuccccagucaaacgcgguaauucaggacgaagagagggauaucccagaacgcuccuggaauaguggguaugaguggauaacugacuucccuggaaagacagugugguuuguucccagcauuaaaucgggcaacgauaucgccaauuguuugcgaaagaacggcaagagagugauccagcugucucggaaaaccuucgacacggaguaccaaaagacuaaaaauaacgacugggauuacgucgugacaaccgacauuuccgaaaugggggcaaacuucagggcugaucgcguuaucgacccacguagaugccucaagccugugauucugaaagauggacccgagcgggucauacuugccgguccaaugccggugaccguagcaagcgccgcucagaggcgcggccgaaucgggagaaaucacaacaaggaaggagaccaguauauuuacaugggccagccucuaaauaacgaugaggaccaugcccacuggacugaggcgaagaugcuguuggauaauaucaacacacccgaagguaucauuccagcauuauuugaccccgagcgggaaaaaucagccgcuauagauggggaguauaggcugcgcggcgaagccagaaagaccuucguggagcucaugaggcggggagaccugccuguuuggcuuaguuacaaagucgcuucugagggcuuucaauauuccgaucgucgcuggugcuucgacggggaacgaaauaaccaggugcuggaggaaaauauggacguggagaucuggacaaaggaaggagagaggaagaagcucaggccacggugguuggaugcacgcacuuacagcgacccccuggcccuaagagaguuuaaagaguucgcugccgguaggcggucagucaguggcgaucugauucucgagaucgggaaacuuccucagcaccugacgcagcgagcacaaaacgcguuagacaauuugguuaugcugcauaacagcgaacagggaggcagagccuaucgccacgcuauggaggaacucccggauaccauugagacacugaugcuucuggcccucaucgcaguguugacuggugggguaacccuguuuuucuuauccggcaggggacuaggcaagacaucuauagggcugcucugugugauggcuagcuccguccuucuguggauggccucaguggagccacauuggaucgcagccucuauuaucuuggaauuuuuccugaugguucuccugauucccgagccugaccggcagcguacaccccaggauaaucaacuugcuuacguggucaucggacuccuguuuaugauauugacuguagcggccaacgaaaugggucuguuagagacgaccaaaaaggaccuaggcauugggcacguggcaguugagaaucaccaucacgcugccaugcuggauguggaccuccauccagccagugcauggacacuuuacgcugucgccacuaccaucauuacaccuaugaugagacacaccaucgaaaacacuacagcgaacauaucgcugacggcuaucgccaaucaggcagccauuuugaugggacuggauaaaggcuggcccaucagcaagauggacauuggugugccacuccuggcucuugggugcuauucccaggucaacccuuuaacccugacugcagccgugcucauguugguugcgcauuacgcuaucauaggcccgggacugcaagccaaagcaacaagggaggcccagaagcgcaccgcugccggcauuaugaagaaucccaccguggaugggaucguagcaaucgaccuagacccaguggucuaugaugcuaaauucgaaaagcagcugggacagauuaugcuccuuauccuguguacaucucaaauauugcugaugcggacuacgugggcccucugcgagucaauuacccuggcgacaggcccuuuaacuacccuuugggaagguagccccgggaaauuuuggaacacaaccaucgccguuuccauggcaaauauuuuccgaggaaguuaccuggcuggcgccggucucgcauucucucuaaugaaaagccugggcgggggaagaaggggcacuggggcucagggagagacguugggcgagaaauggaagcgccagcugaaccagcucucaaaguccgaauuuaauacauauaaacggagugguaucauggagguggacagaagcgaagccaaggaggggcuuaaacguggagaaaccacuaagcacgccgucucuaggggcaccgcgaaacugcggugguucguggagcgcaacuugguaaagccagaggguaaggugauagaucugggcugugggcgaggaggcugguccuacuauugcgcugggcucaaaaagguuacagaagugaaaggauacacuaagggcgguccugggcacgaggaacccaucccgauggcaaccuacggauggaauuuagucaaacugcauucaggcaaggacguguuuuucauuccaccugagaaaugugauacacuucugugcgacaucggcgaaagcucgcccaacccaacgauugaggaggggagaacccuaaggguccucaagaugguggaacccuggcugcggggaaaucaauuuuguaucaagauuuugaacccuuauaugccgucuguuguagagacucuggaacagaugcagcgcaaacacgguggcaugcucgugagaaauccccuuaguaggaacuccacacaugagauguacugggucagcugcgggaccggaaauaucgugucagccguuaacaugacuucccgaaugcuguuaaaucgguucacaauggcucaccguaagccaaccuaugagagagauguggaccugggcgccgguacgcgccacgucgcaguggaaccugagguagccaacuuggauauaauugggcagaggaucgaaaacaucaaacaugagcacaagucuaccuggcauuacgacgaagauaaucccuauaaaacaugggcuuaccacggaagcuaugaggugaagccuaguggcuccgcgagcucuaugguuaacggcgucgugaagcuccugacuaaaccaugggacgugauucccauggucacccaaauagccaugacagacacuaccccuuuugggcagcagcggguuuucaaggagaaaguggauacaagaaccccaaaggcaaaacgcggaacugcucaaaucauggaaguaacggccaaguggcuaugggguuuucuuucaaggaauaagaaaccccgaauuuguacacgggaggaguucaccagaaaggugaggaguaacgcagccaucggcgcugucuuuguggacgagaaucaguggaacuccgccaaagaagcgguugaggaugagcgcuucugggaccuggugcaucgugaacgggagcuccacaagcaggggaaaugcgcaacuugcgucuacaauaugaugggaaagagagaaaagaaacugggcgaguuugguaaggccaaagggagcagggcuauuugguacaugugguugggagcccgcuuccuggaguucgaggcacucggcuuuaugaacgaggaucacugguucucucgagaaaauucgcuuucaggcguggagggggaaggacugcauaaguuagguuauauccugcgggacauaagcaaaaucccgggcgggaacauguacgcugaugacaccgccggaugggauacaagaauuacggaggacgauuugcagaaugaggcuaagaucaccgacauuauggaaccugagcacgcccuccuggcaaaauccaucuuuaagcuaacuuaucaaaacaagguaguuagggugcagcgcccagcgaaaaauggcacagucauggaugugauaaguagacgggaccagagggguucuggacaggugggaaccuacggccuuaacacuuucacaaauauggaagcccaacugauucgucagauggagagcgaaggcaucuuuucccccucagagcucgagaccccuaaccuggcugggcgagucuuggacugguuagaaaagcauggaguugagcgccugaaaagaauggccaucaguggugaugacugugugguaaagccaauugaugaccgguucgcaacagcucucacugcccuuaacgauaugggcaaagugaggaaggacauaccccagugggaaccgucuaagggguggaaugauuggcagcaagucccuuuuugcagccaccacuuccaucagcugaucaugaaagacggacgcgagauugugguucccuguagaaaccaggaugagcuagugggccgggcaagggucucccagggugccggguggucacugcgagagaccgcgugccucggaaagagcuaugcucaaauguggcaguugauguacuuucaccguagagaccugcgccuugccgcaaaugccaucuguucugcugugccaguagauuggguuccuacgucccggaccacauggaguauucaugcccaccaucaguggaugacuaccgaggacaugcugagcguguggaacagggucuggaucgaagagaaucccuggauggaagacaaaacacacauaucguccuggggcgaugugccauaucucggcaagagagaggaccaauggugcgggucuuuaaucggacugacugcacgcgcuaccugggccacgaacauucagguugcgaucaaucaggugcggagguugcuggguaacgaaaauuaccucgauuacaugacaucaaugaaacgauucaagaacgagagcgaccccgagggcgcucuuugguga

SEQ ID NO: 14088 - RNA, 9879 nt, Artificial Sequence
  derived and/or modified CDS sequence (opt3) from DENV-1__JQ045635__SS-prME
agcgugaccaugcugcucaugcuuaugcccaccgcacuggcuuuccacuugacuacgagaggaggggaaccucauaugaucgucuccaagcaggaaagagggaagucuuuacuguuuaagaccucagccgguguuaacaugugcacccuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgauugccacaaucacaccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggcaggaccuucugguaacuuuuaaaacagcucacgccaagaagcaggaaguuguggucuuggguucucaagagggggcuaugcacaccgcccucacaggcgcaacugaaauucagaccuccggaacgaccacaauauucgccggccaucugaaaugccguuuaaagauggauaaacugacucuaaaggggaugagcuaugugauguguaccggaucguucaaacucgagaaggaagucgcugagacacagcacgguacugugcugguucagaucaaguacgagggcaccgacgcgccuugcaaaauuccauuuucuacgcaagaugaaaagggggcaacacagaacggacgccuuaucaccgccaaucccauagugacugacaaagagaagccuguaaacauugaagcugagccacccuucggcgaguccuauaucgucaucggugccggggaaaaagcauugaagcugucaugguuuaagaaaggcaguagcauuggaaagauguucgaggccacagcuagaggcgccaggcggauggcaauccucggggauaccgcgugggacuuuggauccauugguggcguguucacuucuguugggaaacuggugcaucagauauuuggaaccgcuuacggcguccuuuucagcggugugucauggacaaugaagaucgggauuggcguacuguugacguggcucggacugaauagucgauccaccagcuuaucuaugacuuguaucgccgugggccugguuacacuauaccucggggucauggugcaggcagauucaggaugcgugaucaacuggaaaggccgcgaacugaagugugguagugggauuuuugucaccaaugagguucacacauggacugaacaauauaaguuccaggccgacagcccgaaaagacuuuccgcugccauaggaaaggcaugggaggagggcgugugcgguaucaggucugcuacccgguuggaaaacauuauguggaaacagaucucgaacgagcugaaucauauucuccuggaaaacgacaugaaguuaacggugguagucggcgauguggccgggauccuggcgcagggcaagaagaugauacgcccucaacccauggaguacaaauauagcuggaaguccuggggcaaggccaaaaucauuggggcugacguucagaauacaaccuuuaucauugauggaccaaacacuccugaaugucccgacgaucagagagcauggaauaucugggagguggaggacuacggcuucgguauauuuaccacaaacauuuggcuuaaguugagggauucauauacucaggucugcgaccaccgucucaugagugccgcuaucaaagauucuaaggccgugcacgcagacaugggguacuggauugaaagcgagaaaaaugaaaccuggaagcuggcgcgggccuccuucaucgagguuaagacauguauauggccaaaaucacauacgcuauggagcaacggagugcuggaaucugagaugaucauucccaagaucuauggcgguccuauuucccaacacaauuaccgaccaggcuacuucacccagacugcugggccguggcaucucggaaaacuggagcuugauuuugacuugugcgaaggcacaaccguagucguggaugagcacugcgggaacagaggacccagucugaggacuacaaccgugacgggcaagaucauacacgaaugguguugccgcagcuguacuuuaccuccacuccgguucaaaggugaggacgggugcugguauggaauggagauuagacccgucaaggaaaaggaggaaaaucugguuaaaucuaugguguccgccggcucaggugagguagacaguuuuagccuuggccuguuguguaucucgaucaugauugaagaggugaugaggucccgcuggucucgaaagaugcucaugaccgggacacuggcagucuucuuucuacugaucaugggacagcucaccuggaacgaucugauucggcuuugcauaauggugggcgcugacgccagcgaucguauggggaugggaacuacauacuuggcacugauggccaccuucaaaaugagaccuauguuugcuguuggcuuacucuucaggcgccugacaucacgggaggugcuucugcuaacuaucggucucagucuggucgcguccguggaauugccaaauucucuggaggaauuaggggacggacucgccaugggcauuaugauccugaaacuucugaccgauuuucaaagccaucaguugugggcaacgcuccugucccuaacauucauuagaaccacuuuuucacugcacuaugcuuggaaaaccauggccaugguucuuagcaucgugagucucuucccccuguguuugucuacaacuucccagaagaccacguggcugccggucuuacucggcagccuggggugcaagccucuuacaauguuucugauagccgagaacaaaaucuggggaaggaagucguggccauugaaugaagguauuauggcuguaggcaucgugucaauucuccugucuagucuacugaaaaacgacguuccccuugcagggccucucaucgccggaggcaugcugauagcguguuacgugauuuccgguagcucugcugauuugagcuuagagaaggccgcagucguguccugggaggaagaggccgaacauucaggggcuagucacaacauccugguagaggugcaggacgauggaaccaugaaaaucaaggacgaagaacgagaugacacucucacaauucugcuuaaagcaacccuguuggccgucagcggcguuuauccccuaucuauaccagcgacucuguucgugugguacuucuggcaaaagaagaaacagcgcuccggcgugcucugggauacaccuucacccccagaggucgaacgggcugugcuggacgacgggaucuauagaauuaugcagaggggacuuuuaggucguagucagguuggcguagggguguuucaagagaaugucuuccauaccauguggcacgugacgcgcggagccguucugauguaccagggcaagcggcucgaaccgagcugggcauccgugaaaaaggauuugaucucuuacggugggggauggagacugcagggcucguggaacacuggcgaggagguccaggugauugccguagaaccugggaaaaaucccaagaacguccaaaccgcuccaggaacauuuaagaccagcgagggugaagugggcgccaucgcacucgacuucaaacccgggacaucaggauccccuauaguuaauagggagggcaagaucgugggucuguaugggaacggagucgugacuaccaguggcacguacguuucugcuauugcccaggcgaaagccagccaggaaggcccacuucccgagaucgaggaugaaguguuucgaaagcggaaucugacaauuauggacuugcacccuggguccggaaaaacucgcagauaucuaccggcaaucgucagggaggcuauaaagcggaagcugcgaacccucauuuuagccccaacaagagugguagcuucagaaauggcagaggcccugaaagguaugcccauccgcuaccaaaccacugccgugaagucugaacauaccggcaaagagaucguugaucuuaugugccacgcuacauucacgaugaggcugcucagcccuguccgugugccaaacuauaauaugauuaucauggacgaggcgcauuuuacugaucccaguuccauagcagcccggggguacauuagcaccagagugggaaugggcgaagcugccgcaaucuucaugacagccaccccuccggguucugucgaggcuuuuccccagucaaacgcgguaauucaggacgaagagagggauaucccagaacgcuccuggaauaguggguaugaguggauaacugacuucccuggaaagacagugugguuuguucccagcauuaaaucgggcaacgauaucgccaauuguuugcgaaagaacggcaagagagugauccagcugucucggaaaaccuucgacacggaguaccaaaagacuaaaaauaacgacugggauuacgucgugacaaccgacauuuccgaaaugggggcaaacuucagggcugaucgcguuaucgacccacguagaugccucaagccugugauucugaaagauggacccgagcgggucauacuugccgguccaaugccggugaccguagcaagcgccgcucagaggcgcggccgaaucgggagaaaucacaacaaggaaggagaccaguauauuuacaugggccagccucuaaauaacgaugaggaccaugcccacuggacugaggcgaagaugcuguuggauaauaucaacacacccgaagguaucauuccagcauuauuugaccccgagcgggaaaaaucagccgcuauagauggggaguauaggcugcgcggcgaagccagaaagaccuucguggagcucaugaggcggggagaccugccuguuuggcuuaguuacaaagucgcuucugagggcuuucaauauuccgaucgucgcuggugcuucgacggggaacgaaauaaccaggugcuggaggaaaauauggacguggagaucuggacaaaggaaggagagaggaagaagcucaggccacggugguuggaugcacgcacuuacagcgacccccuggcccuaagagaguuuaaagaguucgcugccgguaggcggucagucaguggcgaucugauucucgagaucgggaaacuuccucagcaccugacgcagcgagcacaaaacgcguuagacaauuugguuaugcugcauaacagcgaacagggaggcagagccuaucgccacgcuauggaggaacucccggauaccauugagacacugaugcuucuggcccucaucgcaguguugacuggugggguaacccuguuuuucuuauccggcaggggacuaggcaagacaucuauagggcugcucugugugauggcuagcuccguccuucuguggauggccucaguggagccacauuggaucgcagccucuauuaucuuggaauuuuuccugaugguucuccugauucccgagccugaccggcagcguacaccccaggauaaucaacuugcuuacguggucaucggacuccuguuuaugauauugacuguagcggccaacgaaaugggucuguuagagacgaccaaaaaggaccuaggcauugggcacguggcaguugagaaucaccaucacgcugccaugcuggauguggaccuccauccagccagugcauggacacuuuacgcugucgccacuaccaucauuacaccuaugaugagacacaccaucgaaaacacuacagcgaacauaucgcugacggcuaucgccaaucaggcagccauuuugaugggacuggauaaaggcuggcccaucagcaagauggacauuggugugccacuccuggcucuugggugcuauucccaggucaacccuuuaacccugacugcagccgugcucauguugguugcgcauuacgcuaucauaggcccgggacugcaagccaaagcaacaagggaggcccagaagcgcaccgcugccggcauuaugaagaaucccaccguggaugggaucguagcaaucgaccuagacccaguggucuaugaugcuaaauucgaaaagcagcugggacagauuaugcuccuuauccuguguacaucucaaauauugcugaugcggacuacgugggcccucugcgagucaauuacccuggcgacaggcccuuuaacuacccuuugggaagguagccccgggaaauuuuggaacacaaccaucgccguuuccauggcaaauauuuuccgaggaaguuaccuggcuggcgccggucucgcauucucucuaaugaaaagccugggcgggggaagaaggggcacuggggcucagggagagacguugggcgagaaauggaagcgccagcugaaccagcucucaaaguccgaauuuaauacauauaaacggagugguaucauggagguggacagaagcgaagccaaggaggggcuuaaacguggagaaaccacuaagcacgccgucucuaggggcaccgcgaaacugcggugguucguggagcgcaacuugguaaagccagaggguaaggugauagaucugggcugugggcgaggaggcugggcuuacuauugcgcagggcucaaaaagguuacagaagugaaaggauacacuaagggcgguccugggcacgaggaacccaucccgauggccaccuacggauggaauuuagucaaacugcauuccggcaaggacguguuuuucauuccaccugagaaaugugauacacuucugugcgacaucggcgaaucaagccccaacccaacgauugaggaggggagaacccuaaggguccucaagaugguggaacccuggcugcggggaaaucaauuuuguaucaagauuuugaacccuuauaugccgucgguuguagagacucuggaacagaugcagcgcaaacacgguggcaugcucgugagaaauccccuuucuaggaacaguacacaugagauguacugggucuccugcgggaccggaaauaucgugagcgcuguuaacaugacuucacgaaugcuguuaaaucgguucacaauggcccaccguaagccaaccuaugagagagauguggaccugggcgcagguacgcgccacgucgccguggaaccugagguagcuaacuuggauauaauugggcagaggaucgaaaacaucaaacaugagcacaaguccaccuggcauuacgacgaagauaaucccuauaaaacaugggcguaccacggaucuuaugaggugaagccuagcggcagugccuccagcaugguuaacggcgucgugaagcuccugacuaaaccaugggacgugauucccauggucacccaaauagcaaugacagacacuaccccuuuugggcagcagcggguuuucaaggagaaaguggauacaagaaccccaaaggcuaaacgcggaacugcccaaaucauggaaguaacggcaaaguggcuaugggguuuucuuucuaggaauaagaaaccccgaauuuguacacgggaggaguucaccagaaaggugaggucaaacgccgcuaucggcgccgucuuuguggacgagaaucaguggaacagugcgaaagaagcaguugaggaugagcgcuucugggaccuggugcaucgugaacgggagcuccacaagcaggggaaaugcgccacuugcgucuacaauaugaugggaaagagagaaaagaaacugggcgaguuugguaaggcuaaaggguccagggccauuugguacaugugguugggagcacgcuuccuggaguucgaggcucucggcuuuaugaacgaggaucacugguucagccgagaaaauucucuuucgggcguggagggggaaggacugcauaaguuagguuauauccugcgggacauaucaaaaaucccgggcgggaacauguacgccgaugacaccgcuggaugggauacaagaauuacggaggacgauuugcagaaugaggccaagaucaccgacauuauggaaccugagcacgcacuccuggcgaaaagcaucuuuaagcuaacuuaucaaaacaagguaguuagggugcagcgcccagccaaaaauggcacagucauggaugugauauccagacgggaccagagggguaguggacaggugggaaccuacggccuuaacacuuucacaaauauggaagcucaacugauucgucagauggagucugaaggcaucuuuagccccuccgagcucgagaccccuaaccuggccgggcgagucuuggacugguuagaaaagcauggaguugagcgccugaaaagaauggcaaucucaggugaugacugugugguaaagccaauugaugaccgguucgcuacagcccucacugcacuuaacgauaugggcaaagugaggaaggacauaccccagugggaaccgaguaagggguggaaugauuggcagcaagucccuuuuugcucucaccacuuccaucagcugaucaugaaagacggacgcgagauugugguucccuguagaaaccaggaugagcuagugggccgggccagggucagccagggugcgggguggucccugcgagagaccgcuugccucggaaagucauaugcccaaauguggcaguugauguacuuucaccguagagaccugcgccuugcagccaaugcuaucuguagcgccgugccaguagauuggguuccuacgucucggaccacaugguccauucaugcacaccaucaguggaugacuaccgaggacaugcugaguguguggaacagggucuggaucgaagagaaucccuggauggaagacaaaacacacauaagcucguggggcgaugugccauaucucggcaagagagaggaccaauggugcggguccuuaaucggacugacugcucgcgccaccugggcgacgaacauucagguugcuaucaaucaggugcggagguugcuggguaacgaaaauuaccucgauuacaugacaucuaugaaacgauucaagaacgagucagaccccgagggcgcccuuugguga

SEQ ID NO: 14089 - RNA, 9879 nt, Artificial Sequence
  derived and/or modified CDS sequence (opt3) from DENV-1__JQ045637__SS-prME
agcgugaccaugcugcucaugcuuaugcccacagcacuggcuuuccacuugacuacgagaggaggggaaccucauaugaucgucuccaagcaggaaagagggaaaucuuuacuguuuaagaccucagccgguguuaacaugugcacacuaauugcaauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagaugucuggaacaacuaccauuuuugcaggccauuuaaaaugccgucugaagauggauaaacuaacacucaaggggauguccuaugugauguguacuggcagcuucaaacuggagaaggaagucgccgagacccagcacgguacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauagggaucggcguguugcucacuuggcugggauuaaauucacgaaguacaucccugagcaugaccuguauugcgguuggccuagucacacucuaccugggggugauggugcaggcugauucuggaugcgucaucaacuggaaaggccgcgaacuuaagugugguucagggaucuucguuacuaaugaggugcacaccuggacggaacaauauaaguuucaggccgacaguccgaaaagauugagcgcagccauuggaaaggcuugggaggagggcgugugcgguauaagguccgccacacggcuggaaaacaucauguggaaacagauuucuaacgagcucaaucauauccuguuagaaaacgacaugaaguucaccguagucgugggcgauguugcagggauucuggcucagggcaagaagaugauccgcccucaacccauggaguacaaauauucguggaaaagcuggggcaaggccaagauaaucggggcggacgugcagaauacuaccuuuauuaucgauggaccaaacacaccugaaugucccgacgaucagagagccuggaauauuugggaggucgaggacuacggcuucgguaucuuuacuaccaacauauggcuuaaguugagggauuccuauacacaggugugcgaccaccgucucaugucagcugcaauuaaagauaguaaggccguucacgcugacaugggguacuggaucgaaucugagaaaaaugaaacguggaagcuggcccgggccagcuucauugaggugaagaccuguaucuggccaaaaucccauacucuauggucaaacggaguacuggaaagcgagaugauaauccccaagauuuauggcgguccuaucucucaacacaauuaccgaccaggcuacuucacacagaccgcggggccguggcaucucggaaaacuggagcuugauuuugacuugugcgaaggcacuacagucgugguggaugagcacugcggguccagaggacccagucugaggaccacgacugucaccggcaagauuauccacgaaugguguugccgcagcuguacauuaccuccacuccgguucagaggugaggacgggugcugguauggaauggagauaaggcccguuaaagaaaaggaggaaaaccuggugaagucuaugguauccgccggcucaggugagguggacagucuuagccugggcuugcucuguauuucgaucaugaucgaagaggucaugcgcucccgauggucucggaaaaugcugaugaccgggacucuagcuguguuuuuccugcucauuaugggacagcugacauggaaugaucuuauccguuugugcauuaugguuggcgccaacgcaagcgacagaauggggaugggaaccacauaccuggcuuuaauggccgcauuuaagaugaggccuauguucgccgugggccuccuguuucgccggcuuacuucaagagagguccugcuacucaccauaggucugaguuugguggcuuccguugaacugccaaauucuuuagaggaacucggggauggacuggcgaugggcaucaugauucuuaaacuguugacggacuuccaaagccaucagcucugggccacacugcuaucccugaccuuuaucaagacuaccuucucacuucacuaugcauggaaaacaauggcuauggugcucagcauugucagucuguuucccuugugucugucuacuaccucccagaagacgacaugguuaccgguacuccugggcagccuugggugcaagccucugaccauguucuugaucgccgagaacaaaauauggggaaggcgaucguggccacucaaugaagguaucauggccgugggcauuguuucaauccugcuaucuagucugcuuaagaacgaugugccccucgcugggccucugauugcaggaggcauguugaucgccuguuacgucauauccgguagcucugcggacuuaagccuggagaaagcugccgagguguccugggaagaggaagcagagcauucaggggccagucacaacauucucguagaagugcaggaugacggaacuaugaagaucaaagaugaggagcgcgacgauacacugaccauccuucugaaggcuacuuugcuagcagucagcggcguuuauccccugucuauuccagccacacucuuugugugguacuucuggcagaaaaagaagcagcgguccggcgugcugugggacaccccuucacccccagaagucgagagagcggugcuugaugacgggauauauaggaucaugcagcguggauuacugggucgcagucagguuggcguagggguguuccaagaaaaugucuuucauacgauguggcacgugacucggggagcuguucucauguaccagggcaaaagauuggagccgagcugggccuccgugaagaaagaccugauuucuuacggugggggauggaggcuccagggcucguggaacaccggcgaggaaguccaggugaucgcaguagagccugggaagaaucccaaaaacguccaaacagccccaggaaccuucaagacacccgaaggugaggugggcgcuauugcccuggauuuuaagccugggacuagcggaucaccaaucguuaaucgagaaggcaaaauagugggucuuuaugggaacggagucgugaccacguccggcacauacguuagugcaaucgcucaggccaaggcgucucaggagggcccccugccugagauugaagacgagguguuccggaaacgcaauuugacuaucauggaucuacacccggggagcggaaagaccagaagguaucugccagccauuguccgggaagcaaucaaacgaaagcucagaacauuaauacuggcucccacccgcgugguagccuccgagauggcugaagcacuuaaggguaugccuauuagguaccaaacuaccgccgugaaaucagagcauacaggcaaggagaucguugaccugaugugccacgccacguuuacuaugcgucucuugucuccaguccgggugcccaacuauaauaugaucauuauggaugaagcucauuucaccgacccuagcaguaucgcggcaagaggguacauauccacaagggugggaaugggcgaggccgcugccauuuuuaugaccgcaacuccgcccgguagcgucgaagccuucccacagucuaacgcuguaauccaggaugaggaacgcgacauuccugagcgaucauggaacuccggguaugaguggaucacagauuuucccggaaaaaccgugugguucguuccaaguauaaagagcggcaacgacauugcgaauugucugaggaaaaauggcaagcgggugauccagcucucgaggaagacguuugauacugaauaccagaaaacaaagaauaacgacugggacuacgucgugaccaccgauaucucugagaugggggccaacuuccgcgcagaccguguuauugauccuagacggugccugaaacccgugauccuuaaggacggaccagaaagggucauucuagcugguccgaugccugugacuguagccuccgcagcccagcgccgaggcagaauagggcggaaucacaacaaagagggagaucaguauaucuacaugggccagccccugaauaacgacgaggaucaugcucacuggacagaagccaagauguuguuagacaauauuaacaccccagaggguaucauccccgcgcuguucgaaccugagagggaaaagagcgcagccauugauggggaguaucgccucagaggcgaggcuaggaaaacauuuguggaacugaugcggcguggagaccuuccaguuuggcugucauacaaggucgccagugagggcuuccaauauucugaucgccgauggugcuuugacggggaaagaaauaaccaggugcucgaggaaaauauggauguggagauauggacuaaagagggagaaaggaagaaauugcggccccgcuggcuggacgcuagaacguacuccgacccucuagcacugagggaguucaaggaauuugccgcuggucggcgaagcgucucaggcgaucucauccuugagauugggaaacugccgcagcacuuaacccagagagcccaaaacgcauuggacaaucugguuaugcuccauaacagugaacagggaggccgcgcguauaggcacgccaucgaggagcugccagauacaauugaaacucuuaugcugcucgcuuugaucgccgugcugaccggugggguaacauuauucuuucuaagcggccggggacugggcaagaccuccauagggcuccuuugugugauggcaucuagcguccuguuguggauggcuuccguggagccccauuggaucgccgcaucaauuauccuggaguucuuucucaugguucugcuuauuccugagcccgaccgucagagaacuccacaggauaaucaacucgccuacguggucaucggacuguuguucaugauacugacgguagcugcgaacgagauggguuuacuagaaaccacaaagaaagaccugggcauugggcacguggccguugagaaucaccaucacgcagcuaugcucgauguggaccuucauccugccucugccuggacucuguacgcagucgcuaccacaaucauuacccccaugaugaggcacacuaucgaaaacacaacggccaacauaaguuugaccgcgaucgcuaaucaggccgcaauucugaugggacucgauaagggcuggccaaucucgaaaauggacauuggugugccucugcuugccuuagggugcuauagccaggucaacccgcugacucucacagcugcaguguugaugcugguugcccauuacgcgaucauaggccccggacuacaagcuaaggccacccgcgaggcacagaaacggaccgccgcuggcauuaugaagaauccaacaguggaugggaucguagccaucgaccuggauccuguggucuaugacgcaaaguuugaaaaacagcucggacagauuaugcuucugaucuuguguacuucccaaauacugcucaugcgaacgaccugggcucugugcgagucuauuacauuagccacuggcccccuuaccacacugugggaggguucaccagggaaguucuggaacaccacuaucgcgguuagcauggccaauauuuuuagaggauccuaccucgcaggcgcuggucuagccuucagucugaugaaaucuuugggcgggggaaggcgcggcacgggggcacagggagaaacacugggcgagaaguggaaacggcagcucaaccagcuuagcaagucagaguucaauaccuauaagagauccgguaucauggagguggaccguagugaagcuaaagaggggcugaagaggggagagacuaccaaacacgccgucagccggggcacagccaaguugcgcugguuuguggaacgaaaccugguaaaaccugaggguaaggugauagaucucggcugugggagaggaggcuggucuuacuauugcgcgggguuaaagaaaguuacugaagugaagggauacaccaaaggcggucccgggcacgaggaaccgaucccaauggcuacauacggauggaaucuggucaaacuucauuccggcaaagacguguucuuuauuccucccgagaagugugauacgcugcuaugcgacaucggcgagucaagcccaaaccccaccauugaagaggggaggacucuccggguccugaaaaugguggaaccuugguugcgcggaaaucaauucuguaucaagauucugaacccguauaugcccucgguuguagagacacucgagcagaugcagagaaagcacgguggcaugcuugugaggaauccacugucucgaaacaguacccaugaaauguacugggucuccugcgggacuggaaauaucgugagcgcaguuaacaugacaucacggauguuacugaaucguuuuaccauggcccacagaaaaccuacguaugagcgcgauguggacuugggcgcugguaccaggcacgucgccguggaacccgagguagcaaaccucgauauaauugggcagcggaucgaaaacaucaagcaugagcacaaauccacauggcauuacgacgaggauaauccuuauaagacuugggccuaccacggaucuuaugaagugaaaccaagcggcagugcuuccagcaugguuaacggcgucgugaagcugcuaaccaagcccugggacgugauuccuauggucacacaaauagcgaugacugauaccacaccauucgggcagcagagaguuuuuaaagagaagguggacacccgcacucccaaagccaagaggggaacggcacaaaucauggaaguaacagcuaaauggcuuugggguuuccugucucgaaauaagaagccgcggauuuguaccagagaggaauuuacuaggaaagugcgcucaaacgccgcaaucggcgccgucuucguggacgagaaucaguggaacagugcuaaggaggccguugaagaugagcguuuuugggaccucgugcaucgggaaagagagcugcacaaacaggggaagugcgcgaccugcgucuacaauaugaugggaaaaagggaaaagaaguugggcgaguucgguaaagcaaaggggucccgcgccauuugguacauguggcugggagcucgauuucucgaguucgaagcccuuggcuucaugaacgaggaucacugguuuagccgggaaaauucucugucgggcguggagggggagggauuacauaaacuggguuauaucuugagagacauaucaaagaucccuggcgggaacauguacgcagaugacacagcuggaugggauacgaggauuaccgaagacgaucuccagaaugaggcccgcaucacugacauuauggaaccagagcacgcucugcuagccagaagcaucuucaaacuuacauaucaaaacaagguaguucgggugcagaggcccgccaaaaauggcaccgucauggaugugauaucccgucgagaccagcgcgguaguggacaggugggaacuuacggccugaacacauuuaccaauauggaagcgcaacucauuagacagauggagucugagggcaucuucagcccuuccgaacuggagacaccaaacuuggccgaacgggucuuagauuggcuggagaaguaugggguugaaaggcucaagcgcauggcuaucucaggagacgacugugugguaaaacccauugaugacagauuugccacugcacuuaccgcucugaacgauauggguaaggugcggaaagacauaccgcagugggagccuaguaagggcuggaaugauuggcagcaaguccccuucugcucucaucacuuucaccagcuaaucaugaaagacgggagggagauugugguuccaugucgaaaccaggaugaacuggugggacgugccagagucagccagggcgcagguuggucccuccgcgagacggccugcuuggggaagucauacgcgcaaauguggcagcugauguauuuccaucggagggaccuuagacuggcugccaaugcaaucuguagcgccgugccuguagauuggauucccaccucucgcacaacuugguccauccacgcucaucaccaguggaugaccacagaagacaugcucaguguuuggaaccggguguggauagaggaaaauccauggauggaggauaagacucauaucagcucguggggagacguccccuacuuaggcaaaagggaggaccaauggugcggcucccugauuggguugaccgcccgagcaacgugggcuacaaacauccagguggccauuaaucagguuagacggcugaucggaaacgaaaauuaccucgauuauaugaccucuaugaagagguuuaaaaacgagucagacccugaaggugcgcuuugguga

SEQ ID NO: 14090 - RNA, 9879 nt, Artificial Sequence
  derived and/or modified CDS sequence (opt3) from DENV-1__JQ045638__SS-prME
agcgugaccaugcugcucaugcuuaugcccacagcacuggcuuuccacuugacuacgagaggaggggaaccucauaugaucgucuccaagcaggaaagagggaaaucuuuacuguuuaagaccucagccgguguuaacaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagaugucuggaacaacuaccauuuuugcaggccauuuaaaaugccgucugaagauggauaaacuaacacucaaggggauguccuaugugauguguacuggcagcuucaaacuggagaaggaagucgccgagacccagcacgguacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauagggaucggcguguugcucacuuggcugggauuaaauucacgaaguacaucccugagcaugaccuguauugcgguuggccuagucacacucuaccugggggugauggugcaggcugauucuggaugcgucaucaacuggaaaggccgcgaacuuaagugugguucagggaucuucguuacuaaugaggugcacaccuggacggaacaauauaaguuucaggccgacaguccgaaaagauugagcgcagccauuggaaaggcuugggaggagggcgugugcgguauaagguccgccacacggcuggaaaacaucauguggaaacagauuucuaacgagcucaaucauauccuguuagaaaacgacaugaaguucaccguagucgugggcgauguugcagggauucuggcucagggcaagaagaugauccgcccucaacccauggaguacaaauauucguggaaaagcuggggcaaggccaagauaaucggggcggacgugcagaauacuaccuuuauuaucgauggaccaaacacaccugaaugucccgacgaucagagagccuggaauauuugggaggucgaggacuacggcuucgguaucuuuacuaccaacauauggcuuaaguugagggauuccuauacacaggugugcgaccaccgucucaugucagcugcaauuaaagauaguaaggccguucacgcugacaugggguacuggaucgaaucugagaaaaaugaaacguggaagcuggcccgggccagcuucauugaggugaagaccuguaucuggccaaaaucccauacucuauggucaaacggaguacuggaaagcgagaugauaauccccaagauuuauggcgguccuaucucucaacacaauuaccgaccaggcuacuucacacagaccgcggggccguggcaucucggaaaacuggagcuugauuuugacuugugcgaaggcacuacagucgugguggaugagcacugcggguccagaggacccagucugaggaccacgacugucaccggcaagauuauccacgaaugguguugccgcagcuguacauuaccuccacuccgguucagaggugaggacgggugcugguauggaauggagauaaggcccguuaaagaaaaggaggaaaaccuggugaagucuaugguauccgccggcucaggugagguggacagucuuagccugggcuugcucuguauuucgaucaugaucgaagaggucaugcgcucccgauggucucggaaaaugcugaugaccgggacucuagcuguguuuuuccugcucauuaugggacagcugacauggaaugaucuuauccguuugugcauuaugguuggcgccaacgcaagcgacagaauggggaugggaaccacauaccuggcuuuaauggccgcauuuaagaugaggccuauguucgccgugggccuccuguuucgccggcuuacuucaagagagguccugcuacucaccauaggucugaguuugguggcuuccguugaacugccaaauucuuuagaggaacucggggauggacuggcgaugggcaucaugauucuuaaacuguugacggacuuccaaagccaucagcucugggccacacugcuaucccugaccuuuaucaagacuaccuucucacuucacuaugcauggaaaacaauggcuauggugcucagcauugucagucuguuucccuugugucugucuacuaccucccagaagacgacaugguuaccgguacuccugggcagccuugggugcaagccucugaccauguucuugaucgccgagaacaaaauauggggaaggcgaucguggccacucaaugaagguaucauggccgugggcauuguuucaauccugcuaucuagucugcuuaagaacgaugugccccucgcugggccucugauugcaggaggcauguugaucgccuguuacgucauauccgguagcucugcggacuuaagccuggagaaagcugccgagguguccugggaagaggaagcagagcauucaggggccagucacaacauucucguagaagugcaggaugacggaacuaugaagaucaaagaugaggagcgcgacgauacacugaccauccuucugaaggcuacuuugcuagcagucagcggcguuuauccccugucuauuccagccacacucuuugugugguacuucuggcagaaaaagaagcagcgguccggcgugcugugggacaccccuucacccccagaagucgagagagcggugcuugaugacgggauauauaggaucaugcagcguggauuacugggucgcagucagguuggcguagggguguuccaagaaaaugucuuucauacgauguggcacgugacucggggagcuguucucauguaccagggcaaaagauuggagccgagcugggccuccgugaagaaagaccugauuucuuacggugggggauggaggcuccagggcucguggaacaccggcgaggaaguccaggugaucgcaguagagccugggaagaaucccaaaaacguccaaacagccccaggaaccuucaagacacccgaaggugaggugggcgcuauugcccuggauuuuaagccugggacuagcggaucaccaaucguuaaucgagaaggcaaaauagugggucuuuaugggaacggagucgugaccacguccggcacauacguuagugcaaucgcucaggccaaggcgucucaggagggcccccugccugagauugaagacgagguguuccggaaacgcaauuugacuaucauggaucuacacccggggagcggaaagaccagaagguaucugccagccauuguccgggaagcaaucaaacgaaagcucagaacauuaauacuggcucccacccgcgugguagccuccgagauggcugaagcacuuaaggguaugccuauuagguaccaaacuaccgccgugaaaucagagcauacaggcaaggagaucguugaccugaugugccacgccacguuuacuaugcgucucuugucuccaguccgggugcccaacuauaauaugaucauuauggaugaagcucauuucaccgacccuagcaguaucgcggcaagaggguacauauccacaagggugggaaugggcgaggccgcugccauuuuuaugaccgcaacuccgcccgguagcgucgaagccuucccacagucuaacgcuguaauccaggaugaggaacgcgacauuccugagcgaucauggaacuccggguaugaguggaucacagauuuucccggaaaaaccgugugguucguuccaaguauaaagagcggcaacgacauugcgaauugucugaggaaaaauggcaagcgggugauccagcucucgaggaagacguuugauacugaauaccagaaaacaaagaauaacgacugggacuacgucgugaccaccgauaucucugagaugggggccaacuuccgcgcagaccguguuauugauccuagacggugccugaaacccgugauccuuaaggacggaccagaaagggucauucuagcugguccgaugccugugacuguagccuccgcagcccagcgccgaggcagaauagggcggaaucacaacaaagagggagaucaguauaucuacaugggccagccccugaauaacgacgaggaucaugcucacuggacagaagccaagauguuguuagacaauauuaacaccccagaggguaucauccccgcgcuguucgaaccugagagggaaaagagcgcagccauugauggggaguaucgccucagaggcgaggcuaggaaaacauuuguggaacugaugcggcguggagaccuuccaguuuggcugucauacaaggucgccagugagggcuuccaauauucugaucgccgauggugcuuugacggggaaagaaauaaccaggugcucgaggaaaauauggauguggagauauggacuaaagagggagaaaggaagaaauugcggccccgcuggcuggacgcuagaacguacuccgacccucuagcacugagggaguucaaggaauuugccgcuggucggcgaagcgucucaggcgaucucauccuugagauugggaaacugccgcagcacuuaacccagagagcccaaaacgcauuggacaaucugguuaugcuccauaacagugaacagggaggccgcgcguauaggcacgccaucgaggagcugccagauacaauugaaacucuuaugcugcucgcuuugaucgccgugcugaccggugggguaacauuauucuuucuaagcggccggggacugggcaagaccuccauagggcuccuuugugugauggcaucuagcguccuguuguggauggcuuccguggagccccauuggaucgccgcaucaauuauccuggaguucuuucucaugguucugcuuauuccugagcccgaccgucagagaacuccacaggauaaucaacucgccuacguggucaucggacuguuguucaugauacugacgguagcugcgaacgagauggguuuacuagaaaccacaaagaaagaccugggcauugggcacguggccguugagaaucaccaucacgcagcuaugcucgauguggaccuucauccugccucugccuggacucuguacgcagucgcuaccacaaucauuacccccaugaugaggcacacuaucgaaaacacaacggccaacauaaguuugaccgcgaucgcuaaucaggccgcaauucugaugggacucgauaagggcuggccaaucucgaaaauggacauuggugugccucugcuugccuuagggugcuauagccaggucaacccgcugacucucacagcugcaguguugaugcugguugcccauuacgcgaucauaggccccggacuacaagcuaaggccacccgcgaggcacagaaacggaccgccgcuggcauuaugaagaauccaacaguggaugggaucguagccaucgaccuggauccuguggucuaugacgcaaaguuugaaaaacagcucggacagauuaugcuucugaucuuguguacuucccaaauacugcucaugcgaacgaccugggcucugugcgagucuauuacauuagccacuggcccccuuaccacacugugggaggguucaccagggaaguucuggaacaccacuaucgcgguuagcauggccaauauuuuuagaggauccuaccucgcaggcgcuggucuagccuucagucugaugaaaucuuugggcgggggaaggcgcggcacgggggcacagggagaaacacugggcgagaaguggaaacggcagcucaaccagcuuagcaagucagaguucaauaccuauaagagauccgguaucauggagguggaccguagugaagcuaaagaggggcugaagaggggagagacuaccaaacacgccgucagccggggcacagccaaguugcgcugguuuguggaacgaaaccugguaaaaccugaggguaaggugauagaucucggcugugggagaggaggcugggcguacuauugcgcuggguuaaagaaaguuacugaagugaagggauacaccaaaggcggucccgggcacgaggaaccgaucccaauggcaacauacggauggaaucuggucaaacuucauucuggcaaagacguguucuuuauuccucccgagaagugugauacgcugcuaugcgacaucggcgaguccucaccaaaccccaccauugaagaggggaggacucuccggguccugaaaaugguggaaccuugguugcgcggaaaucaauucuguaucaagauucugaacccguauaugcccagcguuguagagacacucgagcagaugcagagaaagcacgguggcaugcuugugaggaauccacugucgcgaaacucuacccaugaaauguacugggucaguugcgggacuggaaauaucguguccgccguuaacaugacaagccggauguuacugaaucguuuuaccauggcucacagaaaaccuacguaugagcgcgauguggacuugggcgccgguaccaggcacgucgcaguggaacccgagguagccaaccucgauauaauugggcagcggaucgaaaacaucaagcaugagcacaaaucaacauggcauuacgacgaggauaauccuuauaagacuugggcuuaccacggauccuaugaagugaaaccaucuggcagcgcgaguuccaugguuaacggcgucgugaagcugcuaaccaagcccugggacgugauuccuauggucacacaaauagccaugacugauaccacaccauucgggcagcagagaguuuuuaaagagaagguggacacccgcacucccaaagcaaagaggggaacggcucaaaucauggaaguaacagccaaauggcuuugggguuuccugagccgaaauaagaagccgcggauuuguaccagagaggaauuuacuaggaaagugcgcucuaacgcagccaucggcgcugucuucguggacgagaaucaguggaacucagccaaggaggcgguugaagaugagcguuuuugggaccucgugcaucgggaaagagagcugcacaaacaggggaagugcgcaaccugcgucuacaauaugaugggaaaaagggaaaagaaguugggcgaguucgguaaagccaaggggagucgcgcuauuugguacauguggcugggagcccgauuucucgaguucgaagcacuuggcuucaugaacgaggaucacugguuuucccgggaaaauagccugucuggcguggagggggagggauuacauaaacuggguuauaucuugagagacauaucgaagaucccuggcgggaacauguacgcugaugacacagccggaugggauacgaggauuaccgaagacgaucuccagaaugaggcucgcaucacugacauuauggaaccagagcacgcccugcuagcaagaucaaucuucaaacuuacauaucaaaacaagguaguucgggugcagaggcccgcgaaaaauggcaccgucauggaugugauaagccgucgagaccagcgcgguuccggacaggugggaacuuacggccugaacacauuuaccaauauggaagcccaacucauuagacagauggagagugagggcaucuucucuccuagcgaacuggagacaccaaacuuggcugaacgggucuuagauuggcuggagaaguaugggguugaaaggcucaagcgcauggccaucuccggagacgacugugugguaaaacccauugaugacagauuugcaacugcucuuaccgcccugaacgauauggguaaggugcggaaagacauaccgcagugggagccuucaaagggcuggaaugauuggcagcaaguccccuucugcagucaucacuuucaccagcuaaucaugaaagacgggagggagauugugguuccaugucgaaaccaggaugaacuggugggacgugcaagagucucucagggcgccgguuggagccuccgcgagacggcgugcuuggggaaguccuacgcucaaauguggcagcugauguauuuccaucggagggaccuuagacuggccgcaaaugccaucuguucagcugugccuguagauuggauucccaccagccgcacaacuuggucuauccacgcccaucaccaguggaugaccacagaagacaugcucuccguuuggaaccggguguggauagaggaaaauccauggauggaggauaagacucauaucaguagcuggggagacguccccuacuuaggcaaaagggaggaccaauggugcggcucgcugauuggguugaccgcacgagcuacgugggccacaaacauccagguggcgauuaaucagguuagacggcugaucggaaacgaaaauuaccucgauuauaugaccuccaugaagagguuuaaaaacgagucugacccugaaggugcucuuugguga

SEQ ID NO: 14091 - RNA, 9879 nt, Artificial Sequence
  derived and/or modified CDS sequence (opt3) from DENV-1__JQ045639__SS-prME
agcgugaccauguuccugaugcucaugcccacagcccuugcuuuucaccugacuacgagaggaggggaaccucauaugaucgucuccaagcaggaaaggggaaaaucuuuguuauucaagaccucagccgguguuaauaugugcacacugauugccauggaccuaggcgaacucugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccgggucguucaaacucgagaaggaacuggccgagacgcagcacgguacaguccuugugcagauaaaguacgagggcaccgacgcuccuugcaaaaucccauuuucgacucaagaugaaaaggggguuacacagaacggacgcuugauuaccgcgaaucccaucgugacugacaaagagaagccuguaaacauagaagcagagccacccuucggcgagucuuauauugucaucggugccggggaaaaagcucugaagcucuccugguuuaagaaaggcucaaguaucggaaagauguucgaggccaccgcaagaggcgccaggcggauggcuauucugggggauacagccugggacuuuggaagcaucgguggcguguucacguccguugggaaacuugugcaucagauuuuuggaaccgcauacggcguccuguucucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuuugucaccaaugagguucacacguggacagaacaauauaaguuccaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguuuacugugguagucggcgauguggcagggauucuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcuuaaguugagggauuccuauacgcaggucugcgaccaccgucucaugucagcugcaauuaaagauaguaaggccgugcacgcugacaugggguacuggaucgaaucugagaaaaaugaaaccuggaagcuggcccgggcauccuucauugagguuaagacuuguaucuggccaaaaucccauacacuauggucaaacggagugcuggaaagcgagaugauaauccccaagauuuauggcgguccuaucucucaacacaauuaccgaccaggcuacuuuacccagacugcggggccguggcaucucggaaaacuggagcuugauuucgacuugugcgaaggcacaaccguagucguggaugagcacugcgggaacagaggacccucccugaggacgacuaccgugacaggcaagauuauccacgaaugguguugccgcaguuguaccuuaccuccacuccgguuuagaggugaggacgggugcugguauggaauggagauaaggcccgucaaagaaaaggaggaaaaucugguuaagagcauggugucugccggcuccggugagguagacucauucagucuuggccuguuguguauuagcaucaugaucgaagaggugaugcgcucgcgauggucccggaaaaugcucaugacugggacacuggcugucuuuuuccuacugauuaugggacagcucaccuggaacgaucugauccgucuuugcauuauggugggcgccaaugcaucugacagaauggggaugggaacaacuuacuuggcucugauggccaccuuuaagaugaggccuauguucgcaguuggcuuacucuuucgccggcugacgagcagagaggugcuucugcuaacaauaggucucucacuggucgccaguguggaauugccaaacucccuggaggaauuaggggauggacucgcuaugggcaucaugauucugaaacuucugaccgacuuccaaucucaucaguugugggcgacucuccugagccuaaccuuuaucaagacaacuuucucccugcacuaugccuggaaaaccauggcaaugguucuuucaauugugagccucuuuccccuguguuugaguacgacaucucagaagaccacuuggcugccggucuuacucggcucccuggggugcaagccucuuacaauguuccugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaaccaugaagaucaaagaugaggagcgcgacgauacucucacaauccugcuuaaggccacccuguuggcugugaguggcgucuauccccuaagcauuccagcaacgcuguucguuuggcauuuuuggcagaaaaagaagcagcggucuggcgugcucugggacacuccuucacccccagaaguggagagagccguccuggaugacgggauauacaggaucaugcagcguggacuuuuaggucgcagccaggugggcguugggguauuccaagaaaacguguuucacaccauguggcacgucacacggggagcggugcugauguaucagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucucgauuuuaagccugggacgucgggaagcccaaucgugaaccgagaaggcaaaauaguuggucuguacgggaauggaguggucacaacuucaggcaccuauguguccgccaucgcacaggcucgggccagucaggagggcccccuuccugagauugaagacgagguuuuccgcaagagaaaccugacaaucauggauuugcauccggggucuggaaaaaccaggcgguaccuaccagcgauugugcgagaagccaucaagagaaaacugcgcacucucauauuagcacccaccagggucguggcuagcgagauggccgaagcucugaaggguaugccuauucguuaucaaacaacggcaguaaaguccgagcacacuggcaaagagaucguggaccuuaugugccaugccaccuuuacaaugcggcugcucucaccaguuagaguccccaauuacaacaugaucauuauggaugaagcccacuucaccgacccuucuagcaucgcugcgaggggguauauaaguacucgcgugggaaugggcgaggcagccgcuauuuuuaugacagccaccccgcccgguuccguggaagcauucccacagagcaaugccgucauccaggaugaggaacgagacauuccugagagaucuuggaacucaggguacgaguggaucacggauuuucccggaaagacuguaugguucgugccauccauaaaaaguggcaaugacauugcuaacuguuugcggaagaauggcaaaaggguuauccagcugagccgcaagacauucgauaccgaauaucaaaagaccaaaaacaacgacugggacuacguggucacuacagauaucucggagaugggggcgaauuuucgugccgacagagugauugauccucggaggugccucaagcccguuauccugaaagacggaccagaacgcgugauucuugcagguccgaugccugucaccguggcuucugccgcacagcgaagaggccggauagggaggaaccauaauaaggagggagaucaguacaucuauaugggccagccccuaaacaaugacgaggaucacgcccacuggacagaagcuaaaaugcuguuggacaacauuaauacuccagaggguaucauccccgccuuauucgaaccugagcgcgaaaaguccgcggcaauugauggggaguacagacugaggggcgaggcccggaagacguuuguagaacucaugcgucgcggagaccugccaguguggcuuagcuauaaaguugcuucagagggcuuccaauacagugaucgaagauggugcuuugacggggaaaggaacaaucagguccuggaggaaaacauggauguggagauauggaccaaggagggagaacggaaaaagcuccgccccagaugguuggacgccaggacauauucugacccucuggcucuacgggaguucaaagaauuugcagccggucgaagauccgugagcggcgaucugauccucgagauugggaaacuuccgcagcaucugacucagcgcgcucaaaaugccuuagacaacuuggucaugcugcacaauucagaacagggaggcagggcauaccggcaugcgauggaggagcucccagauaccaucgaaacacugaugcuucuggcccucauugcuguuuugaccgguggggugacucuguucuuuuuaaguggccguggacuaggcaaaacgagcaucgggcugcucuguguaauggccuccucugcacuucuguggauggcuagcguggagccccacuggauagccgcauccaucauuuuggaguucuuucugaugguccuccugaucccugagcccgacagacagaggaccccacaggauaaccaacuugccuaugugguuauuggacuccuguucaugaucuugacaguggcugcgaaugagaugggucuguuagaaacuaccaagaaggaccuaggcauagggcacgccgcagucgagaaccaucaccaugcugccaugcuggauguagaccuccacccugccucagcauggacacuuuacgcuguggccaccacuauuaucacacccaugaugcgccauacgauugaaaacaccacugcgaauaucucucugacagcuauagccaaccaggcagccaucuugaugggacuggauaaaggcuggccaauuaguaagauggacaucgguguuccucuccuggcucuugggugcuacagccaggugaauccguuaacccugaccgcagccguccucauguugguggcgcacuaugcuauuaucggccccggacugcaagccaaagcaacacgggaggcccagaagcgaacugcugccggcauaaugaaaaacccaacggucgaugggauuguggcaaucgaccuagauccuguuguguacgacgcuaaguuugaaaagcagcugggacagaucaugcuccuuauucuguguaccagccaaaucuugcugaugagaacaacuugggcccucugcgaguccauaacccuggcgacaggccccuuaaccacucuuugggaggguucuccagggaaauucuggaauacgacaauugccguaucaauggcaaacaucuucaggggaagcuaucuggcuggcgccggucucgcauuuucccuaaugaagagucugggcgggggacgccggggcaccggggcucagggagaaacuuugggcgagaaauggaagagacagcugaaucagcucucuaaaagcgaguucaacaccuacaagcguucagguauuauggagguggacagguccgaagccaaggaggggcuuaaacggggagagacaacuaagcacgccgucagucgcggcaccgcgaaacugcgaugguuuguugaaagaaauuuggugaagccugaggguaaagucaucgaucugggcugugggaggggaggcuggagcuauuacugcgcugggcucaagaaggugacagaaguaaaaggauauacgaagggcggucccgggcaugaggaaccgauaccaauggcaaccuacggauggaacuuagugaaacugcacucuggcaaggacguuuucuuuaucccucccgagaaaugugauacucuucugugcgacauuggcgaguccucaccaaaucccacaaucgaagaggggcggacccuacgcgugcucaagauggucgaaccuuggcugagaggaaaccaauucuguauuaaaaucuugaauccguacaugcccagcguggucgagacucuggagcagaugcagaggaagcaugguggcaugcucgugcgaaacccacuuucgagaaauucuacacacgaaauguauuggguuaguugcgggaccggaaacauuguauccgccgugaauaugacgagccguaugcuguuaaacagauuuaccauggcucaccgcaagccuacauacgagagggaugucgaccugggcgccgguacucggcauguggcaguugaacccgagguggccaacuuggauaucauagggcagagaauugaaaauaucaaacacgagcauaagucaaccuggcacuaugacgaggauaacccuuacaaaacaugggcuuaucauggauccuacgaagucaagccaucuggcagcgcgaguuccauggugaauggcguagugaaacuccugacuaagcccugggacguuaucccuauggucacccaaauugccaugacagauaccacuccauucgggcagcagcgcguguuuaaggagaaaguggacacgaggacacccaaggcaaaacgaggaaccgcucaaauaauggaagucacugccaaguggcuaugggguuuccuuagccggaacaaaaagccgagaaucuguaccagggaggaauuuacacgcaagguucguucuaaugcagccauuggcgcuguguucguagacgagaaccaguggaacucagccaaagaggcgguggaagaugagcgguuuugggaccugguccacagagaaagggagcuccacaagcaggggcgcugcgcaacgugcguguauaacaugaugggaaaacgagaaaagaaacugggcgaguucgguaaggccaaggggagucgggcuaucugguacaugugguugggagccagauuccuggaguuugaagcacucggcuucaugaaugaggaucauugguuuuccagggaaaacagccuuucuggcguugagggggagggacugcacaaauuagguuacauucugcgcgacaucucgaagauaccuggcgggaauauguaugcugaugacaccgccggaugggauacuagaaucacagaagacgauuugcagaacgaggcucggauuaccgacaucauggaaccagagcaugcccuccuggcaaaaucaauuuucaagcuaacuuaccaaaauaaaguggucagggugcagcgucccgcgaagaacggcacaguaauggauguuaucagccgacgcgaccagagagguuccggacaggugggaaccuauggccuuaauacauuuacuaacauggaagcccaacugauacggcagauggagagugagggcauuuucucuccuagcgaacucgagaccccaaaccuggcugaaagggucuuggauugguuagagaaauacgggguggaacgccugaagagaauggccaucuccggagacgacuguguggucaagcccaucgaugaccgguuugcaacggcucucaccgcccuuaaugauauggguaaaguuaggaaggacauuccgcagugggagccuucaaaaggcuggaacgauuggcagcaagugcccuucugcagucaccacuuucaucagcugauaaugaaggacgggcgagagaucguagugccaugucguaaucaggaugagcuagucggacgggcacgcgugucucagggcgccgguuggagccugcgggagacagcgugccucgggaaauccuaugcucaaauguggcaguugauguacuuccacaggagagaccugcgccuugccgcaaacgccauuuguucagcuguuccuguggauuggauccccacuagccggaccacauggucuauucaugcccaccaucaguggaugacuaccgaagacaugcuguccgucuggaauaggguguggaucgaggaaaacccauggauggaggauaagacgcacauaaguagcugggaggacguacccuaucucggaaagcgagaagaccaauggugcggcucguuaaucggccugacagcaagagcuaccugggccacuaauauucagguugcgaucaaccaggugcggagguugauugggaaugagaacuaccuggauuacaugacauccaugaaacgcuuuaagaaugaaucugacccugagggagcucucugguga

SEQ ID NO: 14092 - RNA, 9879 nt, Artificial Sequence
  derived and/or modified CDS sequence (opt3) from DENV-1__JQ045641__SS-prME
uccgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguugcgcagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccguugggaaacuggugcaucagauuuucggaacggcguacggcgucuuguuuucuggugugagcuggaccaugaagauagggaucggcguacuccugacuugguuaggacuaaauucacgaaguacaucccuaagcaugaccuguauugcugugggccucguuacacuguaccuuggggucauggugcaggccgauucuggaugcgugaucaacuggaaaggccgcgaauugaagugugguucagggaucuucgucacuaaugagguucacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccgugguagucggcgauguggcugggauucuugcccagggcaaaaagaugauccgcccucaacccauggaguacaaauauucguggaaaagcuggggcaaggcgaagauaaucggggccgacguucagaauacuaccuuuauuaucgauggaccaaacacaccugaaugucccgacgaucagagagcuuggaauauuugggagguggaggacuacggcuucgguaucuuuacuaccaacauaugguugaagcucagggauuccuauacacaggucugcgaccaccgucugaugucagcagccauuaaagauaguaaggcugugcacgccgacaugggguacuggaucgaaucugagaaaaaugaaacguggaagcuagcacgggcgagcuucauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgccgggccguggcaucugggaaaacuugaguuggauuuugaccugugcgaaggcacuacaguagucguggaugagcacugcgggaacagaggacccuccuuaaggaccacgacugugaccggcaagauuauccacgaaugguguugccgcaguuguacacucccuccacugcgguucagaggugaggacgggugcugguauggaauggagauaaggcccgucaaagaaaaggaggaaaaucuuguuaagagcauggugucugcuggcuccggugagguagacucauuuagucugggcuugcucuguauuagcaucaugaucgaagaggugaugcgcucgcgauggucccggaaaaugcugaugaccgggacucuagccgucuucuuucugcucauuaugggacagcugacauggaacgaucuuauccguuugugcauuauggugggcgcaaaugcuucugacagaauggggaugggaaccacauaccuggccuuaauggcaacuuucaagaugaggccuauguuugccguuggccuccuguuccgccggcuuaccagcagagaggugcugcuacucacgauaggucugucauuggucgcuaguguggaacugccaaacuccuuagaggaacucggggauggacuggcgaugggcaucaugauucuuaaacuguugacagacuuucaaucucaucagcucugggccacccugcuaagccugacuuucaucaagaccacacuuucccuccacuaugcauggaaaacuauggcuaugguucugucaauugugagcuuguuuccccuguguuuaaguaccacgucucagaagacaaccuggcucccgguccugcuuggcucccuggggugcaagccuuugacuauguuccucaucgccgagaauaaaauauggggaaggcgaagcuggccacugaacgaagguaucauggccguaggcauugugucgauccuacugucaucucuucucaagaacgauguuccccuggcugggccuuugauugcaggaggcauguuaaucgccuguuacgugauaagugguuccagcgcggaccugucucucgagaaagcugccgaggucagcugggaagaggaagcagagcauuccggggccucacacaauauucugguggaaguacaggaugacggaacaaugaagaucaaagaugaggagcgcgacgauacccuuacuauccuguugaaggcuacacuacuggcagugaguggcgucuauccccucagcauuccagccacccuguuuguuugguacuucuggcagaaaaagaagcagcggucuggcgugcuuugggacacgccuucacccccagaaguggagagagcggucuuagaugacgggauauauaggaucaugcagcguggacugcucggucgcagccaggugggcguugggguauuccaagaaaacguguuucauacuauguggcacgucacccggggagcuguguugauguaccagggcaaaagacuggagccgaguugggccagcguuaagaaagaccucauuuccuacggugggggauggaggcugcagggcucuuggaauacaggcgaggaagugcaggucaucgcaguggagccugggaagaaccccaaaaauguacaaaccgccccaggaacauucaagacucccgaaggugaggucggcgcuauugcccuugauuuuaagccugggaccucgggaagcccaaucgugaaccgagaaggcaaaauaguuggucuguaugggaauggaguggucacgacaucaggcacuuacguguccgcaaucgcucaggccaaggcgagucaggagggccccuugccugagauugaagacgagguuuuccggaaacgcaaccuaaccaucauggaucugcacccggggucuggaaagacaagaagguaucucccagccauugugcgggaagcaaucaaacgaaaguuaagaacccugauacuugcucccacucgcgucguggccagcgagauggcugaagcacugaaggguaugccuauuagguaccaaaccacagccguaaaauccgagcauacgggcaaggagaucguggaccucaugugccacacuaccuuuacaaugcguuugcugucaccaguucggguccccaauuauaacaugaucauuauggaugaagcccauuucaccgacccuucuagcaucgcugcgagaggguacauaaguacuagggugggaaugggcgaggcagccgcuauuuuuaugacagccaccccgcccgguuccguggaagcauucccacagagcaaugccgucauccaggaugaggaacgcgacauuccugagcgaucuuggaacucaggguaugaguggaucacggauuuucccggaaaaacuguaugguucgugccauccauaaagaguggcaaugacauugcuaacugucucaggaaaaauggcaagcggguuauccagcugagcaggaagacauuugauaccgaauaccagaaaaccaagaacaacgacugggacuacguggucacuacagauaucucggagaugggggcgaauuuccgcgccgaccgugugauugauccuagacggugccuuaaacccguuauccuaaaggacggaccagaaagggugauucuggcagguccgaugccugucaccguggcuucugccgcacagcgccgaggcagaauagggcggaaccacaauaaagagggagaucaguauaucuacaugggccagcccuugaacaaugacgaggaucaugcccacuggacagaagcuaagauguuacuggacaacauuaauacuccagaggguaucauccccgcccucuucgaaccugagagggaaaaguccgcggcaauugauggggaguaucgccugagaggcgaggccaggaaaacguuuguagaacuuaugcggcguggagaccugccaguguggcucagcuacaagguugcuucagagggcuuccaauauagugaucgccgauggugcuuugacggggaaagaaacaaucaggucuuggaggaaaacauggauguggagauauggaccaaagagggagaaaggaagaaacugcggccccgcuggcuagacgccagaacauacucugacccucuggcucucagggaguucaaggaauuugcagccggucggcgauccgugagcggcgaucuuauccuggagauugggaaauuaccgcagcacuugacucagagagcucaaaaugcccuggacaaccucgucaugcugcauaauucagaacagggaggccgcgcauauaggcacgcgauggaggagcuuccagauaccaucgaaacacugaugcucuuggcccugauugcuguuuuaaccgguggggugacucuauucuuucugaguggccggggacucggcaagacgagcaucgggcuucuguguguaauggccuccucuguguugcuguggauggcaagcgucgagccccauuggauagcugccuccaucauucucgaguucuuucugauggugcuucucaucccugagcccgaccgucagagaaccccacaggauaaccaacuggcauacguugugauuggauugcuguucaugaucuuaacagucgccgcuaaugagaugggucuacuggaaacuaccaagaaagaccucggcauagggcacguagcgguggagaaccaccaucacgccgcaaugcuugauguugaccugcauccugcuucagccuggacauuguacgccguggcaaccacuauuaucacacccaugaugaggcacacgauugaaaacaccacugcuaauaucucucugacagccauagcgaaccaggcugccauccucaugggacuggauaagggcuggccaauuaguaaaauggacaucggugucccucuuuuagcacuggggugcuauagccaggugaauccgcucaccuugaccgccgcuguccugaugcuaguggcacauuacgccauuaucggccccggacugcaagcgaaggcuacacgcgaggcccagaaacggacugcagccggcauaaugaagaacccaacgguugaugggauuguggcuaucgaccucgauccuguaguguaugacgccaaguuugaaaaacagcuuggacagaucaugcuguugauucuguguaccagccaaauccuccugaugcgaacaacuugggcauuaugcgaguccauaacccuugcuacaggcccccugaccacucucugggaggguucuccagggaaguucuggaauacgacaauugccgucucaauggcgaacaucuuuagaggaagcuaccuagccggcgcaggucuggcuuucuccuugaugaaaagucugggcgggggaaggcgcggcaccggggcccagggagaaacucucggcgagaaguggaaacggcagcuuaaucagcugucuaagagcgaguucaacaccuauaagagaucagguauuauggagguugaccguuccgaagcaaaagagggguugaagaggggagagacaacuaaacacgcugugagucggggcaccgccaagcugcgcugguuugucgaacgaaaucucgugaaaccugaggguaagguaaucgauuuaggcugugggagaggaggcuggagcuacuauugcgccgggcugaagaaagugacagaaguuaagggauacacgaaaggcggucccgggcacgaggaaccgauaccaauggcgaccuacggauggaaccuugugaagcugcauucuggcaaagacgucuucuuuaucccucccgagaagugugauacucuacucugcgacauuggcgaguccucaccaaaucccacaaucgaagaggggaggacccugcggguguugaaaauggucgaaccuuggcugcgcggaaaccaauucuguauuaagauccucaauccguauaugcccagcgugguugagacucuugagcagaugcagagaaagcacgguggcaugcugguaaggaacccauuaucgcgaaauucuacacaugaaauguacugggugaguugcgggaccggaaacauugucuccgcugugaauaugacgagccggaugcuguugaaccguuuuaccauggcacacagaaaaccuacauaugagcgcgauguugaccucggcgccgguacuaggcacguggcugucgaacccgagguggccaaccuggauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcuacuuacuaagcccugggacgugaucccuauggugacccaaauugcuaugacagauaccacuccauucgggcagcagagagucuuuaaagagaagguugacacgcgcacacccaaagcgaagaggggaaccgcccaaauaauggaagugacugcaaaauggcugugggguuuccucagccgaaacaagaagccgcggaucuguaccagagaggaauuuacaaggaaaguacgcucuaaugcugccauuggcgcaguguucgucgacgagaaccaguggaacucagccaaggaggcuguggaagaugagcguuuuugggaccugguucaucgggaaagagaguugcacaaacaggggaagugcgccacgugcguguacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcgucgagggggagggacugcauaaauuggguuauauucucagagacaucucgaagauaccuggcgggaauauguacgccgaugacaccgcaggaugggauacuaggaucacagaagacgaucugcagaacgaggcucgcauuaccgacaucauggaaccagagcacgcccuacuugcuaaaucaauuuucaagcugacuuaucaaaauaaagugguaagaguucagcggcccgccaagaacggcacagugauggaugucaucagcaggcgugaccagcgagguuccggacaggugggaaccuacggccucaauacauuuacuaacauggaagcacaacugauacgccagauggagagugagggcauuuucucuccuagcgaauuggagaccccaaacuuagcggaaagagugcuggauuggcucgagaaguauggggucgaacggcuuaaaaggauggccaucuccggagacgacuguguugugaagcccaucgaugaccgcuuugcuacggcccugaccgcacuaaaugauauggguaaaguaagaaaggacauuccgcagugggagccuucaaaaggcuggaacgauuggcagcaagugcccuucugcagucaucacuuucaccagcugauaaugaaggacgggcgggagaucgucgugccauguaggaaucaggaugaacucguuggacgagcucgugugucucagggcgccgguuggagcuugagagagacagcaugccuggggaaguccuacgcccaaauguggcagcuuauguauuuccaucgccgggaccugaggcucgcggcuaacgccauuuguucagcagucccuguggauuggauccccacuagcagaaccacauggucuauucacgcccaucaccaguggaugacuaccgaagacauguuauccguauggaaucgcguuuggaucgaggaaaacccauggauggaggauaaaacgcauauaaguagcuggggagacgugcccuaccugggcaagcgggaggaccaauggugcggcucguugaucgggcugacagcuagggccaccugggcaacuaauauucaggucgcuaucaaccaggugcgaagacucauuggaaaugaaaacuaccuugauuauaugacauccaugaaacgguuuaagaaugagucugacccugaaggugcccugugguga

SEQ ID NO: 14093 - RNA, 9879 nt, Artificial Sequence
  derived and/or modified CDS sequence (opt3) from DENV-1__JQ045642__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcagugugaaaacuuaaaauacucagucaucgugaccguucacacuggagaccagcaucaaguggguaaugagaguacggaacacggcacaaccgcuacuauuacaccccaagccccuaccaccgagauccagcugacugacuauggggcgcucacacuugauugcagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugucgucugaagauggauaaacuaacucucaaggggauguccuacgugaugugcaccgguagcuucaaacuggagaaggaagucgccgagacgcagcacggaacagugcuuguucagauaaaguaugagggcaccgacgcuccuuguaaaaucccauucucgacucaagaugaaaagggggugacacagaacggacgcuugauuaccgcgaaucccaucguaacugacaaagagaagccugucaacauagaagcagagccacccuuuggcgagucuuacauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauauggcgugcuguuuucugguguaagcuggacuaugaagauagggaucggcguguugcucacauggcugggauuaaauucacgaaguaccucccugagcaugacaugcauugcgguuggccuagucacucucuaccugggggugauggugcaggcugauucuggaugugucaucaacuggaaaggccgcgaacuuaagugcgguucagggaucuucguuaccaaugaggugcacacguggacagaacaauacaaguuucaggccgacaguccgaaaagauugagcgcagccauuggaaaggcuugggaggagggcgugugugguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguauaaauacucguggaaaagcuggggcaaggccaagauaaucggggcggacgugcagaauaccacauuuauuaucgauggaccaaacacuccugaaugccccgacgaucagagagccuggaauauuugggaggucgaggacuauggcuucgguaucuuuaccacaaacauauggcuuaaguugagggauuccuacacacaggugugugaccaccgucucaugucagcugcaauuaaagauaguaaggccguucacgcugacaugggguauuggaucgaaucugagaaaaaugaaaccuggaagcuggcccgggcauccuucauugaggugaagacuugcaucuggccaaaaucccauacacuauggucaaacggaguacuggaaagcgagaugauaauccccaagauuuacggcgguccuaucucucaacacaauuaucgaccaggcuacuucacccagacugcggggccguggcaucucggaaaacuggagcuugauuuugacuugugcgaaggcacaaccgucgugguggaugagcacugugggaacagaggacccucccugaggacgacuaccgucacaggcaagauuauccacgaauggugcugucgcaguugcaccuuaccuccacuccgguucagaggugaggacggguguugguacggaauggagauaaggcccguuaaagaaaaggaggaaaaucugguaaagagcaugguaucugccggcuccggugagguggacucauuuagucuuggccuguugugcauuagcaucaugaucgaagaggucaugcgcucgcgauggucccggaaaaugcucaugacugggacacuggcuguguucuuucuacugauuaugggacagcucaccuggaacgaucugauccgucuuuguauuaugguuggcgccaaugcaucugacagaauggggaugggaacaacuuauuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuacgccuggaaaaccauggcaauggugcuuucaauugucagccucuucccccugugcuugaguacgacaucucagaagaccacuuggcugccgguauuacucggcucccugggguguaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcaugcuaugucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuacccccuaagcauuccagcaacgcuguucgugugguauuucuggcagaaaaagaagcagcggucuggcgugcucugggacacuccuucacccccagaagucgggagagccgugcuggaugacggaauauacaggaucaugcagcguggucuuuuaggccgcagccagguugggguaggaguguuucaagagaacgucuuccauaccauguggcacgugacacggggcgcgguucugauguaucaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguacggaaauggcgucgugacaacuucaggcaccuauguuuccgccaucgcacaggcuaaggccagucaggaagggccccuuccugagauugaggacgaaguguuucggaaacgcaaccugacaaucauggauuugcacccgggaucugguaagaccagaagguaccuaccagcgauuguccgggaggccaucaaacgaaagcugagaacucucauauuagcacccacccgcgugguagcuagcgaaauggccgaggcucugaagggcaugccuauuagguaucaaacaacggcagugaaauccgaacauacugggaaggagaucguugaccuuaugugucacgccaccuucacaaugcgucugcucucaccaguccgggugcccaauuacaacaugaucauuauggaugaggcccauuuuaccgacccuucuagcaucgcugcgagaggauauauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauacgaguggaucacggauuuccccggcaaaacugugugguuuguuccauccauaaagaguggcaaugacauugcuaacugcuugaggaaaaaugggaagcgggugauccagcugagcaggaagacauucgauaccgaguaucagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguacaucuauaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaccgccugagaggagaggccaggaaaacguucguggagcucaugcggcguggcgaccugccaguuuggcuuagcuauaaggucgcuucagaaggguuucaauacagugaucgccgaugguguuucgacggagagagaaacaaucaggugcuggaagagaacauggauguggaaauauggaccaaagagggugagaggaagaaacuccggccccgcugguuggacgccagaacauauucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauacaggcacgcgauggaggaacucccagauaccaucgagacacugaugcuucuggcccucauugcuguguugaccgggggcguaacucuguuuuucuuaaguggacggggccuagggaagacgagcaucggacugcucugcgugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauauguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcuguuacucgcaggucaauccguuaacccugaccgccgcugugcucauguugguugcacauuaugccauuaucggacccggccugcaagcgaaggcuacacgcgaagcccagaaacggacugcagccgggauaaugaagaacccaacgguggauggaauuguagcuaucgaccuagauccuguggucuacgacgccaaguucgagaaacagcugggccagaucaugcuccuuauucugugcaccagccaaaucuugcugaugcgaacaacuugggcacucugugaauccauaacccuggcuacaggucccuuaaccacucuuugggaggggucuccaggaaaguuuuggaauacgacaauugccguuucaauggcgaacaucuucagaggcagcuaucuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuacaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucuggggugcggaagaggcggguggagcuauuacugugccggacucaagaaaguuacagaggugaagggcuauacgaaaggugggcccggacacgaggagccgauaccaauggcgaccuacggcuggaacuuagucaagcugcauucuggcaaagacguguuuuucaucccucccgaaaagugcgauacucuucugugugacauuggggaguccucaccaaaucccacaaucgaggaaggaaggacccuacggguccucaaaaugguggagccuuggcugcgcgguaaccaauuuugcauuaagaucuugaauccguacaugcccagcguuguagaaacucuggagcagaugcagagaaagcacggcgggaugcucgugaggaacccacuuucgcgaaauucuacacaugagauguauugggucaguuguggaaccggcaacauuguguccgcuguuaauaugacgagccggaugcuguuaaaccguuucaccauggcacacagaaaaccuacauacgaacgcgauguggaccugggugccgggacuaggcacgucgcuguggagcccgaaguagccaacuuggauaucauaggacagcggauugagaauaucaagcaugaacacaaaucaaccuggcauuaugacgaggauaacccuuacaagacaugggcauaucacggcuccuacgaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucugcaccagagaagaguucacaaggaaagugcgcucuaaugcugccauuggggcagucuuuguggacgaaaaccaguggaacucagccaaggaggcuguugaggaugaacguuucugggaccuggugcaucgggagagagaacuccacaaacagggaaagugcgccacgugugucuauaacaugaugggcaaaagggagaagaagcugggugaauuugggaaagcgaagggaagucgcgcaaucugguacaugugguugggcgcccgauuccuggaguucgaggcucucggcuuuaugaaugaagaucacugguucucccgggagaacagccuuucugggguggaaggagagggucugcauaaauuaggcuacauucugagagacaucucgaagauaccugggggaaauauguaugccgaugacaccgcaggcugggauacuaggaucacagaggacgauuugcagaacgaagcucgcauuaccgacaucauggagccagaacacgcccuccuggcuaaaucaauuuuuaagcuaacuuaccaaaauaaaguaguuagagugcagcggcccgccaagaacgguacagucauggaugugaucagcaggcgugaccagcgaggguccggacaggugggcaccuauggccuuaauacauucacuaacauggaggcacaacugauacgccagauggaaagugaggggauauuuucuccuagcgagcucgaaaccccaaaccuggcggagagagucuuggauugguuagaaaaguacggaguugagcggcugaaaaggauggccaucuccggugacgacugcgugguaaagcccaucgaugaccgcuucgcuacggcccucaccgcacuuaaugauaugggcaaagugagaaaggacauuccgcagugggaaccuucaaaaggguggaacgauuggcagcaaguccccuuuuguagucaucacuuccaccagcugauaaugaaggacggacgggagaucgugguuccaugcaggaaucaggaugagcuagugggccgagcucgugucucucagggugccggguggagccugagagaaacagcaugucucggaaaguccuaugcccaaauguggcaguugauguacuuucaucgccgggaccugaggcuugcggcuaacgccauuugcucagcagugccuguagauuggauccccacuagcagaaccacauggucuauucacgcccaucaccaguggaugacuaccgaggacaugcuguccguuuggaaucgcguguggaucgaagagaacccauggauggaagauaaaacgcauauaaguagcuggggcgacguccccuaucucggcaagcgggaggaccaauggugugggucguuaaucggacugacagcuagggccaccugggcaacuaauauucagguggcuaucaaccagguucgaagauugauugguaaugagaacuaccuggauuacaugacauccaugaaacgguucaagaaugaaucugacccugagggcgcccucugguga

SEQ ID NO: 14094 - RNA, 9879 nt, Artificial Sequence
  derived and/or modified CDS sequence (opt3) from DENV-1__JQ045644__SS-prME
agcgugaccaugcugcucaugcuuaugcccacggcacuggcuuuccacuugacuacgagaggaggggaaccucauaugaucgucuccaagcaggaaagaggaaaaucuuuacuguuuaagaccucagccgguguuaacaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccgcauucaagaugaggccuauguuugccgugggcuuacucuuccgccggcugaccagcagagagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaagaccacauuuucccugcacuaugcauggaaaacuauggcuauggugcuuucaauugucagccucuucccccuguguuugaguaccacgucucagaagacaaccuggcugccgguauuacucggcucccuggggugcaagccucuuacuauguuucugaucgccgagaauaaaauauggggaaggcgaagcuggccauugaacgaagguaucauggccgugggcauuguuucgauccuccugucaucucuacugaagaacgaugugccccuugcugggccucucauugcaggaggcaugcugaucgccuguuacgucauaagugguuccagcgcggacuugucuuuagagaaagcugccgaggugagcugggaagaggaagcagagcauuccggggccucacacaauauucugguagaagugcaggaugacggaacaaugaagaucaaagaugaggagcgcgacgauacccucacuauccugcuuaaggcuacacuguuggcagucaguggcguuuauccccuaagcauuccagccacccuguucgugugguacuucuggcagaaaaagaagcagcggucuggcgugcucugggacacgccuucacccccagaagucgagagagcggugcuggaugacgggauauauaggaucaugcagcguggacuuuuaggucgcagccagguuggcguagggguguuucaagaaaacgucuuccauacuauguggcacgugacccggggagcuguucugauguaccagggcaaaagacucgagccgaguugggccagcgugaagaaagacuugauuuccuacggugggggauggaggcugcagggcucuuggaauacaggcgaggaaguccaggugaucgcaguagagccugggaagaaccccaaaaauguccaaaccgccccaggaacauuuaagacucccgaaggugaggugggcgcuauugcccucgauuucaagccugggaccucgggaagcccaaucguuaaccgagaaggcaaaauagugggucuguaugggaauggagucgugacgacaucaggcacuuacguuuccgcaaucgcucaggccaaggcgagucaggagggcccccuuccugagauugaagacgagguguuucggaaacgcaaccugaccaucauggauuugcacccggggucuggaaagacaagaagguaucuaccagccauuguccgggaagcaaucaaacgaaagcugagaacccucauauuagcucccacucgcgugguagccagcgagauggcugaagcacugaaggguaugccuauuagguaccaaaccacagccgugaaauccgagcauacgggcaaggagaucguugaccuuaugugccacgccacuuucaccaugcgucugcucucaccaguccgggugcccaauuauaacaugaucauuauggaugaagcucauuuuacagacccuucuagcaucgcggcaagaggguacauaaguaccagggugggaaugggcgaggccgcugccauuuucaugacugcaacaccgcccgguuccgucgaagccuuuccacagagcaaugcuguaauccaggaugaggaacgcgacauuccugagcgaucuuggaacucaggguaugaguggaucaccgauuuccccggaaaaacggugugguuuguuccauccauaaagaguggcaaugacauugcgaacuguuugaggaaaaauggcaagcgggugauccagcugagcaggaagacuuucgauacagaauaccagaaaaccaagaacaacgacugggacuacgucgugaccacugauaucucggagaugggggccaauuuccgcgcagaccguguuauugauccuagacggugccucaaacccgugauccugaaggacggaccagaaagggucauucuugcugguccgaugccugugacaguagccucugcagcccagcgccgaggcagaauagggcggaaccacaauaaagagggagaucaguauaucuacaugggccagccccuaaacaaugacgaggaucaugcucacuggaccgaagccaagaugcuguuggacaacauuaauacaccagaggguaucauccccgcguuauuugaaccugagagggaaaaguccgcagccauugauggggaguaucgccugagaggcgaggcuaggaaaacuuucguggaacucaugcggcguggagaccugccaguuuggcuuagcuacaaggucgccucagagggcuuucaauauagugaucgccgauggugcuucgacggggaaagaaacaaucaggugcuggaggaaaacauggauguggagauauggacgaaagagggagaaaggaagaaacuccggccccgcugguuggacgcuagaaccuacucugacccucuggcacuaagggaguuuaaggaguucgccgcuggucggcgauccgucagcggcgaucugauccucgagauugggaaacuuccgcagcaccugacacagagagcccaaaaugcauuagacaacuugguuaugcugcauaauucagaacagggaggccgcgcguauaggcacgccauggaggagcucccagauacuaucgaaacccugaugcuucuggcucucauugccguguugacaggugggguaacccuguuuuucuuaaguggccggggacuaggcaagacuagcaucgggcugcucugugugauggcauccucuguccuucuguggauggcuagcguggagccccauuggauagccgcauccaucauuuuggaauuuuuccugaugguucuccugaucccugagcccgaccgucagagaacgccacaggauaaccaacuugccuacguggucauuggacuccuguuuaugaucuugaccguagcugcgaaugagaugggucuguuagaaacaacuaagaaagaccuaggcauagggcacguggccguugagaaccaccaucacgcagcuaugcuggauguggaccuccauccugccucagccuggacccuuuacgcagucgcuacaaccauuaucacucccaugaugaggcacacaauugaaaacacgaccgccaauaucucucugacugcgauagcuaaccaggccgcaaucuugaugggacuggauaagggcuggccaauuaguaaaauggacaucggugugccucuccuggcccuugggugcuauucgcaggucaauccguuaacacugaccgcugcagugcucauguugguugcccauuacgcgauuaucggccccggacugcaagcuaaggccacccgcgaggcacagaaacggacagccgcuggcauaaugaagaacccaacuguggaugggauuguagccaucgaccuagauccuguggucuaugacgcaaaguucgaaaaacagcugggacagaucaugcuccuuauucuguguacgagccaaaucuugcugaugcgaaccacaugggcucucugcgaguccauaacucuggccaccggccccuuaacaacccuuugggaggguucuccagggaaguuuuggaauacuacgauugcgguuucaauggccaacaucuucagaggaagcuaccuggcaggcgcuggucucgccuucucccuaaugaaaagucugggcgggggaaggcgcggcacaggggcacagggagaaaccuugggcgagaaguggaaacggcagcugaaucagcucucuaagagcgaauuuaacacuuauaagagaucagguauuauggagguggaccguuccgaagcuaaagaggggcuuaagaggggagagaccacaaaacacgccgucagucggggcacugccaagcugcgcugguucguggaacgaaauuugguaaaaccugaggguaaggugaucgaucugggcugugggagaggaggcuggagcuacuauugcgcggggcucaagaaaguuaccgaagugaagggauacacaaaaggcggucccgggcacgaggaaccgauaccaauggcuacguacggauggaacuuagucaagcugcauucuggcaaagacguguuuuucaucccucccgagaagugugauacccuucugugcgacauuggcgaguccucaccaaaucccacuaucgaagaggggaggacacuacggguccucaaaaugguggaaccuuggcugcgcggaaaccaauuuuguauuaagaucuugaauccguauaugcccagcguuguagagacccuggagcagaugcagagaaagcacgguggcaugcucgugaggaacccacuuucgcgaaauucuacucaugaaauguacugggucaguugcgggacaggaaacauuguguccgcaguuaauaugaccagccggaugcuguuaaaccguuucacgauggcccacagaaaaccuaccuaugagcgcgauguggaccugggcgcugguacaaggcacgucgccguggaacccgagguagcaaacuuggauaucauagggcagcggauugaaaauaucaagcaugagcacaaaucaacuuggcauuacgacgaggauaacccuuauaagaccugggccuaccacggauccuaugaagugaaaccaucuggcagcgcuaguuccaugguuaauggcgucgugaagcuccugacaaagcccugggacgugaucccuauggucacucaaauugcgaugaccgauacaaccccauuugggcagcagagaguuuucaaagagaagguggacacucgcacgcccaaagccaagaggggaacagcacaaauaauggaaguaaccgcuaaauggcuaugggguuuucuuagccgaaacaagaagccgcggaucuguacuagagaggaguucaccaggaaagugcgcucuaaugccgcaauuggcgccgucuuuguggacgagaaccaguggaacucagcuaaggaggccguugaagaugagcguuucugggaccuggugcaucgggaaagagagcuccacaaacaggggaagugcgcgacaugcgucuacaacaugaugggaaaaagggaaaagaagcugggcgaguuugguaaagcaaaggggagucgcgccaucugguacaugugguugggagcucgauuccuggaguucgaagcccucggcuuuaugaaugaggaucacugguucucccgggaaaacagccuuucuggcguggagggggagggacugcauaaauuagguuauauucugagagacaucucgaagauaccuggcgggaauauguacgcagaugacacggcuggaugggauaccaggaucacugaagacgauuugcagaacgaggcccgcauuacagacaucauggaaccagagcacgcucuccuggccagaucaauuuuuaaacuaaccuaucaaaauaagguaguucgggugcagaggcccgccaaaaauggcacugucauggaugugaucagccgucgagaccagcgcgguuccggacaggugggaacauacggccuuaauaccuucacaaacauggaagcgcaacugauaagacagauggagagugagggcauauuuucuccuagcgaacucgagacuccaaaccuggccgaacgggucuuggauugguuagagaaguaugggguugaaaggcugaagcgcauggcuaucuccggagacgacugugugguaaaacccaucgaugacagauucgccaccgcacucacggcucuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugccagagucucucagggcgcagguuggagccugcgcgagaccgccugccucgggaaguccuacgcgcaaauguggcaguugauguauuuucaucggagggaccugagacuugcugccaacgcaauuuguucagccgugccuguagauuggauccccacaagccgcacuaccuggucuauucacgcucaucaccaguggaugacaacugaagacaugcuguccguuuggaaucggguguggaucgaggaaaacccauggauggaggauaagacccauauaaguagcuggggagacguccccuaccucggcaaaagggaggaccaauggugcggcucguuaaucgggcugacggcccgagcaacaugggcuaccaauauucagguggccaucaaccagguuagacgguugauuggaaaugaaaacuaccuggauuauaugacuuccaugaagagguucaaaaaugagucugacccugaaggugcgcucugguga

SEQ ID NO: 14095 - RNA, 9879 nt, Artificial Sequence
  derived and/or modified CDS sequence (opt3) from DENV-1__JQ045648__SS-prME
uccgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguugcgcagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccguugggaaacuggugcaucagauuuucggaacggcguacggcgucuuguuuucuggugugagcuggaccaugaagauagggaucggcguacuccugacuugguuaggacuaaauucacgaaguacaucccuaagcaugaccuguauugcugugggccucguuacacuguaccuuggggucauggugcaggccgauucuggaugcgugaucaacuggaaaggccgcgaauugaagugugguucagggaucuucgucacuaaugagguucacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccgugguagucggcgauguggcugggauucuugcccagggcaaaaagaugauccgcccucaacccauggaguacaaauauucguggaaaagcuggggcaaggcgaagauaaucggggccgacguucagaauacuaccuuuauuaucgauggaccaaacacaccugaaugucccgacgaucagagagcuuggaauauuugggagguggaggacuacggcuucgguaucuuuacuaccaacauaugguugaagcucagggauuccuauacacaggucugcgaccaccgucugaugucagcagccauuaaagauaguaaggcugugcacgccgacaugggguacuggaucgaaucugagaaaaaugaaacguggaagcuagcacgggcgagcuucauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgccgggccguggcaucugggaaaacuugaguuggauuuugaccugugcgaaggcacuacaguagucguggaugagcacugcgggaacagaggacccuccuuaaggaccacgacugugaccggcaagauuauccacgaaugguguugccgcaguuguacacucccuccacugcgguucagaggugaggacgggugcugguauggaauggagauaaggcccgucaaagaaaaggaggaaaaucuuguuaagagcauggugucugcuggcuccggugagguagacucauuuagucugggcuugcucuguauuagcaucaugaucgaagaggugaugcgcucgcgauggucccggaaaaugcugaugaccgggacucuagccgucuucuuucugcucauuaugggacagcugacauggaacgaucuuauccguuugugcauuauggugggcgcaaaugcuucugacagaauggggaugggaaccacauaccuggccuuaauggcaacuuucaagaugaggccuauguuugccguuggccuccuguuccgccggcuuaccagcagagaggugcugcuacucacgauaggucugucauuggucgcuaguguggaacugccaaacuccuuagaggaacucggggauggacuggcgaugggcaucaugauucuuaaacuguugacagacuuucaaucucaucagcucugggccacccugcuaagccugacuuucaucaagaccacacuuucccuccacuaugcauggaaaacuauggcuaugguucugucaauugugagcuuguuuccccuguguuuaaguaccacgucucagaagacaaccuggcucccgguccugcuuggcucccuggggugcaagccuuugacuauguuccucaucgccgagaauaaaauauggggaaggcgaagcuggccacugaacgaagguaucauggccguaggcauugugucgauccuacugucaucucuucucaagaacgauguuccccuggcugggccuuugauugcaggaggcauguuaaucgccuguuacgugauaagugguuccagcgcggaccugucucucgagaaagcugccgaggucagcugggaagaggaagcagagcauuccggggccucacacaauauucugguggaaguacaggaugacggaacaaugaagaucaaagaugaggagcgcgacgauacccuuacuauccuguugaaggcuacacuacuggcagugaguggcgucuauccccucagcauuccagccacccuguuuguuugguacuucuggcagaaaaagaagcagcggucuggcgugcuuugggacacgccuucacccccagaaguggagagagcggucuuagaugacgggauauauaggaucaugcagcguggacugcucggucgcagccaggugggcguugggguauuccaagaaaacguguuucauacuauguggcacgucacccggggagcuguguugauguaccagggcaaaagacuggagccgaguugggccagcguuaagaaagaccucauuuccuacggugggggauggaggcugcagggcucuuggaauacaggcgaggaagugcaggucaucgcaguggagccugggaagaaccccaaaaauguacaaaccgccccaggaacauucaagacucccgaaggugaggucggcgcuauugcccuugauuuuaagccugggaccucgggaagcccaaucgugaaccgagaaggcaaaauaguuggucuguaugggaauggaguggucacgacaucaggcacuuacguguccgcaaucgcucaggccaaggcgagucaggagggccccuugccugagauugaagacgagguuuuccggaaacgcaaccuaaccaucauggaucugcacccggggucuggaaagacaagaagguaucucccagccauugugcgggaagcaaucaaacgaaaguuaagaacccugauacuugcucccacucgcgucguggccagcgagauggcugaagcacugaaggguaugccuauuagguaccaaaccacagccguaaaauccgagcauacgggcaaggagaucguggaccucaugugccacacuaccuuuacaaugcguuugcugucaccaguucggguccccaauuauaacaugaucauuauggaugaagcccauuucaccgacccuucuagcaucgcugcgagaggguacauaaguacuagggugggaaugggcgaggcagccgcuauuuuuaugacagccaccccgcccgguuccguggaagcauucccacagagcaaugccgucauccaggaugaggaacgcgacauuccugagcgaucuuggaacucaggguaugaguggaucacggauuuucccggaaaaacuguaugguucgugccauccauaaagaguggcaaugacauugcuaacugucucaggaaaaauggcaagcggguuauccagcugagcaggaagacauuugauaccgaauaccagaaaaccaagaacaacgacugggacuacguggucacuacagauaucucggagaugggggcgaauuuccgcgccgaccgugugauugauccuagacggugccuuaaacccguuauccuaaaggacggaccagaaagggugauucuggcagguccgaugccugucaccguggcuucugccgcacagcgccgaggcagaauagggcggaaccacaauaaagagggagaucaguauaucuacaugggccagcccuugaacaaugacgaggaucaugcccacuggacagaagcuaagauguuacuggacaacauuaauacuccagaggguaucauccccgcccucuucgaaccugagagggaaaaguccgcggcaauugauggggaguaucgccugagaggcgaggccaggaaaacguuuguagaacuuaugcggcguggagaccugccaguguggcucagcuacaagguugcuucagagggcuuccaauauagugaucgccgauggugcuuugacggggaaagaaacaaucaggucuuggaggaaaacauggauguggagauauggaccaaagagggagaaaggaagaaacugcggccccgcuggcuagacgccagaacauacucugacccucuggcucucagggaguucaaggaauuugcagccggucggcgauccgugagcggcgaucuuauccuggagauugggaaauuaccgcagcacuugacucagagagcucaaaaugcccuggacaaccucgucaugcugcauaauucagaacagggaggccgcgcauauaggcacgcgauggaggagcuuccagauaccaucgaaacacugaugcucuuggcccugauugcuguuuuaaccgguggggugacucuauucuuucugaguggccggggacucggcaagacgagcaucgggcuucuguguguaauggccuccucuguguugcuguggauggcaagcgucgagccccauuggauagcugccuccaucauucucgaguucuuucugauggugcuucucaucccugagcccgaccgucagagaaccccacaggauaaccaacuggcauacguugugauuggauugcuguucaugaucuuaacagucgccgcuaaugagaugggucuacuggaaacuaccaagaaagaccucggcauagggcacguagcgguggagaaccaccaucacgccgcaaugcuugauguugaccugcauccugcuucagccuggacauuguacgccguggcaaccacuauuaucacacccaugaugaggcacacgauugaaaacaccacugcuaauaucucucugacagccauagcgaaccaggcugccauccucaugggacuggauaagggcuggccaauuaguaaaauggacaucggugucccucuuuuagcacuggggugcuauagccaggugaauccgcucaccuugaccgccgcuguccugaugcuaguggcacauuacgccauuaucggccccggacugcaagcgaaggcuacacgcgaggcccagaaacggacugcagccggcauaaugaagaacccaacgguugaugggauuguggcuaucgaccucgauccuguaguguaugacgccaaguuugaaaaacagcuuggacagaucaugcuguugauucuguguaccagccaaauccuccugaugcgaacaacuugggcauuaugcgaguccauaacccuugcuacaggcccccugaccacucucugggaggguucuccagggaaguucuggaauacgacaauugccgucucaauggcgaacaucuuuagaggaagcuaccuagccggcgcaggucuggcuuucuccuugaugaaaagucugggcgggggaaggcgcggcaccggggcccagggagaaacucucggcgagaaguggaaacggcagcuuaaucagcugucuaagagcgaguucaacaccuauaagagaucagguauuauggagguugaccguuccgaagcaaaagagggguugaagaggggagagacaacuaaacacgcugugagucggggcaccgccaagcugcgcugguuugucgaacgaaaucucgugaaaccugaggguaagguaaucgauuuaggcugugggagaggaggcuggagcuacuauugcgccgggcugaagaaagugacagaaguuaagggauacacgaaaggcggucccgggcacgaggaaccgauaccaauggcgaccuacggauggaaccuugugaagcugcauucuggcaaagacgucuucuuuaucccucccgagaagugugauacucuacucugcgacauuggcgaguccucaccaaaucccacaaucgaagaggggaggacccugcggguguugaaaauggucgaaccuuggcugcgcggaaaccaauucuguauuaagauccucaauccguauaugcccagcgugguugagacucuugagcagaugcagagaaagcacgguggcaugcugguaaggaacccauuaucgcgaaauucuacacaugaaauguacugggugaguugcgggaccggaaacauugucuccgcugugaauaugacgagccggaugcuguugaaccguuuuaccauggcacacagaaaaccuacauaugagcgcgauguugaccucggcgccgguacuaggcacguggcugucgaacccgagguggccaaccuggauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcuacuuacuaagcccugggacgugaucccuauggugacccaaauugcuaugacagauaccacuccauucgggcagcagagagucuuuaaagagaagguugacacgcgcacacccaaagcgaagaggggaaccgcccaaauaauggaagugacugcaaaauggcugugggguuuccucagccgaaacaagaagccgcggaucuguaccagagaggaauuuacaaggaaaguacgcucuaaugcugccauuggcgcaguguucgucgacgagaaccaguggaacucagccaaggaggcuguggaagaugagcguuuuugggaccugguucaucgggaaagagaguugcacaaacaggggaagugcgccacgugcguguacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcgucgagggggagggacugcauaaauuggguuauauucucagagacaucucgaagauaccuggcgggaauauguacgccgaugacaccgcaggaugggauacuaggaucacagaagacgaucugcagaacgaggcucgcauuaccgacaucauggaaccagagcacgcccuacuugcuaaaucaauuuucaagcugacuuaucaaaauaaagugguaagaguucagcggcccgccaagaacggcacagugauggaugucaucagcaggcgugaccagcgagguuccggacaggugggaaccuacggccucaauacauuuacuaacauggaagcacaacugauacgccagauggagagugagggcauuuucucuccuagcgaauuggagaccccaaacuuagcggaaagagugcuggauuggcucgagaaguauggggucgaacggcuuaaaaggauggccaucuccggagacgacuguguugugaagcccaucgaugaccgcuuugcuacggcccugaccgcacuaaaugauauggguaaaguaagaaaggacauuccgcagugggagccuucaaaaggcuggaacgauuggcagcaagugcccuucugcagucaucacuuucaccagcugauaaugaaggacgggcgggagaucgucgugccauguaggaaucaggaugaacucguuggacgagcucgugugucucagggcgccgguuggagcuugagagagacagcaugccuggggaaguccuacgcccaaauguggcagcuuauguauuuccaucgccgggaccugaggcucgcggcuaacgccauuuguucagcagucccuguggauuggauccccacuaccugcacaacuuggagcauucacgcccaucaccaguggaugaccacggaagacauguuaucuguauggaauagaguuuggaucgaggaaaacccauggauggaggauaaaacacauauauccaguuggggagacgugcccuaccugggcaagcgcgaggaccaaugguguggcagcuugaucgggcugaccgcucgggccacuugggcaacaaauauucaggucgcuaucaaccaggugaggcgacucauuggaaaugaaaacuaccuugauuauaugaccucgaugaaaagauuuaagaaugaguccgacccugaaggugcccugugguga

SEQ ID NO: 14096 - RNA, 9879 nt, Artificial Sequence
  derived and/or modified CDS sequence (opt3) from DENV-1__JQ045649__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacgcuaauugccauggaccucggagaacugugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggagcacaaauacucguggaaaagcuggggcaaggccaagauaaucggggcggacgugcagaauaccacauuuauuaucgauggaccaaacacuccugaaugucccgacgaucagagagccuggaauauuugggaggucgaggacuauggcuucgguaucuuuaccacaaacauauggcuuaaguugagggauuccuacacacaggugugcgaccaccgucucaugucagcugcaauuaaagauaguaaggccguucaugcugacaugggguauuggaucgaaucugagaaaaaugaaaccuggaagcuggcccgggccagcuucauugaggugaagacuuguaucuggccaaaaucccacacacuauggucaaacggaguacuggaaagcgagaugauaauccccaagauuuacggcgguccuaucucucaacauaauuaucgaccaggcuacuucacccagacugcggggccguggcaccucggaaaacuggagcuugauuuugacuugugcgaaggcacaaccgucgugguggaugagcacugcgggaacagaggacccucccugaggacgacuaccgucacaggcaagauuauccaugaaugguguugccgcaguuguaccuuaccuccacuccgguucagaggugaggacgggugcugguacggaauggagauaaggcccguucgcgaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuguuggacagcucaccuggaacgaucugaucagacuuugcauuauggugggcgccaaugcaucugacaggauggggaugggaacaacuuauuuggcucugauggccaccuucaaaaugcgcccuauguuugcagucggcuuacucuuccggagacugacgagcagggaggugcuucugcuaacaauaggucucucacugguugccaguguggaauugccaaacucccuggaggaauuaggggauggacucgcuaugggcaucaugauucugaaacuucugaccgacuuucaaucucaccaguugugggcgagccuccugucccuaacuuucaucaaaaccacauuuucacugcauuacgccuggaagacuauggcaaugguccuuagcguagugagucucuucccccuguguuugucuaccacgucccagaaaacaaccuggcugccgguuuuacucggcagccuggggugcaagccucuuacuauguuucugauugcugagaauaagaucuggggacgacgcucguggccauugaacgaagguauaauggccgugggcaucgucucaauucuccugucuagucuacugaaaaacgaugugccccuugccgggccucucaucgcuggaggcaugcugauugcauguuauguaaucuccgguagcucugccgacuugagcuuagagaaggcggcugagguguccugggaagaggaagccgagcacucaggggcaagucauaauauacuggucgaaguucaggaugacggaacaaugaaaauuaaggaugaggagcgggacgauacccucacuauccugcuuaaagccacacuguuggcugugagcggcguguacccccuaucuaucccagcaacccuguucgucugguauuucuggcaaaagaaaaagcagagauccggcgugcucugggacacgccuucacccccagaaguugagagggccguacuggaugacgggauuuaccguauaaugcagcgcggacuuuuaggucggagucaggugggcgucgggguguuucaagaaaacguuuuccacacuauguggcacgugaccagaggagcgguccugauguaucagggcaagaggcucgagccgagcugggcuuccgugaaaaaggacuugaucucuuacggugggggauggcgacugcagggcucguggaauacaggcgaggaaguacaggucauugccguggagccugggaaaaaccccaagaauguucaaaccgcaccaggaacauuuaaaacucccgaaggugaggugggcgccaucgcucucgauuucaagccugggaccagcggaucaccaauugucaaccgggaaggcaagaucgugggucuguacgggaauggaguugugacgacauccggcacuuaugucagugccauagcacaggcuaaagccucucaggagggcccccuuccugagaucgaagacgagguguuucgcaagagaaaccugaccauuauggauuugcauccggggagcggaaaaacaaggcgguaccuaccagcgaucguacgagaagccauuaagagaaaacugcgcacccucaucuuagcacccacuagggugguugcuuccgagauggccgaagcucugaaggguaugccuauacguuaucaaaccacagcagucaagucagagcacacgggcaaagagauuguggaccuuaugugccaugccacuuucaccaugcggcugcucucuccagugagaguccccaauuacaacaugaucaucauggaugaagcccacuuuacagacccuagcaguauugcugcgaggggguauaucuccacccgcguaggaaugggcgaggcagccgcuauauucaugacugccacaccgcccgguagcguggaagcauuuccacagucuaaugccguuauucaggaugaggaacgagacaucccugagagaucauggaacuccggguacgaguggauuaccgauuuccccggaaagacggugugguuugucccaaguaucaaaagcggcaaugacauagcuaacuguuugcggaagaauggcaaaagggugauucagcugucgcgcaagacuuucgauacagaauaucaaaagaccaaaaacaacgacugggacuacguugugaccacugauaucucugagaugggggcgaauuuccgugccgacagagucaucgauccucggaggugccucaagcccgugauucugaaagacggaccagaacgcguaauccuugcagguccgaugccugugacaguugcuuccgccgcacagcgaagaggccggauugggaggaaccauaauaaggagggagaucaguacauauauaugggccagccccuaaacaaugacgaggaucacgcccacuggaccgaagcuaaaaugcuguuggacaacaucaauacaccagaggguauuauccccgccuuauuugaaccugagcgcgaaaagagcgcggcaaucgauggggaguacagacugaggggcgaggcccggaagacuuucgucgaacucaugcgucgcggagaccugccaguguggcuuucauauaaaguggcuagugagggcuuucaauacucugaucgaagauggugcuucgacggggaaaggaacaaucagguccuggaggaaaacauggauguugagauuuggacgaaggagggagaacggaaaaagcuccgccccagaugguuggacgccaggaccuauuccgacccucuggcucuacgggaguuuaaagaguucgcagccggucgaagaagcgugucaggcgaucugauacucgagaucgggaaacuuccgcagcaucugacacagcgcgcucaaaaugccuuagacaacuugguaaugcugcacaauagugaacagggaggcagggcauaccggcaugcgauggaggagcucccagauacuauugaaacccugaugcuucuggcccucaucgcuguguugacagguggggucacccuguuuuucuuaagcggccguggacuaggcaaaacuuccauugggcugcucugugugauggccucuagcguucuucuguggauggcauccguggagccccacuggaucgcugccucaauaaucuuggaauuuuuccugaugguccuccugauuccugagcccgacagacagaggacgccacaggauaaccaacuugcauauguagugaucggacuccuguuuaugauuuugaccguugccgcuaaugagaugggucuguuagaaacaacuaagaaggaccuaggcaucgggcacguggcggucgagaaccaucaccaugccgcaaugcuggauguggaccuccacccugcuucugccuggacccuuuacgccgucgcaacaaccauaauuacucccaugaugcgccauacaaucgaaaacacgaccgcuaauauuagucugacugccaucgcgaaccaggcugccauauugaugggacuggauaaaggcuggccaaucucgaagauggacauuggugugccucuccuggcacuugggugcuacagccagguuaauccguuaacacugaccgccgcugugcucauguugguagcacacuaugccaucauuggccccggacugcaagcgaaagcuacccgggaggcccagaagcgaacagcagccggcaucaugaaaaacccaacuguggaugggauagucgcuauugaccuagauccuguuguguacgacgccaaguucgaaaagcagcugggacagaucaugcuccuuauccuguguacgucccaaauuuugcugaugagaaccacaugggcacucugcgagucuaucacucuggcuaccggccccuuaacaacccuuugggaggguucaccagggaaauuuuggaauacuacgauagccgucagcauggcgaacauuuucaggggauccuaucuggccggcgcaggucucgcuuucagucuaaugaagucucugggcgggggacgccggggcacaggggcccagggagaaaccuugggcgagaaauggaagagacagcugaaucagcucagcaaaucagaauuuaacacuuacaagcguuccgguaucauggagguggacaggagugaagcaaaggaggggcuuaaacggggagagaccacaaagcacgcuguaagccgcggcacugccaaacugcgaugguucguggaaagaaauuugguuaagccugaggguaaagugauugaucugggcugugggaggggaggcuggucuuauuacugcgccgggcucaagaaggucaccgaagugaaaggauauacaaagggcggucccgggcaugaggaaccgaucccaauggcgacguacggauggaacuuagucaaacugcacuccggcaaggacguguuuuucauaccucccgagaaaugugauacccuucugugcgacaucggcgagucaagcccaaaucccacuauugaagaggggcggacacuacgcguucucaagaugguagaaccuuggcugagaggaaaccaauuuuguaucaaaauuuugaauccguacaugcccucgguggucgagacccuggagcagaugcagaggaagcaugguggcaugcucgugcgaaacccacuuucucggaauaguacucacgaaauguauuggguuuccugcgggacaggaaacaucgugagcgcugucaauaugaccucacguaugcuguuaaacagauucacgauggcacaccgcaagccuaccuacgagagggauguggaccugggcgccgguacacggcauguagcuguggaacccgagguugccaacuuggauauuaucgggcagagaauagaaaauauuaaacacgagcauaaguccacuuggcacuaugacgaggauaacccuuacaaaaccugggcauaucauggaucuuacgaagucaagccaagcggcagugccuccagcauggugaauggcguggucaaacuccugacaaagcccugggacguuaucccuauggugacucaaaucgcuaugaccgauacaaccccauuugggcagcagcgcguauucaaggagaaaguggacacuaggacgcccaaggcgaaacgaggaacagcccaaauuauggaagucaccgcaaaguggcuaugggguuuucuuucucggaacaaaaagccgagaauauguacuagggaggaguucacccgcaaggugcguucaaaugcugccaucggcgcaguuuuuguggacgagaaccaguggaauagugccaaagaggcugucgaagaugagcgguucugggaccuggugcacagagaaagggagcuccacaagcaggggaaaugcgccacaugcguauauaacaugaugggaaagcgcgagaagaagcugggcgaguuugguaaggcgaaagggucccgagcaauuugguacaugugguugggagcccgguuccuggaguucgaagcucucggcuuuaugaaugaggaucauugguucagcagagaaaacucucuuucgggcguugagggggagggacugcacaaguuagguuacauccugagggacauuucaaaaaucccuggcgggaauauguaugccgaugacacggcaggaugggauacccgcauaacugaagacgauuugaagaacgaggcuagaaucacagacauuauggaaccagagcaugcccuccuggcuaaaagcaucuuuaagcuaaccuaccagaauaaagugguccgggugcaaaggcccgccaagaacggcacugugauggaugucauuucccgucgagaccagcgcgguagugggcagguuggaacauauggccuuaauaccuucacaaacauggaagcacagcugaucagacaaauggagucugagggcauauuuagcccuuccgaacucgagacuccaaaccuggcggaacggguguugcacugguuagagaaguacgggguagaaaggcugaaacgcauggccauuucaggagaugacuguguggucaagcccaucgacgauagauucgcuaccgcccucacggcacuuaaugacauggguaaagugcggaaggauaucccgcagugggagccuaguaaaggcuggaacgacuggcagcagguucccuuuugcucucaccauuuccaccaacugauuaugaaggaugggagggagauaguggucccaugucgaaaucaggacgagcuagugggacgugcuagaguaagccagggcgccgguuggucccugcgcgagaccgcaugccucgggaagucauaugcccagauguggcaauugauguacuuucaucggagggaucugagacuugcggcuaacgccaucuguagcgcaguuccuguggacuggauucccacaucucgcacuaccugguccauccacgcccaucaccaguggaugacaacugaagauaugcugagugucuggaaucggguguggauugaggaaaacccauggauggaggacaaaacccacaucagcucguggggagauguucccuaucucggcaagagggaggaccaguggugcggcuccuuaauagggcugacggcucgagccacaugggcaaccaauauccaaguggcuauuaaccaggucagacgguugaucggaaaugaaaacuaccuggacuacaugacuucuaugaaaagguucaagaaugagucagauccugaaggugcccucugguga

SEQ ID NO: 14097 - RNA, 9879 nt, Artificial Sequence
  derived and/or modified CDS sequence (opt3) from DENV-1__JQ045650__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaauaugugcacacugauugccauggaccucggagaacugugugaagauacuaugaccuacaaaugcccacggauaacagagaccgaaccggacgauguggacuguuggugcaaugcgacugauacauggguaaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauaugguugaagcucagggauuccuacacgcaggucugcgaccaccgucugaugucagcugcaauuaaagauaguaaggccgugcaugcugacaugggguauuggaucgaaucugagaaaaaugaaaccuggaagcuagcccgggccagcuucauugagguuaagacuuguaucuggccaaaaucccacacacuguggucaaacggagugcucgaaagcgagaugauaauccccaagauuuacggcgguccuaucucucaacauaauuaucgaccaggcuacuucacccagacugcggggccguggcaccugggaaaacuugaguuggauuuugaccugugcgaaggcacaaccguagucguggaugagcacugcgggaacagaggacccuccuuaaggacgacuaccgugacaggcaagauuauccaugaaugguguugccgcaguuguacccucccuccacugcgguucagaggugaggacgggugcugguacggaauggagauaaggcccguccgcgaaaaagaggaaaaucuuguuaagagcauggugucugccggcuccggugagguagacucauuuagucugggcuugcucuguauuagcaucaugaucgaagaggugaugcgaucgcgguggucccguaagaugcugaugacugggacacuagcugucuucuuucugcucauugugggacagcugaccuggaacgaucuuaucagauugugcauuaugguuggcgccaaugcaucugacaggauggggaugggaacaacuuaucuggcuuuaauggccaccuucaaaaugcgcccuauguuugcagugggccuccuguuccggagacuuacgagcagggagguccugcuacucacaauaggucugucauugguggccaguguugaacugccaaacuccuuagaggaacucggggauggacuggcuaugggcaucaugauucuuaagcuguugaccgacuuucaaucucaccagcucugggcgagccugcuaucccugacuuucaucaaaaccacauuuucacuucauuacgccuggaagacuauggcaauggugcucagcgucguaagucuguuccccuugugucugucuaccacgucccagaaaacaaccugguuaccggugcuccugggcagccuugggugcaagccucugacuauguuuuugauugcugagaauaagaucuggggacgacgcucguggccacucaacgaagguauaauggccguuggcaucgugucaauucugcuaucuagucugcuuaaaaacgaugucccccucgccgggccucugaucgcuggaggcauguugauugcauguuaugugaucuccgguagcucugccgacuuaagccuggagaaggcggcugagguauccugggaagaggaagccgagcacucaggggcaagucauaauauacucguggaaguccaggaugacggaacaaugaaaauuaaggaugaggagcgggacgauacccugacuauccuucugaaagccacauugcuagcuguuagcggcguguacccccugucuaucccagcaacccucuucgugugguauuucuggcaaaagaaaaagcagagauccggcguccugugggacacgccuucacccccagaaguggagagggccguucuugaugacgggauuuaccguauaaugcagcgcggauuacugggucggagucagguaggcgugggggucuuucaagaaaacguguuccacacuauguggcacguuaccagaggagcggugcucauguaucagggcaagagguuggagccgagcugggcuuccgucaaaaaggaccugaucucuuacggugggggauggcgacuccagggcucguggaauacaggcgaggaagugcagguaauugccgucgagccugggaaaaaccccaagaaugugcaaaccgcaccaggaacauuuaaaacucccgaaggugagguuggcgccaucgcucuggauuucaagccugggaccagcggaucaccaauugugaaccgggaaggcaagaucgucggucuuuacgggaauggagugguuacgacauccggcacuuaugugagugccauagcacaggcuaaagccucucaggagggcccccugccugagaucgaagacgaggucuuucgcaagagaaacuugaccauuauggaucuacauccggggagcggaaaaacaaggcgguaccugccagcgaucgugcgagaagccauuaagagaaaacuccgcaccuuaauccuggcacccacuaggguaguggcuuccgagauggccgaagcucuuaaggguaugccuauacguuaucaaaccacagcaguuaagucagagcacacgggcaaagagauugucgaccugaugugccaugccacuuucaccaugcggcucuugucuccagugagagugcccaauuacaacaugaucaucauggaugaagcccacuuuacagacccuagcaguauugcugcgaggggguauaucuccacccgcgucggaaugggcgaggcagccgcuauauucaugacugccacaccgcccgguagcguagaagcauuuccacagucuaaugccgugauucaggaugaggaacgagacaucccugagagaucauggaacuccggguacgaguggauuaccgauuuccccggaaagacgguuugguuugugccaaguaucaaaagcggcaaugacauagcuaacugucugcggaagaauggcaaaagggucauucagcucucgcgcaagacuuucgauacagaauaucaaaagaccaaaaacaacgacugggacuacgugguuaccacugauaucucugagaugggggcgaauuuccgugccgacagagugaucgauccucggaggugccugaagcccgucauucuuaaagacggaccagaacgcgugauccuagcagguccgaugccuguaacaguggcuuccgccgcacagcgaagaggccggauugggaggaaccauaauaaggagggagaucaguacauauauaugggccagccccugaacaaugacgaggaucacgcccacuggaccgaagcuaaaauguuguuagacaacaucaauacaccagaggguauuauccccgcccuguuugaaccugagcgcgaaaagagcgcggcaaucgauggggaguacagacucaggggcgaggcccggaagacuuucguugaacugaugcgucgcggagaccuuccagucuggcugucauauaaaguggcuagugagggcuuucaauacucugaucgaagauggugcuucgacggggaaaggaacaaucaggugcucgaggaaaacauggaugucgagauuuggacgaaggagggagaacggaaaaaguugcgccccagauggcuggacgccaggaccuauuccgacccucuagcucugcgggaguuuaaagaguucgcagccggucgaagaagcguuucaggcgaucucauacuugagaucgggaagcugccgcagcauuuaacacagcgcgcucaaaaugccuuggacaaccuggugaugcuccacaauagugaacagggaggcagggcauaccggcaugcgauggaggagcugccagauacuauugaaacccuuaugcugcucgccuugaucgcuguacugacagguggggugaccuuauuuuuccuaagcggccguggacugggcaaaacuuccauugggcuccuuugugucauggccucuagcgugcuguuguggauggcauccguugagccccacuggaucgcugccucaauaauccuggaauuuuuccucauggugcugcuuauuccugagcccgacagacagaggacgccacaggauaaccaacucgcauaugucguaaucggacuguuguuuaugauucugaccguggccgcuaaugagauggguuuacuagaaacaacuaagaaggaccugggcaucgggcacguugcgguggagaaccaucaccaugccgcaaugcucgaugucgaccuucacccugcuucugccuggacccuguacgccguggcaacaaccauaauuacucccaugaugcgccauacaaucgaaaacacgaccgcuaauauuaguuugacugccaucgcgaaccaggcugccauacugaugggacucgauaaaggcuggccaaucucgaagauggacauuggugucccucugcuugcauuagggugcuacagccaggugaauccgcugacacucaccgccgcuguuuugaugcugguggcacacuaugccaucauuggccccggacuacaagcgaaagcuacccgggaggcccagaagcgaacagcagccggcaucaugaaaaacccaacuguagaugggauaguggcuauugaccuggauccugucguuuacgacgccaaguucgaaaagcagcucggacagaucaugcuucugaucuuguguacgucccaaauucugcucaugagaaccacaugggcacugugcgagucuaucacuuuagcuaccggcccccuuacaacccugugggaggguucaccagggaaauuuuggaauacuacgauagccgugagcauggcgaacauuuucaggggauccuaucucgccggcgcaggucuagcuuucagucugaugaagucuuugggcgggggacgccggggcacaggggcccagggagaaacccugggcgagaaauggaagagacagcucaaucagcuuagcaaaucagaauuuaacacuuacaagcguuccgguaucauggaggucgacaggagugaagcaaaggaggggcugaaacggggagagaccacaaagcacgcugugagccgcggcacugccaaauugcgaugguucguagaaagaaaucuggugaagccugaggguaaaguuauugaucucggcugugggaggggaggcugggccuauuacugcgcgggguuaaagaaggugaccgaagucaaaggauauacaaagggcggucccgggcaugaggaaccgaucccaauggcuacguacggauggaaccuggugaaacuucacucuggcaaggacgucuuuuucauaccucccgagaaaugugauacccugcuaugcgacaucggcgaguccucaccaaaucccacuauugaagaggggcggacacuccgcgugcugaagaugguugaaccuugguugagaggaaaccaauuuuguaucaaaauucugaauccguacaugcccagcguaguggagacccucgagcagaugcagaggaagcaugguggcaugcuuguccgaaacccacugucgagaaauucuacucacgaaauguauugggugaguugcgggacaggaaacaucguuuccgcagugaauaugaccagccguauguuacugaacagauucacgauggcccaccgcaagccuaccuacgagagggaugucgacuugggcgcugguacacggcauguggccguagaacccgagguggcaaaccucgauauuaucgggcagagaauagaaaauauuaaacacgagcauaagucaacuuggcacuaugacgaggauaacccuuacaaaaccugggccuaucauggauccuacgaaguuaagccaucuggcagcgcuaguuccauggucaauggcguggugaaacugcuaacaaagcccugggacgucaucccuaugguuacucaaaucgcgaugaccgauacaaccccauuugggcagcagcgcguguucaaggagaaaguagacacuaggacgcccaaggccaaacgaggaacagcacaaauuauggaagugaccgcuaaguggcuuugggguuuucugagccggaacaaaaagccgagaauauguacuagggaggaguucacccgcaagguccguucuaaugccgcaaucggcgccguguuuguugacgagaaccaguggaacucagcuaaagaggccguggaagaugagcgguucugggaccucguccacagagaaagggagcugcacaagcaggggaaaugcgcgacaugcguguauaacaugaugggaaagcgcgagaaaaaguugggcgaguuugguaaggcaaaagggagucgagccauuugguacauguggcugggagcucgguuccucgaguucgaagcccuuggcuuuaugaaugaggaucauugguucuccagagaaaacagccugucuggcguagagggggagggauuacacaagcuggguuacaucuugagggacauuucgaaaaucccuggcgggaauauguaugcagaugacacggcuggaugggauacccgcauaacugaagacgaucucaagaacgaggccagaaucacagacauuauggaaccagagcaugcucugcuagccaaaucaaucuuuaaacuuaccuaccagaauaaaguugugcggguccaaaggcccgcaaagaacggcacugugauggaugugauuagccgucgagaccagcgcgguuccgggcaggucggaacauauggccugaauaccuucacaaacauggaagcgcagcucaucagacaaauggagagugagggcauauuuucuccuagcgaacuggagacuccaaacuuggccgaacggguuuuacacuggcuggagaaguacgggguggaaaggcucaaacgcauggcuauuuccggagaugacuguguagugaagcccaucgacgauagauucgccaccgcacuuacggcucugaaugacauggguaaaguccggaaggauaucccgcagugggagccuucaaaaggcuggaacgacuggcaacaggugcccuuuugcagucaccauuuccaccaacuaauuaugaaggaugggagggagauaguugugccaugucgaaaucaggacgaacuggucggacgugccagagugucucagggcgcagguuggagccuccgcgagaccgccugcuuggggaaguccuaugcgcagauguggcaacugauguacuuucaucggagggaucuuagacuggcugccaacgcaaucuguucagccguaccuguugacuggauucccacaagccgcacuaccuggucuauccacgcucaucaccaguggaugacaacugaagauaugcucuccguguggaaucgggucuggauugaggaaaacccauggauggaggacaaaacccacaucaguagcuggggagaugugcccuauuuaggcaagagggaggaccaguggugcggcucgcugauaggguugacggcccgagcaacaugggcuaccaauauccaaguugccauuaaccaggugagacggcugaucggaaaugaaaacuaccucgacuacaugacuuccaugaaaagguucaagaaugagucugauccugaaggugcgcuuugguga

SEQ ID NO: 14098 - RNA, 9879 nt, Artificial Sequence
  derived and/or modified CDS sequence (opt3) from DENV-1__JQ045651__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaauaaaauauggggaaggcgaagcuggccacucaacgaagguaucauggccguaggcauugugucgauccugcuaucaucucugcuuaagaacgauguuccccucgccgggccucugauugcuggaggcauguugaucgcauguuacgugauaagugguuccagcgccgacuuaucucuggagaaagcggcugaggucagcugggaagaggaagccgagcauuccggggcaucacacaauauucucguggaaguacaggaugacggaaccaugaagaucaaagaugaggagcgcgacgauacucugacaauccuucugaaggccaccuugcuagcugugaguggcgucuauccccugagcauuccagcaacacucuucguuugguacuucuggcagaagaagaagcagcggucuggcgugcugugggacacuccuucacccccagaaguggagagagccguccuugaugacgggauauauaggaucaugcagcguggauuacugggucgcagccaggugggcguugggguauuucaagaaaacguguuccauaccauguggcacgucacacggggagcggugcucauguaccagggcaaaagauuggagccgaguugggcuagcguuaagaaagaccugauuuccuacggugggggauggaggcuccagggcucuuggaauaccggcgaggaagugcaggucaucgccguggagccugggaagaaccccaaaaauguacaaacagcaccaggaacuuuuaagacccccgaaggugaggucggcgccauugcucuggauuucaagccugggacgucgggaagcccaaucgugaaccgagaaggcaaaauaguuggucuuuaugggaauggaguggucacaacuucaggcaccuacguguccgccaucgcacaggcuaaggccagucaggagggcccccugccugagauugaagacgagguuuuucggaaacgcaacuugacaaucauggaucuacacccggggucuggaaagaccagaagguaucugccagcgauugugcgggaagccaucaaacgaaagcucagaacuuuaauacuggcacccacccgcgucguggcuagcgagauggccgaagcucuuaaggguaugccuauuagguaccaaacaacggcaguaaaauccgagcauacuggcaaggagaucguggaccugaugugccacgccaccuucacaaugcgucucuugucaccaguucggguccccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccguggaagcauuuccacagagcaaugccgucauccaggaugaggaacgcgacauuccugagcgaucuuggaacucaggguaugaguggaucacggauuuccccggaaaaacuguaugguuugugccauccauaaagaguggcaaugacauugcuaacugucugaggaaaaauggcaagcggguuauccagcucagcaggaagacauucgauaccgaauaccagaaaaccaagaacaacgacugggacuacguggucacuacagauaucucggagaugggggcgaauuuccgcgccgaccgugugauugauccuagacggugccugaaacccguuauccuuaaggacggaccagaaagggugauucuagcagguccgaugccugucaccguggcuucugccgcacagcgccgaggcagaauagggcggaaccacaauaaagagggagaucaguauaucuacaugggccagccccugaacaaugacgaggaucaugcccacuggacagaagcuaagauguuguuagacaacauuaauacuccagaggguaucauccccgcccuguuugaaccugagagggaaaaguccgcggcaauugauggggaguaucgccucagaggcgaggccaggaaaacguucguagaacugaugcggcguggagaccuuccaguguggcugagcuacaagguugcuucagagggcuuucaauauagugaucgccgauggugcuucgacggggaaagaaacaaucagguccucgaggaaaacauggauguggagauauggaccaaagagggagaaaggaagaaauugcggccccgcuggcuggacgccagaacauacucugacccucuagcucugagggaguuuaaggaguucgcagccggucggcgauccgugagcggcgaucucauccuugagauugggaaacugccgcagcacuuaacucagagagcucaaaaugccuuggacaaccuggucaugcuccauaauucagaacagggaggccgcgcauauaggcacgcgauggaggagcugccagauaccaucgaaacacuuaugcugcucgccuugauugcuguucugaccgguggggugacuuuauuuuuccuaaguggccggggacugggcaagacgagcaucgggcuccuuuguguaauggccuccucugugcuguuguggauggcaagcgucgagccccauuggauagcugccuccaucauucuggaauuuuuccucauggugcugcuuaucccugagcccgaccgucagagaaccccacaggauaaccaacucgcauacguugugauuggacuguuguuuaugauccugacagucgccgcuaaugagauggguuuacuagaaacuaccaagaaagaccugggcauagggcacguagcgguggagaaccaccaucacgccgcaaugcucgauguugaccuucauccugcuucagccuggacacuguacgccguggcaaccacuauuaucacacccaugaugaggcacacgauugaaaacaccacugcuaauaucucuuugacagccauagcgaaccaggcugccauccugaugggacucgauaagggcuggccaauuaguaaaauggacaucggugucccucugcuugcauuagggugcuauagccaggugaauccgcugacccucaccgccgcugucuugaugcugguggcacauuacgccauuaucggccccggacuacaagcgaaggcuacacgcgaggcccagaaacggacugcagccggcauaaugaagaacccaacgguugaugggauuguggcuaucgaccuggauccuguaguguaugacgccaaguucgaaaaacagcucggacagaucaugcuucugauuuuguguaccagccaaauccugcucaugcgaacaacuugggcacugugcgaguccauaaccuuagcuacaggcccccuuaccacucugugggaggguucuccagggaaguuuuggaauacgacaauugccgucucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauuauggagguugaccguuccgaagcaaaagaggggcugaagaggggagagacaacuaaauacgcugugagucggggcaccgccaaguugcgcugguucgucgaacgaaaucuggugaaaccugaggguaagguaaucgaucucggcugugggagaggaggcuggagcuauuacugcgccggguuaaagaaagugacagaaguuaagggauacacgaaaggcggucccgggcacgaggaaccgauaccaauggcgaccuauggauggaaccuggugaaacuucacucuggcaaagacgucuuuuucgugccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguacaugcccagcguuguagagacucucgagcagaugcagagaaagcaugguggcaugcuugugaggaacccacugucgcgaaauucuacacacgaaauguauugggucaguugcgggaccggaaacaucguguccgcuguuaauaugacgagccggauguuacugaaccguuucaccauggcacauagaaaaccuacauacgagcgcgauguggacuugggcgccgguacuaggcacgucgcuguggaacccgagguagccaaccucgauauuaucgggcagcggauagaaaauauuaagcacgagcauaaaucaaccuggcacuaugacgaggauaacccuuacaagacaugggcauaucauggauccuacgaagugaaaccaucuggcagcgccaguuccaugguuaauggcgucgugaagcugcuaacuaagcccugggacgugaucccuauggucacccaaaucgcuaugacagauaccacuccauuugggcagcagagaguuuucaaagagaagguggacacgcgcacacccaaagcgaagaggggaaccgcccaaauuauggaaguaacugcaaaauggcuuugggguuuucugagccgaaacaagaagccgcggauauguaccagagaggaguucacaaggaaagugcgcucuaaugcugccaucggcgcagucuuuguggacgagaaccaguggaacucagccaaggaggcuguugaagaugagcguuucugggaccucgugcaccgggaaagagagcugcauaaacaggggaagugcgccacgugcgucuacaacaugaugggaaaaagggaaaagaaguugggcgaguuugguaaagcgaaggggagucgcgcaauuugguauauguggcugggagcccgauuccucgaguucgaagcucuuggcuuuaugaaugaggaucacugguucucccgggaaaacagccugucuggcguggagggggagggauuacacaaacuggguuacaucuugagagacauuucgaagaucccuggcgggaauauguaugccgaugacaccgcaggaugggauacuaggauaacagaagacgaucuccagaacgaggcucgcaucaccgacauuauggaaccagagcaugcccugcuagcuaaaucaaucuuuaaacuuacuuaccaaaauaaaguaguuagagugcagcggcccgccaagaacggcacagucauggaugugauuagcaggcgugaccagcgagguuccggacaggugggaaccuauggccugaauacauucacuaacauggaagcacaacucauccgccagauggagagugagggcauauuuucuccuagcgaacuggagaccccaaacuuggcggaaagagucuuagauuggcuggagaaguacgggguugaacggcucaaaaggauggccauuuccggagacgacugugugguaaagcccaucgaugaccgcuucgcuacggcccuuaccgcacugaaugauauggguaaagugagaaaggacaucccgcagugggagccuucaaaaggcuggaacgauuggcagcaaguccccuuuugcagucaccauuuccaccagcuaauuaugaaggacgggcgggagauagugguuccauguaggaaucaggaugaacuggugggacgagcucgugucucucagggcgccgguuggagccucagagagacagcaugcuuggggaaguccuaugcccaaauguggcagcugauguacuuucaccgccgggaccuuaggcuggcggcuaacgccaucuguucagcagugccuguagauuggauucccacuagcagaaccacauggucuauccaugcccaccaucaguggaugacuaccgaagacaugcucuccguuuggaaucgcguguggauugaggaaaacccauggauggaggauaaaacgcacaucaguagcugggaggacguccccuacuuaggaaagcgggaagaccaauggugcggcucgcugauaggcuugacagcuagggccaccugggcaacuaauauccagguggcuauuaaccagguucgaagacugaucgggaaugagaacuaucucgauuacaugacauccaugaaacgguucaagaaugaaucugacccugagggagcccuuugguga

SEQ ID NO: 14099 - RNA, 9879 nt, Artificial Sequence
  derived and/or modified CDS sequence (opt3) from DENV-1__JQ045652__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaauaaaauauggggaaggcgaagcuggccacucaacgaagguaucauggccguaggcauugugucgauccugcuaucaucucugcuuaagaacgauguuccccucgccgggccucugauugcuggaggcauguugaucgcauguuacgugauaagugguuccagcgccgacuuaucucuggagaaagcggcugaggucagcugggaagaggaagccgagcauuccggggcaucacacaauauucucguggaaguacaggaugacggaaccaugaagaucaaagaugaggagcgcgacgauacucugacaauccuucugaaggccaccuugcuagcugugaguggcgucuauccccugagcauuccagcaacacucuucguuugguacuucuggcagaagaagaagcagcggucuggcgugcugugggacacuccuucacccccagaaguggagagagccguccuugaugacgggauauauaggaucaugcagcguggauuacugggucgcagccaggugggcguugggguauuucaagaaaacguguuccauaccauguggcacgucacacggggagcggugcucauguaccagggcaaaagauuggagccgaguugggcuagcguuaagaaagaccugauuuccuacggugggggauggaggcuccagggcucuuggaauaccggcgaggaagugcaggucaucgccguggagccugggaagaaccccaaaaauguacaaacagcaccaggaacuuuuaagacccccgaaggugaggucggcgccauugcucuggauuucaagccugggacgucgggaagcccaaucgugaaccgagaaggcaaaauaguuggucuuuaugggaauggaguggucacaacuucaggcaccuacguguccgccaucgcacaggcuaaggccagucaggagggcccccugccugagauugaagacgagguuuuucggaaacgcaacuugacaaucauggaucuacacccggggucuggaaagaccagaagguaucugccagcgauugugcgggaagccaucaaacgaaagcucagaacuuuaauacuggcacccacccgcgucguggcuagcgagauggccgaagcucuuaaggguaugccuauuagguaccaaacaacggcaguaaaauccgagcauacuggcaaggagaucguggaccugaugugccacgccaccuucacaaugcgucucuugucaccaguucggguccccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccguggaagcauuuccacagagcaaugccgucauccaggaugaggaacgcgacauuccugagcgaucuuggaacucaggguaugaguggaucacggauuuccccggaaaaacuguaugguuugugccauccauaaagaguggcaaugacauugcuaacugucugaggaaaaauggcaagcggguuauccagcucagcaggaagacauucgauaccgaauaccagaaaaccaagaacaacgacugggacuacguggucacuacagauaucucggagaugggggcgaauuuccgcgccgaccgugugauugauccuagacggugccugaaacccguuauccuuaaggacggaccagaaagggugauucuagcagguccgaugccugucaccguggcuucugccgcacagcgccgaggcagaauagggcggaaccacaauaaagagggagaucaguauaucuacaugggccagccccugaacaaugacgaggaucaugcccacuggacagaagcuaagauguuguuagacaacauuaauacuccagaggguaucauccccgcccuguuugaaccugagagggaaaaguccgcggcaauugauggggaguaucgccucagaggcgaggccaggaaaacguucguagaacugaugcggcguggagaccuuccaguguggcugagcuacaagguugcuucagagggcuuucaauauagugaucgccgauggugcuucgacggggaaagaaacaaucagguccucgaggaaaacauggauguggagauauggaccaaagagggagaaaggaagaaauugcggccccgcuggcuggacgccagaacauacucugacccucuagcucugagggaguuuaaggaguucgcagccggucggcgauccgugagcggcgaucucauccuugagauugggaaacugccgcagcacuuaacucagagagcucaaaaugccuuggacaaccuggucaugcuccauaauucagaacagggaggccgcgcauauaggcacgcgauggaggagcugccagauaccaucgaaacacuuaugcugcucgccuugauugcuguucugaccgguggggugacuuuauuuuuccuaaguggccggggacugggcaagacgagcaucgggcuccuuuguguaauggccuccucugugcuguuguggauggcaagcgucgagccccauuggauagcugccuccaucauucuggaauuuuuccucauggugcugcuuaucccugagcccgaccgucagagaaccccacaggauaaccaacucgcauacguugugauuggacuguuguuuaugauccugacagucgccgcuaaugagauggguuuacuagaaacuaccaagaaagaccugggcauagggcacguagcgguggagaaccaccaucacgccgcaaugcucgauguugaccuucauccugcuucagccuggacacuguacgccguggcaaccacuauuaucacacccaugaugaggcacacgauugaaaacaccacugcuaauaucucuuugacagccauagcgaaccaggcugccauccugaugggacucgauaagggcuggccaauuaguaaaauggacaucggugucccucugcuugcauuagggugcuauagccaggugaauccgcugacccucaccgccgcugucuugaugcugguggcacauuacgccauuaucggccccggacuacaagcgaaggcuacacgcgaggcccagaaacggacugcagccggcauaaugaagaacccaacgguugaugggauuguggcuaucgaccuggauccuguaguguaugacgccaaguucgaaaaacagcucggacagaucaugcuucugauuuuguguaccagccaaauccugcucaugcgaacaacuugggcacugugcgaguccauaaccuuagcuacaggcccccuuaccacucugugggaggguucuccagggaaguuuuggaauacgacaauugccgucucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauuauggagguugaccguuccgaagcaaaagaggggcugaagaggggagagacaacuaaauacgcugugagucggggcaccgccaaguugcgcugguucgucgaacgaaaucuggugaaaccugaggguaagguaaucgaucucggcugugggagaggaggcuggagcuauuacugcgccggguuaaagaaagugacagaaguuaagggauacacgaaaggcggucccgggcacgaggaaccgauaccaauggcgaccuauggauggaaccuggugaaacuucacucuggcaaagacgucuuuuucgugccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguacaugcccagcguuguagagacucucgagcagaugcagagaaagcaugguggcaugcuugugaggaacccacugucgcgaaauucuacacacgaaauguauugggucaguugcgggaccggaaacaucguguccgcuguuaauaugacgagccggauguuacugaaccguuucaccauggcacauagaaaaccuacauacgagcgcgauguggacuugggcgccgguacuaggcacgucgcuguggaacccgagguagccaaccucgauauuaucgggcagcggauagaaaauauuaagcacgagcauaaaucaaccuggcacuaugacgaggauaacccuuacaagacaugggcauaucauggauccuacgaagugaaaccaucuggcagcgccaguuccaugguuaauggcgucgugaagcugcuaacuaagcccugggacgugaucccuauggucacccaaaucgcuaugacagauaccacuccauuugggcagcagagaguuuucaaagagaagguggacacgcgcacacccaaagcgaagaggggaaccgcccaaauuauggaaguaacugcaaaauggcuuugggguuuucugagccgaaacaagaagccgcggauauguaccagagaggaguucacaaggaaagugcgcucuaaugcugccaucggcgcagucuuuguggacgagaaccaguggaacucagccaaggaggcuguugaagaugagcguuucugggaccucgugcaccgggaaagagagcugcauaaacaggggaagugcgccacgugcgucuacaacaugaugggaaaaagggaaaagaaguugggcgaguuugguaaagcgaaggggagucgcgcaauuugguauauguggcugggagcccgauuccucgaguucgaagcucuuggcuuuaugaaugaggaucacugguucucccgggaaaacagccugucuggcguggagggggagggauuacacaaacuggguuacaucuugagagacauuucgaagaucccuggcgggaauauguaugccgaugacaccgcaggaugggauacuaggauaacagaagacgaucuccagaacgaggcucgcaucaccgacauuauggaaccagagcaugcccugcuagcuaaaucaaucuuuaaacuuacuuaccaaaauaaaguaguuagagugcagcggcccgccaagaacggcacagucauggaugugauuagcaggcgugaccagcgagguuccggacaggugggaaccuauggccugaauacauucacuaacauggaagcacaacucauccgccagauggagagugagggcauauuuucuccuagcgaacuggagaccccaaacuuggcggaaagagucuuagauuggcuggagaaguacgggguugaacggcucaaaaggauggccauuuccggagacgacugugugguaaagcccaucgaugaccgcuucgcuacggcccuuaccgcacugaaugauauggguaaagugagaaaggacaucccgcagugggagccuucaaaaggcuggaacgauuggcagcaaguccccuuuugcagucaccauuuccaccagcuaauuaugaaggacgggcgggagauagugguuccauguaggaaucaggaugaacuggugggacgagcucgugucucucagggcgccgguuggagccucagagagacagcaugcuuggggaaguccuaugcccaaauguggcagcugauguacuuucaccgccgggaccuuaggcuggcggcuaacgccaucuguucagcagugccuguagauuggauucccacuagcagaaccacauggucuauccaugcccaccaucaguggaugacuaccgaagacaugcucuccguuuggaaucgcguguggauugaggaaaacccauggauggaggauaaaacgcacaucaguagcuggggagacguccccuacuuaggcaagcgggaggaccaauggugcggcucgcugauaggguugacagcuagggccaccugggcaacuaauauccagguggcuauuaaccagguucgaagacugaucggaaaugaaaacuaucucgauuacaugacauccaugaaacgguucaagaaugagucugacccugaaggugcccuuugguga

SEQ ID NO: 14100 - RNA, 9879 nt, Artificial Sequence
  derived and/or modified CDS sequence (opt3) from DENV-1__JQ045653__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuugguggauagaggcugggguaauggguguggacucuuuggcaaaggcucccugauaaccugcgcaaaguucaagugcguaacaaaauuagaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccagcucacugacuacggggcgcuuacacuggauuguagcccaaggacgggauuggacuuuaacgaaaugguccuacugaccaugaaggagaaaucuuggcucgugcauaagcagugguuccuggaucuuccgcugcccuggacuuccggcgccucaacaagccaagagaccuggaaucggcaggacuugcucguaacauuuaaaacugcacacgcuaagaagcaggaaguugugguccuggguagucaagagggggccaugcacaccgcuuuaacgggcgccaccgaaauccagacaucuggaacuaccacaauuuucgcaggccaucugaaaugccgucuaaagauggauaaacucacucugaaggggauguccuaugugauguguaccgguagcuuuaaacuugagaaggaauuggccgagacgcagcacggaacaguccuggugcagauaaaguacgagggcaccgacgcuccuugcaaaaucccauucucgacucaagaugaaaaggggguuacacagaacggacgccucauuaccgcgaaucccaucgugacugacaaagagaagccuguaaacauagaagcagagccacccuucggcgagucuuauauugucaucggugccggggaaaaagcucugaaacuuuccugguuuaagaaaggcucaaguaucggaaagauguucgaggccaccgcaagaggcgccaggcggauggcuauucugggggauacagccugggacuuuggaagcaucgguggcguguucacguccguugggaaauuggugcaucagauuuuuggaaccgcauacggcguccucuucucuggugugagcuggacuaugaagauagggaucggcguacuguuaacauggcugggacuaaauucacgaaguaccucccucagcaugacauguauugcggugggccugguuacucuuuacuugggggucauggugcaggcugauucuggaugcgugaucaacuggaaaggccgcgaacugaagugugguucagggaucuuugucaccaaugagguucacacguggacagaacaauauaaguuccaggccgacaguccgaaaagacucagcgcagccauuggaaaggcuugggaggagggcgugugcgguauaagguccgccacccggcuggaaaacaucauguggaaacagauuucuaacgaguuaaaucauauccugcuugaaaacgacaugaaguuuacugugguagucggcgauguggcagggauuuuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcucaagcugagggauuccuauacgcaggucugcgaccaccgucuaaugucagcugcaauuaaagauaguaaggccgugcacgcugacaugggguacuggaucgaaucugagaaaaaugaaaccuggaagcuggcccgggcauccuuuauugagguuaagacuuguaucuggccacgaucccauacacucuggucaaacggagugcuggaaagcgagaugauaauccccaaaauuuauggcgguccuaucucucaacacaauuacagaccaggcuacuucacccagacugcggggccguggcaucuuggaaaguuggagcuggauuucgacuuaugcgaaggcacaaccguagucguggaugagcacugcgggaacaggggacccucccuccgcacgacuaccgugacaggcaaaauuauccacgaaugguguugccggaguuguacccugccuccacuuagauuuaggggugaggacgggugcugguauggaauggagauacgccccgucaaggaaaaagaggaaaaucugguuaagagcauggugucugccggcuccggugagguagacucauucaguuugggccuccuguguauuagcaucaugaucgaagaggugaugcgaucgcggugguccaagaaaaugcuaaugacugggacacuggcugucuuuuuccuccugauuaugggacagcuuaccuggaacgauuugauccgucugugcauuauggugggcgccaaugcaucugacagaauggggaugggaacaacuuacuuagcucucauggccaccuuuaagaugaggccuauguucgcaguuggccugcuuuuucgccggcugacgagcagagaggugcuacuccugacaauagguuugucacuggucgccaguguggaauuaccaaacucccucgaggaacugggggauggacuugcuaugggcaucaugauucugaaauugcucaccgacuuccaaucucaucagcugugggcgacucuacugagccuuaccuuuaucaagacaacuuucucccuccacugugccuggaaaaccauggcaaugauucugucaaucguuagcuuguuuccccugugcuuaaguacgacaucucagaagaccacuuggcucccggugcugcuuggcucccugggguguaagccuuugacaauguuccucauagcugagaauaaaaucuggggaaggcgaagcuggccacugaacgaagguauuauggccgucggcaucguaucgauucuacugucaucucuucucaagaacgaugugccccuggccgggccuuugaucgcuggaggcauguuaauagcaugcuauguuauuagugguuccagcgccgaccugucucucgagaaagcggcugaggugagcugggaagaggaagccgagcauuccggggcaucacacaauauccuggucgaagugcaggaugacggaaccaugaagaucaaagaugaggagcgcgacgauacucuuacaauucuguugaaggccacccuacuggcuguaaguggcguguacccccucagcauaccagcaacgcuguuugucugguauuucuggcagaaaaagaagcagcggucuggcguucuuugggacacuccuucacccccagaaguggagagagccguguuagaugacgggaucuacaggauuaugcagcguggacugcucggucgcagccaggucggcguggggguuuuccaagaagacguauuucauaccauguggcacgugacacggggagcggucuugauguaucagggcaaaagacuggagccgaguugggcuagcgugaagaaagaucucaucuccuacggugggggauggaggcugcagggcucuuggaacaccggcgaggaaguucaggugauugccgucgagccugggaagaaucccaaaaacgugcaaacagcaccaggaacuuucaagacccccgaaggugagguaggcgccaucgcucuugacuuuaagccugggacgucgggaagcccaauagucaaucgagaaggcaaaaucgugggucuguacgggaacggaguugugacaacuucaggcaccuaugucuccgccauugcacaggcuaaggccagucaggagggccccuugccugagaucgaagaugagguguuccggaaacgcaaucuaacaauuauggaccugcacccggggucuggaaagaccagaagguaccucccagcgaucguucgggaagccauaaaacgaaaguuaagaacucugauucuugcacccacccgcguggucgcuagcgagauggccgaagcucugaaggguaugccuaucagguaucaaacaacggcagugaaauccgagcauacuggcaaggagaucguagaucucaugugucacgccaccuuuacaaugcguuugcugucaccagugcggguucccaacuacaauaugauuaucauggacgaagcccauuucaccgauccuucuagcauagcugcgagaggguauauuaguacuagggucggaaugggcgaggcagccgcuaucuuuaugacagccaccccgcccgguuccguggaagcauucccacagagcaacgccgugauucaggacgaggaacgcgauaucccugagcgaucuuggaacucaggguacgaguggauaacggacuuucccggaaaaacugucugguucguaccauccauuaagaguggcaacgauaucgcuaauugccucaggaaaaauggcaagcgggugauccagcugagcaggaagacauuugacaccgaauaucagaaaaccaagaauaacgacugggauuacguugugacuacagacauuucggagaugggggcgaacuuccgcgccgaucgugucaucgacccuagacggugccuuaaacccgugauucuaaaggauggaccagaaaggguuauacuggcagguccgaugccugugaccgucgcuucugccgcacagcgccgaggcagaaucgggcggaaucacaacaaagagggagaccaguacauuuauaugggccagcccuugaauaacgaugaggaccaugcccacuggacagaagcuaagauguuacuggauaauaucaacacuccagaggguaucauucccgcccucuucgaaccugagagggaaaaguccgcggcaauagacggggaguaccgccugagaggcgaggccaggaaaacguuuguggaacuuaugcggcguggagaucugccaguauggcucagcuauaagguggcuucagagggcuuccaauacagugaccgccgaugguguuuugauggggaaagaaauaaccagguuuuggaggaaaauauggacgucgagaucuggaccaaagagggagaaaggaagaaacugcggccccgcuggcuagacgccagaacauauucugauccucuggcucucagggaguucaaggaauuugcagccggucggcgauccgugagcggcgaccuuauucuggagaucgggaaauuaccgcagcacuugacucagagagcucaaaacgcccuggauaaucucgugaugcugcauaacucagaacagggaggccgcgcauacaggcacgcgauggaggagcuuccagacaccauugaaacacugaugcucuuggcccugaucgcugucuuaaccggugggguuacucuauucuuucugaguggccggggacucggcaagacgagcauagggcuucugugcgugauggccuccucuguauugcuguggauggcaagcguggagccccauuggaucgcugccuccauuauccucgaguucuuucugaugguccuucucauuccugagcccgaucgucagagaaccccacaggacaaucaacuggcauaugugguuaucggauugcuguucaugauauuaacaguggccgcuaacgagaugggucuacuggaaacuaccaagaaagaucucggcauugggcacgucgcgguagagaaucaccaucacgccgcaaugcuugacguggaucugcauccugcuucagccuggacauuguacgccguugcaaccacuaucauuacacccaugaugaggcacacgaucgaaaacaccacugcuaacauaucucugacagccaucgcgaaucaggcugccauucucaugggacuggacaagggcuggccaaucaguaaaauggauauuggugugccucuuuuagcacugggguguuacucgcaggucaacccgcucaccuugaccgccgcugugcugaugcuagucgcacauuaugccaucauaggccccggacugcaagcgaaggcuacacgcgaggcccagaaacggacugcagccggcauuaugaagaauccaacgguggacgggaucguugcuaucgaucucgacccugugguauacgacgccaaguuugaaaaacagcuuggacagauuaugcuguugauccugugcaccagccaaauacuccugaugcgaacaacuugggcauuaugugaguccauuacccuugcuacaggcccccugaccacucucugggaggguucuccagggaaguucuggaacacgacaaucgccgugucaauggcgaauauuuuuagaggaagcuaucuagccggcgcaggucuggcuuucuccuugaugaaaagucugggcgggggaaggcgcggcaccggggcccagggagaaacucucggcgagaaguggaaacggcagcuuaaccagcugucuaagagcgaguucaauaccuacaagagaucagguaucauggaggucgaucguuccgaagcaaaagagggguugaagaggggagagacaacuaaacacgcuguuagucggggcaccgccaagcugcgcugguuuguggaacgaaaccucgucaaaccugaggguaaggugauagacuuaggcugcgggagaggaggcuggagcuauuacugugccgggcugaagaaaguaacagaagugaagggauauacgaaaggcggucccgggcacgaggaaccgaucccaauggcgaccuacggauggaaucuuguuaagcugcauucuggcaaagauguguucuuuauuccucccgagaagugcgacacucuacucugugauaucggcgaguccucaccaaaccccacaauugaagaggggaggacccugcgggucuugaaaaugguggaaccuuggcugcgcggaaaucaauucugcaucaagauucucaacccguacaugcccagcgucguggagacucuugagcagaugcagagaaagcacgguggcaugcugguuaggaauccauuaucgcgaaacucuacacaugaaauguauuggguaaguugugggaccggaaauaucguguccgcugucaacaugacgagccggaugcuguugaaucguuuuaccauggcacacagaaaaccuacauacgagcgcgacguggaucucggcgccgguacuaggcacguugcuguggaacccgaggucgccaaccuggacauaauugggcagcggaucgaaaacaucaagcaugagcacaaaucaaccuggcauuaugaugaggacaauccuuacaagacaugggcauaucacggauccuacgaagugaaaccaucuggcagcgccaguuccaugguaaacggcgugguuaagcuacuuacuaagcccugggaugucauuccuauggugacccaaauagcuaugacagacaccacuccauucgggcagcagagaguguuuaaagagaaggucgacacgcgcacacccaaagcgaagaggggaaccgcccaaaucauggaaguuacugcaaaauggcugugggguuuccucagccgaaauaagaagccgcggauuugcaccagagaggaauuuacaaggaaagugcgcucuaacgcugccaucggcgcaguauucguggaugagaaucaguggaacucagccaaggaggcugucgaagacgagcguuuuugggaucuggugcaucgggaaagagaguugcacaaacaggggaagugcgccacguguguuuauaauaugaugggaaaaagggaaaagaagcugggcgaguucgguaaagcgaaggggagucgcgcaauuugguacauguggcucggagcccgauuucuugaguucgaagcucugggcuucaugaacgaggaccacugguuuucccgggaaaauagcuuaucuggcguggagggggagggacugcauaaauuggguuacauccucagagauauaucgaagaucccuggcgggaacauguaugccgacgauaccgcaggaugggacacuaggauuacagaagaugaccugcagaaugaggcucgcaucaccgauauuauggaaccagagcacgcccuacuugcuaaaucaaucuucaagcugacuuaccaaaacaaagucgugagaguacagcggcccgccaagaauggcacaguuauggacgugauaagcaggcgugaucagcgagguuccgggcaggucggaaccuauggccucaacacauuuacuaauauggaagcacaacugauucgccagauggagagugagggcaucuucucuccuagcgaauuggagaccccaaacuuagcggaaagagugcuggacuggcucgagaaguacgggguggaacggcuuaaaaggauggccaucuccggagacgauugcgucguuaagcccauugacgaucgcuuugcuacggcccugaccgcacuaaacgacauggguaaagugagaaaggauauaccgcagugggagccuucaaaaggcuggaaugacuggcagcaaguacccuucuguagucaucacuuucaccagcugaucaugaaggaugggcgggagauuguggucccaugcaggaaccaggacgaacucgugggacgagcucguguuucucagggcgccgguuggagcuugagagagacagcaugucuggggaaguccuaugcccaaauguggcagcuuauguacuuccaucgccgggaucugaggcucgcggcuaaugccaucugcucagcagugccugucgacuggauucccacuagcagaaccacauggucuauccacgcccaucaccaguggaugacuaccgaagauauguuauccguguggaaccgcguauggauagaggaaaauccauggauggaggacaaaacgcauaucaguagcuggggagacguucccuaucugggcaagcgggaggaucaaugguguggcucguugauugggcugacagcuagggccaccugggcaacuaacauccagguggcuauuaaucagguccgaagacucaucggaaacgaaaauuaccuugacuacaugacauccaugaaacgguuuaagaacgagucugauccugaaggugcccugugguga

SEQ ID NO: 14101 - RNA, 9879 nt, Artificial Sequence
  derived and/or modified CDS sequence (opt3) from DENV-1__JQ045657__SS-prME
agcgugaccaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucuacgacacgguuggaaaacaucauguggaagcagauuucgaacgagcugaaucauauccuccuggaaaacgacaugaaauuuaccguagucgugggcgauguugcagggauuuuagcucagggaaagaaaaugauccgcccucagcccauggaguacaaguauagcuggaaguccuggggcaaagccaagauaaucggggcggacgugcaaaauacuaccuucauuaucgauggaccaaacacaccugaaugucccgacgaucagagagccuggaauauuugggaggucgaggacuacggcuuugguaucuucacuaccaacauauggcugaaacuuagggauucauauacacaggugugcgaccaccguuugaugagugcugcaauuaaggauucuaaagccguucacgcugacaugggguacuggaucgaaagcgagaagaaugaaacguggaagcucgcccgggcauccuucauugaggugaaaaccuguaucuggccaaagucacauacucuguggagcaacggaguacuagaaucugagaugauaauccccaaaauuuauggcgguccuaucucccagcacaauuaccgaccaggcuacuuuacacaaaccgcggggccguggcaucugggaaagcucgagcuggauuucgaccuuugcgaaggcacuacagucgugguggaugagcacugcgggaacagaggacccaguuugaggaccacgacugucaccggcaaaauuauccacgaaugguguugccgcagcuguacacugccuccauuacgguuuaagggugaggacgggugcugguauggaauggagauaagacccguuaaggaaaaagaggaaaaucucgugaagucuaugguauccgccggcucaggugagguggacaguuucagccugggccuucuguguauuucgaucaugaucgaagaggucaugaggucccgcuggucucgaaaaauguugaugaccgggacucucgcuguguuuuuccugcuaauuaugggacagcugacauggaacgaucucauccggcugugcauuaugguuggcgccaaugcaagcgaccguauggggaugggaaccacauaccuugcuuugauggccacuuuuaagaugagaccuauguucgcagugggccuguuauuuaggcgccucaccucacgggagguccugcuucugacgauaggucuaagucucguggccuccguugaacugccaaacucuuuggaggaacugggggauggauuagcuaugggcaucaugauucucaaacugcuuacagacuuccagagccaucaacugugggcgaccuugcucucccugacuuuuaucaagaccacauucucacuacacuaugccuggaagacuauggcaauggugcugagcauugucagucuuuuuccccucugucugucuaccacgucccagaaaacaaccugguugccgguacuguuaggcagccucgggugcaagccucugacuauguuccuuaucgcugagaauaaaauauggggaagaaagucguggccacugaacgaagguaucauggccgugggcauuguuucaaucuugcucucuagucugcucaagaaugaugugccccuggccgggccucuuauugcuggaggcaugcucaucgcauguuacgucauauccgguagcucugccgaccugagcuuggagaaggcggcugagguguccugggaagaggaagccgagcauucaggggcaagucacaauauuuuaguagaagugcaggaugacggaacaaugaaaaucaaggaugaggagagggacgauacccugacuauccuccugaaggccacacuucuggcugucagcggcguuuaucccuugucuauuccagcaacccuauucgugugguacuuuuggcagaaaaagaaacaacgauccggcgugcugugggacacgccuucacccccagaagucgagcgcgccgugcucgaugacgggauauaucggaucaugcagagaggacugcuugguaggagucagguuggcguagggguguuccaggaaaacgucuuucauacuauguggcacgugacccguggagcgguuuuaauguaccaaggcaagcgccuggagccgagcugggcuuccgugaaaaaggaccucauuucuuacggugggggauggcgguugcagggcucguggaauacaggcgaggaaguccaggugaucgccguagagccugggaagaaccccaaaaauguccagaccgcaccaggaacauucaagacuagcgaaggugaggugggcgccauugcucuggauuuuaaacccgggaccucaggauccccuaucguuaacagagaaggcaagauagugggucucuaugggaauggagucgugacgacaaguggcacuuacguuucugccaucgcacaagcuaaagccagccaggagggcccacugcccgagauugaagacgagguguucaggaagcgaaaccuuaccaucauggaucugcacccuggguccggaaagacacggcgcuauuugccggcgauugucagagaagccaucaaaaggaagcuacggacccugauacucgcaccaacucgagugguagcuucagagauggccgaggcuuuaaaagguaugcccauuagauaccagaccacagcagugaagucugagcauacgggcaaagagaucguugaccugaugugccacgccacuuuuaccaugcgccuucugagcccugucagggugccaaauuauaacaugaucauuauggaugaagcccauuucacagaccccaguuccaucgcugcgcguggguacauaagcacccgggugggaaugggcgaggcagccgcuauuuuuaugacugccacaccuccggguucugucgaagcauucccccaaucaaaugccguaauccaggaugaggaaagagacauuccagagagguccuggaacaguggguaugaguggaucaccgauuuuccuggaaagacggugugguucguucccagcauaaagucgggcaaugacauugcuaacugucuccgcaaaaauggcaagcgagugauccaguugucuagaaaaacuuucgauacagaauaccagaagaccaaaaacaacgacugggacuacgucgugaccacugauaucuccgagaugggggcgaauuuucgggccgacaggguuauugauccacgccguugccugaagccugugauccucaaggacggacccgaaagagucauucuggcagguccaaugccggugacaguagcuagcgccgcacaacggaggggccgcauagggcgaaaccacaauaaagagggagaucaguauaucuacaugggccagccucuuaacaaugacgaggaucaugcccacuggaccgaagcuaagaugcuacuggacaacauuaauacacccgaggguaucaucccagccuuguucgaacccgagagagaaaaaucagcggcaauugauggggaguaucgguuaaggggcgaggcccgcaagacuuuuguggaacugaugagaaggggagaccucccuguuuggcugaguuacaaagucgcuucugagggcuuccaguauuccgaucggcguuggugcuuugacggggaacgcaacaaucaagugcuugaggaaaacauggauguggagauauggacgaaggagggagaaagaaagaagcugagaccaagguggcucgacgcccggaccuacagcgaccccuuggcucugcgcgaguucaaggaauuugcagccgguagaaggucagucaguggcgaucuaauccuggagauugggaaacucccucagcaccuuacacagcgggcucagaaugcccuggacaacuuaguuauguugcauaauagcgaacaaggaggccgagcauauagacacgcgauggaggagcugccggauacuaucgaaacccucaugcugcuugcccugauugcugugcucacaggugggguaaccuuguucuuucuguccggccgcggauuaggcaagacuucuaucgggcuacugugugugauggccagcuccguccuccuuuggauggcaucaguggagccacauuggauagcugccucuaucauucuggaguucuuuuugaugguucugcucauccccgagccugacaggcagcggacgccccaggauaaccagcuggcauacguggucauuggacuucucuucaugauccugaccguagccgcuaaugagauggguuugcuggaaacaacuaaaaaggacuuaggcauagggcacguggcggccgagaaccaccaucacgcagcuaugcuagauguugaccugcauccagccagugccuggacccucuacgcaguggcuacaaccauuaucacuccuaugaugcgucacacaauugaaaacacgaccgccaauaucucgcuuacugcgauagcuaaccaagccgcaauccugaugggauuggauaaaggcuggcccauuagcaagauggacaucggugucccacugcucgcccuggggugcuauucccaggugaauccucuuacauuaaccgcugcaguccugaugcucguggcccauuacgcgauuaucggcccgggauugcaggcuaaggccaccagagaggcacagaaaaggacagccgcuggcauaaugaagaaccccacuguugaugggauuguggccaucgaccuggauccaguaguguaugacgcaaaauuugaaaagcagcuaggacagaucaugcugcucauucuuuguacgucucagauccuguugaugcgcaccacaugggcucugugcgagucaauaacucucgccaccggcccucugacaaccuuaugggaggguagccccgggaaauucuggaauacuacgauugcggucuccauggccaacaucuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguauuauggagguugaccggagcgaagcuaaggaggggcucaaaagaggagagaccacaaagcacgccgugucucguggcacugccaaacuuaggugguuugucgaacggaaucuggugaaaccagaggguaagguaaucgauuugggcugugggcgcggaggcugguccuacuauugcgcggggcugaaaaaggugaccgaaguuaaaggauacacaaagggcgguccugggcacgaggaacccauaccgauggcuacguacggauggaaccucgugaaauuacauucaggcaaggacgucuucuuugugccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuauaugccgucuguuguagagaccuuggagcaaaugcagcggaaacacgguggcaugcuggugcgcaacccccucaguagaaauuccacucaugaaauguacugggucagcugcgggacaggaaacaucgugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacggcuggaugggauacccggauaacugaagacgaucugcagaacgaggccagaaucacagacauuauggaaccugagcacgcuuugcucgccaaguccaucuucaagcugaccuaucagaauaaaguaguuagggugcaacgcccagcaaagaacggcacugucauggaugugauuaguagacgggaccagagggguucuggacaggugggaacauacggccuaaauaccuuuacaaacauggaagcgcagcuuauccgucaaauggagagcgaggaaauauucucccccucagagcuggaaacuccuaaccucgccggccgaguccuggauugguuggagaaacaugggguugaacgcuuaaagagaauggcuauuaguggagacgacugugugguaaaaccaaucgaugaccgguuugccaccgcacugacggcucucaaugauauggguaaggugaggaaggacaucccccagugggagccgucuaaaggcuggaacgauuggcagcaggucccuuucugcagccaccacuuucaucaacuuauuaugaaggacgggcgcgagauagugguucccuguagaaaucaggaugaacuggugggacgggccagggucucccagggcgcagguuggucacuacgagagaccgccugccuggggaaaagcuaugcgcagauguggcaacucauguacuuccaccguagagacuugcgccuggcugccaacgcaaucuguucugccgugccaguagauuggguuccuacaucccggacuaccuggaguauucaugcucaccaucaguggaugacaacugaagacaugcuuagcguguggaauagggucuggaucgaggaaaaccccuggauggaggauaagacccacauuucguccuggggagacgugccauaucugggcaaaagagaggaccaguggugcggcucucucaucggguuaacggcccgcgcaacaugggcuaccaauauacaaguugccaucaaccaggugcggaggcugauuggaaaugaaaacuacuuggauuacaugacuucaaugaagcgauuuaagaaugagagcgaccccgaaggugcgcugugguga

SEQ ID NO: 14102 - RNA, 9879 nt, Artificial Sequence
  derived and/or modified CDS sequence (opt3) from DENV-1__JQ045659__SS-prME
agcgugaccaugcugcucaugcuuaugcccacagcccuggcuuuccacuugacuacgagaggaggggaaccucauaugaucgucuccaagcaggaaaggggaaaaucuuuacuguuuaagaccucagccgguguuaacaugugcacacugauugccauggaccucggagagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguugacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguucguucaaacuggagaaggaagucgccgagacgcagcacgguacagugcuuguucagauaaaguacgagggcaccgacgcuccuugcaaaaucccauucucgacucaagaugaaaagggggcgacacagaacggacgcuugauuaccgcaaaucccaucgugacugacaaagagaagccuguaaacauagaagccgagccacccuuuggcgagucuuauauugucaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcguguuuacguccguugggaaacuugugcaucagauuuucggaaccgcguacggcguccuguuuucuggugugagcuggacuaugaagauagggaucggcguauugcucacauggcugggauuaaauucacgaaguaccucccugagcaugacauguauugcugugggccuaguuacucucuaccugggggucauggugcaggccgauucuggaugcgugaucaacuggaaaggccgcgaacuuaagugugguucagggaucuucgucaccaaugagguucacacguggacagaacaauauaaguuucaggcagacaguccgaaaagauugagcgccgcuauuggaaaggccugggaggagggcgugugcgguauaagguccgcaacccggcuggaaaacaucauguggaaacagauuucuaacgagcucaaucauauccuguuagaaaacgacaugaaguucacugugguagucggcgaugugaccgggauucuggcucagggcaagaagaugauccgcccucaacccauggaguacaaauauucguggaaaagcuggggcaaggccaagauaaucggggcggacguucagaauacaacuuuuauuaucgauggaccaaacaccccugaaugucccgacgaucagagagccuggaauauuugggagguggaggacuacggcuucgguaucuuuacaacgaacauauggcuuaaguugagggauucccacacccaggucugcgaccaccgucucaugucagcugcaauuaaagauaguaaggccgugcaugcugacaugggguauuggaucgaaucugagaaaaaugaaacuuggaagcuggcccgggcauccuucauugagguuaagacauguaucuggccaaaaucccacacccuauggucaaacggagugcuggaaagcgagaugauaauccccaagauuuacggcgguccuaucucucaacauaauuaucgaccaggcuacuucacucagacagcggggccguggcaccucggaaaacuggagcuugauuuugacuugugcgaaggcaccacgguagccgucgaugagcacugcgggaacagaggacccucccugaggacuaccacagugaccggcaagauuauccaugaaugguguugccgcaguuguacuuuaccuccacuccgguucagaggugaggacgggugcugguacggaauggagauaaggcccgugaaagaaaaggaggaaaaucuggucaagagcaugguuucugcuggcuccggugagguggacucauuuagucuuggccuguuguguauuagcaucaugaucgaagagguaaugcgcucgcgauggucccggaaaaugcucaugacagggacccuggccguguucuuucuacugauuaugggacagcucacauggaacgaucugauccgucuuugcauuauggucggcgcaaaugcuucugacagaauggggaugggaacuaccuauuuggcccugauggcaacguucaagaugaggccuauguuugccgugggcuuacucuuccgccggcugacaagcagagagguucuucugcuaaccauaggucucucacugguggcuaguauggaauugccaaacucccuggaggaauuaggggauggacucgcgaugggcaucaugauucugaaacuucugacugacuuucaaucucaccaguugugggccacccuccugagccuaacauucaucaagacuaccuuuucccugcauuacgcauggaaaacgauggcuaugguccuuucaauugugagccucuucccccuguguuugaguacaaccucucagaagacuacauggcugccgguuuuacucggcucccuggggugcaagccucuuaccauguuucugaucgccgagaauaaaauauggggaaggcgaagcuggccauugaacgaagguaucauggccgugggcauugucucgauccuccugucaucucuacugaagaacgauguaccccuugcugggccucucauugcaggaggcaugcugaucgccuguuaugugauaagugguuccagcgcggacuugucuuuagagaaagcugccgagguuagcugggaaaaggaggcagaacacuccggggccucacauaauauucugguggagguccaggaugacggaacuaugaaaaucaaggaugaagaacgcgacgauacacucaccauccugcuuaaagcuacgcuguuggcagugaguggcguauacccccuaagcauuccagccacucuguucgugugguauuucuggcaaaagaagaaacagcggucuggcguccucugggacaccccuucacccccagagguugggagagcggugcuggaugacggaauauacaggaucaugcagcguggucuuuuaggccgcagccaggugggggucggaguguuucaagaaaacguuuuccacacaauguggcacguaacccggggcgcugugcugauguaucaggguaagagacucgagccgaguugggccagcgucaaaaaggacuugauuuccuacgggggaggcuggaggcugcagggcucuuggaauacaggggaagaggugcagguuaucgcaguggagccuggcaaaaaucccaagaauguccaaacugccccagguaccuuuaagacgcccgaaggcgaggugggggcuauugcccucgauuucaaaccuggaacaucgggcagcccaaucguaaaccgagaagguaagauagucgggcuguacggaaauggcgugguuacuaccucaggcacauauguguccgcaaucgcucaggccaaagcgagucaggaggggccccuuccugaaauugaggacgaggucuuucggaagcgcaaccugaccaucauggauuugcauccgggaucugguaaaacuagaagguaccuaccagccauugugcgggaagcaaucaagcgaaagcugagaacccucauauuagcucccacacgcguuguggccagcgagauggcugaagcacugaaaggcaugccuauuagguaucaaacgacugccgucaaguccgagcacaccgggaaagaaaucguggaccuuaugugccaugccacauucaccaugcgucugcucucaccaguacgggugcccaauuacaacaugaucauuauggaugaggcucacuuuacugacccuucuagcaucgcggcaagaggauauauaaguacaaggguuggcaugggugaggccgcugccauuuucaugaccgcaacgccgcccggguccgucgaagccuuuccacagagcaaugcugugauccaggaugaggaacgcgacauuccugagcgaucuuggaacucaggauacgaauggaucacugauuuccccggcaagacagugugguuugucccauccauaaaaaguggcaaugacauugcgaacuguuugagaaagaaugggaagcggguaauccagcugagcaggaaaaccuucgauaccgaguaucaaaagacuaaaaacaacgacugggacuacgugguuacaaccgauaucucggagaugggagccaauuuccgcgcagaccgugugauugauccuagacggugccucaagcccgucauccugaaagacgguccagaaagggugauucuugcuggcccgaugccuguuacaguggccucugcagcccagcgccgagggagaauaggacggaaccauaauaaggagggcgaucaguacaucuauaugggucagccccuaaacaaugacgaagaucacgcucacuggacugaggccaagaugcuguuggacaacauuaauacgccagaggggaucauccccgcguuauuugaaccugagagggaaaaauccgcagccauugauggcgaguaccgccugagaggagaagcuaggaagaccuucgucgagcucaugcggcguggcgaccugccaguguggcuuagcuauaaaguagccucagagggguuucaauacagugaucgccgauggugcuucgacggagaaagaaacaaucaggugcuggaggaaaacauggauguugagauauggacaaaggaaggugagaggaaaaagcuccggccccgcugguuggacgcuagaacuuauucugacccucuggcacuaagggaguuuaaagaguucgccgcuggccggcgauccgucagcggggaucugauccucgagauuggaaaacuuccgcagcaucugacccagagagcccaaaaugcauuagacaacuuggugaugcugcacaauucagaacagggcggucgcgcguacaggcaugccauggaggaacucccagauacaaucgagacccugaugcuucuggcucucauugccguguugacugggggcgucacgcuguuuuucuuaaguggacggggccuagggaagaccagcaucggacugcucuguguuauggcauccucugugcuucuguggauggcuagcguagagccccacuggauagccgcauccaucauuuuggaauuuuuccugauggugcuccugaucccugagcccgaccgucagagaacaccacaggauaaccaacuugccuaugucgugauuggucuccuguuuaugaucuugacuguugcugcgaaugaaaugggccuguuagagaccaccaaaaaggaccuagggauaggacacguggccgucgagaaccaucaccaugcagcuaugcuggauguagaccuccacccugccucagccuggacccuuuacgcaguggcuacuacaauuaucacgcccaugaugaggcauaccauugaaaacacuacagccaauaucucucugaccgcgauagcuaaccaggccgcaaucuugaugggccuggauaaagguuggccaauuaguaagauggacaucgggguuccucuccuggcccuuggcugcuacagccaggugaauccguuaacccugacagcugcaguccucauguugguggcccacuaugcgauuaucggacccggccugcaagcuaaagccacucgcgaggcacagaagcggacggccgcugggauaaugaagaacccaaccgucgauggaauuguggccaucgaccuagauccuguuguguacgacgcaaaauucgaaaagcagcugggccagaucaugcuccuuauucuguguacaagccaaaucuugcugaugcgaacuaccugggcucucugcgaguccauaacacuggccaccggucccuuaacuacgcuuugggaagggucuccaggaaaauuuuggaauacaaccauugcgguaucaauggccaacaucuucagaggcagcuaucuggcaggagcuggccucgccuucucccuaaugaagagucuagggggaggcaggcgcgggacuggagcacagggcgagaccuugggugagaaauggaagcggcagcugaaucagcucucuaagagcgaauuuaacacauacaaaagaucagggauuauggagguggaccguuccgaagcuaaggagggacuuaaaaggggcgaaacuaccaagcacgccgucagucgggguacagccaaacugcgcugguucguugagcgaaauuuggugaagccugagggcaaggucaucgaucugggguguggaagaggcggguggagcuauuacugcgcgggacucaaaaaggugacggaaguaaaaggcuauaccaagggugggcccggacaugaggaaccgauaccaauggcuacuuacggcuggaacuuagugaaacugcacucuggcaaggacguauuuuucaucccucccgagaaaugugauacacuucugugcgacauuggggaauccucaccaaaucccaccaucgaggagggaaggacucuacgggugcucaagauggucgaaccuuggcugcgcgguaaccaauuuuguauuaagaucuugaauccguacaugcccagcguggucgagacacuggaacagaugcagagaaaacauggcgggaugcucgugaggaacccacuuucgcgaaauucuacccacgagauguauuggguuaguugcggaacgggcaacauuguauccgcagugaauaugaccagccggaugcuguuaaaccguuucacaauggcccacagaaagccuacuuacgagcgcgaugucgaccugggugcugggaccaggcauguggccguugaacccgagguggcaaacuuggauaucauaggacagcggauugaaaauaucaaacacgagcauaagucaacauggcacuaugacgaagauaacccuuacaaaacuugggccuaucauggcuccuacgaggucaagccaucuggcagcgcuaguuccauggugaaugggguagugaagcuccugaccaaacccugggacguuaucccuauggucacacaaauugcgaugaccgauacuacgccauuuggacagcagagaguguucaaggagaaaguggacacacgcacccccaaggccaaaagggguacugcacaaauaauggaagucaccgcuaaguggcuauggggcuuucuuagccgaaacaagcggccgagaaucuguacaagggaggaguucacgcgcaaaguucguucuaaugccgcaauuggggccguguuuguagacgagaaccaguggaacucagcuaaggaagccguggaggaugagcgguucugggaccugguccacagagaaagggagcuccacaaacagggaaagugcgcgaccugcguguauaacaugaugggcaaacgcgaaaagaagcugggugaguuugggaaagcaaagggaagucgagccaucugguacaugugguugggcgcucgguuccuggaguucgaggcccucggcuuuaugaaugaggaucauugguucuccagagaaaacagccuuucugggguugagggagaaggucugcacaaauuaggcuacauucugagggacaucucgaagauaccugggggaaauauguaugcagaugacacugcuggcugggauacacgcaucaccgaggacgauuugcagaacgaggccagaauuacugacaucauggaaccagagcaugcucuccuggccaaaucaauuuuuaagcuaacauaccaaaauaaagugguccgggugcagaggcccgcaaagaacgguaccguaauggauguuaucagccgucgagaccagcgcggguccggacaggugggcacauauggccuuaauacuuucaccaacauggaagcgcaacugauaagacagauggagagugaagggauauuuucuccuagcgagcucgagacgccaaaccuggccgaacgggucuuggauugguuagagaaguacggaguggaaaggcugaaacgcauggcuaucuccggugacgacuguguggucaagcccaucgaugacagauucgccaccgcacucacagcucuuaaugauaugggcaaaguucggaaggacauuccgcagugggagccuucaaaaggguggaacgauuggcagcaagugcccuuuugcagucaccacuuccaucagcugauaaugaaggacggaagggaaaucguagugccaugucgaaaucaggaugagcuagucggccgugccagagugucucagggugcaggguggagccugcgcgagacugccugccucggaaaguccuaugcgcaaauguggcaguugauguacuuucaccggagggaccugagacuugcugccaacgcaauuuguucagccguuccuguggauuggauccccaccagccgcacaacuuggucuauucaugcucaccaucaguggaugaccacggaagacaugcuguccgucuggaaucggguguggaucgaggaaaacccauggauggaggauaaaacacacauaaguagcuggggcgacguacccuaucucggcaagagggaagaccaauggugcgggucguuaaucggacugaccgcccgagcaacuugggcuacaaauauucagguugccaucaaccaggugagacgguugauugguaaugagaacuaccuggauuacaugaccuccaugaaaagguucaagaaugagucugacccugaaggcgcgcucugguga

SEQ ID NO: 14103 - RNA, 9879 nt, Artificial Sequence
  derived and/or modified CDS sequence (opt3) from DENV-1__JQ045661__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauaugguugaagcucagggauuccuacacgcaggucugcgaccaccgucugaugucagcugcaauuaaagauaguaaggccgugcaugcugacaugggguauuggaucgaaucugagaaaaaugaaaccuggaagcuagcccgggccuccuucauugagguuaagacuuguacauggccaaaaucccacacccuguggucaaacggagugcucgaaagcgagaugaucauacccaagaucuacggcgguccuauuucucaacauaauuaucgaccaggcuacuucacucagacagcggggccguggcaccugggaaaacuugaguuggauuuugaccugugcgaaggcaccacgguagucguggaugagcacugcgggaacagaggacccuccuuaaggacuaccacagugaccggcaagaucauucaugaaugguguugccgcaguuguacucucccuccacugcgguucagaggugaggacgggugcugguacggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgauggucccggaaaaugcugaugacagggacccuagcugucuucuuucugcucaucgugggacagcugacauggaacgaucuuauucguuugugcaucaugauuggcgccaaugcaucugacagaauggggaugggaacuaccuaucuggcuuuaauggccacguucaagaugaggccuauguuugcaguuggccuccuguuccgccggcuuacaagcagagaggugcugcuacucaccauaggucugucauuggucgccaguguggaacugccaaacuccuuagaggaacucggggauggacuggcuaugggcaucaugauucuuaaacuguugacugacuuucaaucucaccagcucugggcgacccugcuaagccugacauucaucaagacuaccuuuucccuucauuacgccuggaaaacgauggcaaugguucucucaguggucagccuguuccccuugugucugaguacaaccucucagaagacuacaugguuaccgguacuccugggcucccuugggugcaagccucugaccauguuuuugauugcugagaauaaaaucuggggaaggcgaagcuggccacucaacgaagguauaauggccgugggcaucguuucgauucugcuaucaucucugcuuaagaacgaugugccccucgccgggccucugaucgcuggaggcauguugauugcauguuaugucaucagugguuccagcgccgacuuaucucuggagaaagcggcugaggugagcugggaagaggaagccgagcacuccggggcaucacauaauauacucguagaagugcaggaugacggaacuaugaagauuaaagaugaggagcgcgacgauacacugaccauccuucugaaggccacguugcuagcugucaguggcguuuacccccugagcaucccagcaacucucuucgugugguauuucuggcagaagaagaagcagcggucuggcgugcugugggacaccccuucacccccagaagucgagagagccgugcuugaugacgggauuuacaggauaaugcagcguggauuacugggucgcagccagguuggcguagggguguuucaagaaaacgucuuccacacaauguggcacgugacccggggagcgguucucauguaucagggcaaaagauuggagccgaguugggcuagcgugaagaaagaccugaucuccuacggugggggauggaggcuccagggcucuuggaauacaggcgaggaaguccaggugauugccguagagccugggaagaaccccaaaaauguccaaacugcaccaggaaccuuuaagacgcccgaaggugaggugggcgccaucgcucuggauuucaagccugggacaucgggaagcccaauuguuaaccgagaaggcaaaaucgugggucuuuacgggaauggagucgugacuaccucaggcacauauguuuccgccauagcacaggcuaaggccagucaggagggcccccugccugagaucgaagacgagguguuucggaaacgcaacuugaccauuauggaucuacauccggggucuggaaagacuagaagguaccugccagcgaucguccgggaagccauuaaacgaaagcucagaaccuuaauccuggcacccacacgcgugguagcuagcgagauggccgaagcucuuaaggguaugccuauaagguaucaaacgacugcagugaaauccgagcacaccggcaaggagauuguugaccugaugugccaugccacauucaccaugcgucucuugucaccaguccgggugcccaauuacaacaugaucaucauggaugaagcccacuuuacugacccuucuagcauugcugcgagaggguauaucaguacaagggugggaaugggcgaggcagccgcuauauucaugaccgccacgccgcccgguuccgucgaagcauuuccacagagcaaugccguaauucaggaugaggaacgcgacaucccugagcgaucuuggaacucaggguacgaguggauuacugauuuccccggaaaaacagugugguuuguuccauccaucaagaguggcaaugacauagcuaacugucugaggaaaaauggcaagcgggugauucagcucagcaggaagaccuucgauaccgaauaucagaaaacuaagaacaacgacugggacuacgucgugacaaccgauaucucggagaugggggcgaauuuccgcgccgaccguguuaucgauccuagacggugccugaaacccgugauucuuaaggacggaccagaaagggucauccuagcagguccgaugccugugacaguagcuucugccgcacagcgccgaggcagaauugggcggaaccauaauaaagagggagaucaguacauauauaugggccagccccugaacaaugacgaggaucacgcccacuggacugaagcuaagauguuguuagacaacaucaauacgccagaggguauuauccccgcccuguuugaaccugagagggaaaaguccgcggcaaucgauggggaguaccgccucagaggcgaggccaggaaaaccuucguggaacugaugcggcguggagaccuuccaguuuggcugagcuauaaggucgcuucagagggcuuucaauacagugaucgccgauggugcuucgacggggaaagaaacaaucaggugcucgaggaaaacauggauguggagauuuggacaaaagagggagaaaggaagaaauugcggccccgcuggcuggacgccagaacuuauucugacccucuagcucugagggaguuuaaggaguucgcagccggucggcgauccgucagcggcgaucucauacuugagaucgggaaacugccgcagcauuuaacccagagagcucaaaaugccuuggacaaccugguuaugcuccacaauucagaacagggaggccgcgcauacaggcaugcgauggaggagcugccagauacaauugaaacccuuaugcugcucgccuugaucgcugugcugacuggugggguaacguuauuuuuccuaaguggccggggacugggcaagaccagcauugggcuccuuugugugauggccuccucuguccuguuguggauggcaagcguggagccccacuggaucgcugccuccauaauccuggaauuuuuccucaugguucugcuuauuccugagcccgaccgucagagaacaccacaggauaaccaacucgcauauguggucaucggacuguuguuuaugauucugacuguagccgcuaaugagauggguuuacuagaaaccacaaagaaagaccugggcaucgggcacguggcgguugagaaccaucaccaugccgcaaugcucgauguggaccuucacccugcuucagccuggacccuguacgccgucgcaacuacaauaauuacgcccaugaugaggcauaccaucgaaaacacuacagcuaauauuucuuugaccgccaucgcgaaccaggcugccauacugaugggacucgauaagggcuggccaaucaguaaaauggacauuggugugccucugcuugcauuagggugcuacucgcaggucaauccgcugacccucacagccgcuguguugaugcugguugcacacuaugccaucauuggccccggacuacaagcgaaggcuacucgcgaggcccagaaacggacggcagccggcaucaugaagaacccaaccguggaugggauaguagcuauugaccuggauccuguggucuacgacgccaaguucgaaaaacagcucggacagaucaugcuucugaucuuguguacaagccaaauucugcucaugcgaacuaccugggcacugugcgaguccaucacauuagcuaccggcccccuuacuacgcugugggaggguucuccagggaaguuuuggaauacaaccauagccguuucaauggcgaacauuuucagaggaagcuaucucgccggcgcaggucuagcuuucucccugaugaaaaguuugggcgggggaaggcgcggcacuggggcccagggagaaacccugggcgagaaguggaaacggcagcucaaucagcuuucuaagagcgaauuuaacacauacaagagaucagguaucauggagguggaccguuccgaagcaaaagaggggcugaagaggggagagacuaccaaauaugcugucagucggggcacagccaaguugcgcugguucguggaacgaaaucugguaaaaccugaggguaaggugauugaucucggcugugggagaggaggcuggagcuacuauugcgccggguuaaagaaaguuacggaagugaagggauacaccaaaggcggucccgggcacgaggaaccgaucccaauggcgacuuacggauggaaccuggucaaacuucauucuggcaaagacguguuuuucauaccucccgagaagugugauacacugcuaugcgacaucggcgaguccucaccaaaucccaccauugaagaggggaggacucuccggguccugaaaaugguggaaccuugguugcgcggaaaccaauuuuguaucaagauucugaauccguauaugcccagcguuguagagacacucgagcagaugcagagaaagcacgguggcaugcuugugaggaacccacugucgcgaaauucuacccaugaaauguacugggucaguugcgggacgggaaacaucguguccgcuguuaauaugaccagccggauguuacugaaccguuucacaauggcacacagaaaaccuacuuaugagcgcgauguggacuugggcgccgguaccaggcacgucgcuguggaacccgagguagccaaccucgauauuaucgggcagcggauagaaaauauuaagcaugagcacaaaucaacauggcauuacgacgaggauaacccuuauaagacuugggcauaccacggauccuaugaagugaaaccaucuggcagcgccaguuccaugguuaauggcgucgugaagcugcuaaccaagcccugggacgugaucccuauggucacacaaaucgcuaugaccgauacuacgccauuugggcagcagagaguuuucaaagagaagguggacacacgcacccccaaagcgaagaggggaacugcccaaauuauggaaguaaccgcaaaauggcuuugggguuuucugagccgaaacaagaagccgcggauauguacaagagaggaguucacgaggaaagugcgcucuaaugcugccaucggcgcagucuuuguggacgagaaccaguggaacucagccaaggaggcuguugaagaugagcguuucugggaccucgugcaucgggaaagagagcugcacaaacaggggaagugcgcaaccugcgucuacaacaugaugggaaaaagggaaaagaaguugggcgaguuugguaaagcgaaggggagucgcgcaauuugguacauguggcugggagcccgauuccucgaguucgaagcucuuggcuuuaugaaugaggaucacugguucucccgggaaaacagccugucuggcguggagggggagggauuacauaaacuggguuauaucuugagagacauuucgaagaucccuggcgggaauauguacgccgaugacacugcaggaugggauacaaggauaaccgaagacgaucuccagaacgaggcucgcaucacugacauuauggaaccagagcacgcccugcuagcuaaaucaaucuuuaaacuuacauaucaaaauaaaguaguuagagugcagcggcccgccaagaacggcaccgucauggaugugauuagcaggcgugaccagcgagguuccggacaggugggaacauacggccugaauacuuucaccaacauggaagcacaacucauccgccagauggagagugagggcauauuuucuccuagcgaacuggagacgccaaacuuggcggaaagagucuuagauuggcuggagaaguaugggguugaacggcucaaaaggauggccauuuccggagacgacugugugguaaagcccaucgaugaccgcuucgcuaccgcccuuacagcacugaaugauauggguaaagugagaaaggacaucccgcagugggagccuucaaaaggcuggaacgauuggcagcaaguccccuuuugcagucaucacuuccaccagcuaauuaugaaggacgggcgggagauagugguuccauguaggaaucaggaugaacuggugggacgagcucgugucucucagggcgccgguuggagccucagagagacugcaugcuuggggaaguccuacgcccaaauguggcagcugauguauuuucaucgccgggaccuuaggcuggcggcuaacgccaucuguucagcagugccuguagauuggauucccaccagcagaacaacuuggucuauccacgcccaucaccaguggaugaccacggaagacaugcucuccguuuggaaucgcguguggauugaggaaaacccauggauggaggauaaaacacauaucaguagcuggggagacguccccuacuuaggcaagcgggaggaccaauggugcggcucgcugauaggguugaccgcuagggccacuugggcaacaaauauccagguggcuauuaaccagguucgaagacugaucggaaaugaaaacuaccucgauuauaugaccuccaugaaacgguucaagaaugagucugacccugaaggugcccuuugguga

SEQ ID NO: 14104 - RNA, 9879 nt, Artificial Sequence
  derived and/or modified CDS sequence (opt3) from DENV-1__JQ045663__SS-prME
agcgugaccaugcugcucaugcuuaugcccacugcccuggcuuuccacuugacuacgagaggaggggaaccucauaugaucgucuccaagcaggaaagagggaaaucuuuacuguuuaagaccucagccgguguuaacaugugcacccugauugccauggaccucggagaacugugugaagauacuaugaccuacaaaugcccacggauuacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaacuuacugugguagucggcgauguggcagggauuuuggcucagggcaagaagaugauccgcccucaacccauggaguacaaauauucguggaaaagcuggggcaaggccaagauaaucggggcggacguucagaauaccacauucauuaucgauggaccauccacuccugaaugucccgacgaucagagagccuggaacauuugggagguggaggacuacggcuuugguaucuucaccacaaauauauggcucaagcugagggauucacacacgcaggucugcgaccaccgucuaaugagugcugcaauuaaagauucuaaggccgugcaugcugacaugggguauuggaucgaaagcgagaaaaacgaaaccuggaagcuggcccgggcauccuuuauugagguuaagacuuguaucuggccaaaaucacacacacucuggagcaauggagugcuggaaucugagaugauaauccccaagauuuacggcgguccuaucucccaacauaacuaucgaccaggcuacuucacccagacugcggggccguggcaccuuggaaaauuggagcuggauuucgacuuaugcgaaggcacaaccguagucguggaugagcacugcgggaauagaggacccagucucaggacgacuaccgugacaggcaagauuauccaugaaugguguugccgcagcuguacccugccuccacuucgguuuagaggugaggacgggugcugguacggaauggagauaaggcccgucaaagaaaaggaggaaaaccugguuaagucuaugguguccgccggcucaggugagguagacaguuucagcuugggccuccuguguauuucgaucaugaucgaagaggugaugcgcucccgauggucucggaaaaugcuaaugacugggacacuggcugucuuuuuccuccugauuaugggacagcuuaccuggaaugauuugauccgucugugcauuauggugggcgccaacgcaagcgacagaauggggaugggaacaacuuauuuagcucucauggccaccuuuaagaugaggccuauguucgcaguuggccugcuuuuucgccggcugacgucaagagaggugcuacuccugacaauagguuugagucuggucgccuccguggaauuaccaaauucucucgaggaacugggggauggacuugcuaugggcaucaugauucugaaauugcucaccgacuuccaaagccaccagcugugggcgacucuacugucccuuaccuuuaucaagacaacuuucucacuccauuacgccuggaaaaccauggcaaugguucugagcauugugaguuuguuuccccuguguuuaucuacgacaucccagaagaccacuuggcucccgguccugcuuggcagccuggggugcaagccuuugacaauguuccucaucgcugagaacaaaauauggggaaggcgaucguggccacugaaugaagguaucauggccguaggcauugugucaauccuacugucuagucuucucaagaacgauguuccccuggccgggccuuugauugcuggaggcauguuaaucgcauguuaugugauauccgguagcucugccgaccugagccucgagaaagcggcugaggucuccugggaagaggaagccgagcacucaggggcaagucauaacauucugguggaaguacaggaugacggaaccaugaagaucaaagaugaggagcgcgacgauacucuuacaauccuguugaaggccacccuacuggcugugagcggcgucuacccccucucuauuccagcaacgcuguuuguuugguauuucuggcagaagaagaagcagcgguccggcgugcuuugggacacuccuucacccccagaaguggagagagccgucuuagaugacgggauauacaggaucaugcagcguggacugcucggucgcagucaggugggcguugggguauuccaagaaaauguguuucacaccauguggcacgucacacggggagcgguguugauguaucagggcaaaagacuggagccgagcugggcuuccguuaagaaagaccucauuucuuacggugggggauggaggcugcagggcucguggaacaccggcgaggaagugcaggucaucgccguggagccugggaagaauagcaaaaacguacaaacagcacccggaacuuucaagaccccagaaggugaggucggcgccauugcucuugauuuuaagcccgggacgucaggauccccuaucgugaaucgagaaggcaaaauaguuggucuguacgggaacggaguggucacaacaaguggcaccuaugugucugccaucgcacaggcuaaggccagccaggagggcccauugcccgagauugaagacgagguuuuccggaaacgcaaucuaacaaucauggaucugcauccuggguccggaaagaccagaagguaccucccggcgauugugcgggaagccaucaaacgaaaguuaagaacucugauacuugcaccaacccgcgucguggcuucagagauggccgaagcucugaaggguaugcccauuagguaucaaacaacggcaguaaaaucugagcacacuggcaaggagaucguggaccucaugugccaugccaccuuuacaaugcguuugcugagcccuguucgggucccaaacuacaauaugaucauuauggaugaagcccacuucaccgaccccaguuccaucgcugcgagaggguauauaagcacuagggugggaaugggcgaggcagccgcuauuuuuaugacagccaccccuccggguucuguggaagcauucccccagucaaacgccgucauccaggaugaggaacgcgacauuccagagcgauccuggaauaguggguacgaguggaucacggauuuuccuggaaaaacuguaugguucgugcccagcauaaagucgggcaacgacauugcuaauugucucaggaaaaacggcaagcggguuauccagcugucuaggaagacauuugauaccgaauaucagaaaaccaagaauaacgacugggacuacguggucacuacagauaucuccgagaugggggcgaacuuccgcgccgaccgugugauugauccaagacggugccuuaaaccuguuauccuaaaggacggacccgaaagggugauucuggcagguccaaugccggucaccguggcuagcgccgcacagcgccgaggcagaauagggcggaaucauaacaaagagggagaucaguacaucuauaugggccagccuuugaauaacgacgaggaucacgcccacuggacagaagcuaagauguuacuggacaauauuaacacucccgaggguaucaucccagcccucuucgaacccgagagggaaaagucagcggcaauugauggggaguaccgccugagaggcgaggccaggaaaacguuuguagaacuuaugcggcguggagaccugccuguguggcucaguuauaagguugcuucugagggcuuccaauacuccgaucgccgauggugcuuugacggggaaagaaauaaccaggucuuggaggaaaauauggauguggagauauggaccaaagagggagaaaggaagaaacugcggccacgcuggcuagacgccagaacauauagcgacccccuggcucucagggaguucaaggaauuugcagccggucggcgaucagugaguggcgaucuuauccuggagauugggaaauuaccucagcauuugacucagagagcucaaaacgcccuggacaaucucgucaugcugcacaacagcgaacagggaggccgcgcauacaggcaugcgauggaggagcuuccggauaccaucgaaacacugaugcucuuggcccugauugcuguuuuaaccgguggggugacucuauuccugcucuccggccggggacuuggcaagacgucuaucgggcuguuguguguaauggccagcuccgugcugcucuggauggcaucagucgagccacacuggauagcugccucuaucauucuggaauuuuuccuuauggugcuccugauccccgagccugaccgucagagaacaccccaggauaaucaauuggcauauguugugauuggacuguuauuuaugauccuaacagucgccgcuaacgagaugggucugcucgaaacuaccaagaaagaccuuggcauagggcacguagcgguggagaaucaucaccaugccgcaaugcuggauguugacuugcacccagcuagugccuggacacuguacgccguggcaaccacuauuaucacaccuaugaugaggcauacgauugaaaacaccacugcuaacaucucgcucacagccauagcgaaucaggcugccauccugaugggacuugauaagggcuggcccauuagcaaaauggacaucggugucccauuacuggcacucgggugcuacucccaggugaacccuuugacccugaccgccgcuguccuaaugcugguggcacacuaugccauuaucggcccgggacuccaagcgaaggcuacacgcgaggcccagaaacggacugcagccggcauaaugaagaaucccacgguugaugggauuguggcuaucgaccuugauccaguaguguacgacgccaaguucgaaaaacagcugggacagaucauguugcugauucucuguaccucucaaauccuguuaaugcgaacaacuugggcacuuugcgagucaauaacccuggcuacaggcccucucaccacucuaugggaggguagccccgggaaguuuuggaacacgacaauugccgucuccauggcgaauaucuucagaggaaguuaucuggccggcgcagguuuggcuuuuucucugaugaaaagccucggcgggggaaggcgcggcaccggggcccagggagaaacucuuggcgagaaguggaaacggcagcugaaccaguugucaaaguccgaguucaauaccuacaagagaagugguauuauggagguugaccguagcgaagcaaaagaggggcugaagaggggagagacaacuaaacacgcugugucucggggcaccgccaagcuccgcugguucgucgaacgaaacuuagugaaaccagaggguaagguaaucgaucugggcugugggagaggaggcugguccuauuacugcgccgggcuuaagaaagugacagaaguuaagggauauacgaaaggcgguccugggcaugaggaacccauaccgauggcgaccuacggauggaaucuggugaagcuacacucaggcaaagacgucuuuuucaucccaccugagaagugugauacucuccugugcgacauuggcgagagcucgcccaacccaacaaucgaagaggggaggaccuugcgggugcugaaaauggucgaacccuggcuccgcggaaaucaauuuuguauuaagauccuuaacccuuacaugccgucugugguugagacucuggagcagaugcagagaaagcaugguggcauguuaguaaggaauccccugagucgaaacuccacacacgaaauguauugggugagcugcgggaccggaaauauugucucagcugugaacaugacgucccggauguugcucaaucguuucaccauggcacacagaaaaccaacauacgagcgcgauguugaccugggcgccgguacuaggcauguggcugucgaaccugagguggccaaccuagauaucauagggcagcggauugaaaacaucaagcacgagcauaaaucuaccuggcacuaugacgaggauaaucccuacaagacaugggcauaucauggaagcuacgaaguaaaaccuaguggcuccgccagcucuauggugaacggcguugucaaacuucugacuaagccaugggacgugauccccauggugacccaaauugcuaugacagauaccacuccuuuugggcagcagagagucuucaaagagaagguugacacgcgcacaccaaaagcgaagaggggaaccgcccaaauaauggaagugacugcaaaauggcucugggguuuucugucacgaaauaagaagccccggaucuguaccagagaggaguucacaaggaaaguacgcaguaacgcugccauuggcgcaguguuugucgacgagaaucaguggaacuccgccaaggaggcuguggaagaugagcguuucugggacuugguucaccgggaaagagagcugcacaaacaggggaagugcgccacgugcguguauaauaugaugggaaaaagggaaaagaagcucggcgaguuugguaaagcgaaggggagccgcgcaaucugguacauguggcuuggagcccgauuccuggaguuugaggcuuuaggcuucaugaacgaggaucauugguucucucgggaaaauucgcugucaggcgucgagggggagggauugcacaaacucgguuacauucugagagacaucagcaagauaccgggcgggaacauguaugccgaugacaccgcaggaugggauacuaggaucacagaagacgaucuacagaaugaggcucgcauuaccgacaucauggaaccugagcaugcccuucuggcuaaauccauuuuuaagcucacuuaccaaaacaaagugguaagaguucagcggccagccaagaauggcacagugauggaugucaucaguaggcgugaccagcgagguucuggacaggugggaaccuauggccugaacacauucacuaauauggaagcacaauugauacgccagauggagagcgagggcauauuuucccccucagaauuagagaccccuaaccuggcggaaagagugcucgauuggcuugagaaguacggggucgaacggcugaaaaggauggccaucaguggagacgacuguguugugaagccaaucgaugaccgcuucgcuacggcccuaaccgcacugaacgauauggguaaaguaagaaaggacauuccccagugggagccgucuaaaggcuggaaugauuggcagcaagugccuuuuugcagccaccacuuccaucagcucauaaugaaggacgggcgggagaucgucgugcccuguaggaaccaggaugaauugguuggacgagcucgugugucccagggcgccgguuggucacugagagagacagcaugccuuggaaagagcuaugcccaaauguggcagcugauguacuuucaccgccgggaccucagguuagcggcuaaugccauuuguucugcagucccaguggauuggaucccuacuuccagaaccacauggaguauucaugcccaccaucaguggaugacuaccgaagacaugcugagcguauggaaccgcguuuggaucgaggaaaaucccuggauggaggauaaaacgcacauaucguccuggggagacgugccauauuugggcaagcgggaggaccaauggugcggcucucugaucgggcucacagcuagggccaccugggcaacuaacauucaggucgcuaucaaucaggugcgaagacuuauuggaaacgaaaauuaccuggauuacaugacaucaaugaaacgguucaagaacgagagcgaccccgaaggugcccuaugguga

SEQ ID NO: 14105 - RNA, 9879 nt, Artificial Sequence
  derived and/or modified CDS sequence (opt3) from DENV-1__JQ045665__SS-prME
agcgugaccaugcugcucaugcuuaugcccacagcccuggcuuuccacuugacugcaagaggaggggaaccucauaugaucgucuccaagcaggaaagaggaaaaucuuuacuguuuaagacgucagccgguguuaacaugugcacccugauugcgauggaccucggcgaacugugugaagauacaaugacuuacaaaugcccacggauaaccgaaacagaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguugacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaacuugcugagacccagcacggaacggucuuggugcagauaaaguacgagggcacagacgcgccuugcaaaaucccauucucgacccaagaugaaaagggggcaacucagaacggacgccugauuacagccaaucccaucguuaccgacaaagagaagccugugaacauagaagcugagccacccuuuggcgagucuuauauuguaaucggugccggggaaaaagcacucaagcuguccugguucaagaaaggcucaaguaucggaaagauguuugaggccacugcuagaggcgccaggcggauggcaauucuuggggauaccgcgugggacuucggaagcaucgguggcgucuuuacauccguggggaaacugguucaucagauuuucggaacggcuuacggcguguuguuuucuggugucagcuggaccaugaagauagggaucggcgugcuccugacuugguuaggacuaaauucacgaaguacaucccuaagcaugaccuguauugccguaggccucgugacacuguaccuugggguuaugguccaggcagauucuggaugcgugaucaacuggaaaggccgcgaauugaagugugguucagggaucuucgugacuaaugagguccacaccuggacggaacaauauaaguuucaggccgacaguccgaaaagacugagcgcugccauuggaaaggcaugggaggagggcguuugcgguauaagguccgcuacacggcucgaaaacaucauguggaaacagauuucuaacgagcugaaucauaucuuacuggaaaacgacaugaaguucaccguggugguaggcgaugucgccgggauucuugcgcagggcaaaaagaugauccgcccucaacccauggaguacaaauauucguggaaaagcuggggcaaggccaagauaaucggggcugacgugcagaauacuaccuuuauuaucgauggaccaaacacaccugaaugucccgacgaucagagagcauggaauauuugggagguugaggacuacggcuucgguaucuuuacuaccaacauaugguugaagcucagggauuccuauacacaggugugcgaccaccgucugaugucagccgcuauuaaagauaguaaggccguccacgcagacaugggguacuggaucgaaucugagaaaaaugaaacguggaagcuagcgcgggccagcuucauugaggugaagaccuguaucuggccaaaaucccauacucuguggucaaacggaguucucgaaagcgagaugauaauccccaagauuuauggcgguccuaucucucaacacaauuaccgaccaggcuacuucacacagaccgcugggccguggcaucugggaaaacuugaguuggauuuugaccugugcgaaggcacuacagugguagucaacgagcacugcgggaauagaggacccuccuuaaggaccacgacugugaccggcaagauuauccacgaaugguguugccgcaguuguacacucccuccacugcgguucagaggugaggaugggugcugguauggaauggagauaaggcccgugaaagaaaaggaggaaaaccuugucaagagcaugguuucugccggcuccggugagguggacucauuuagucugggcuugcucuguauuagcaucaugaucgaagagguaaugcgcucgcgacugucccggaaaaugcuaaugaccgggacucuggcaguguucuuucuccugauuaugggacagcuuacauggaaugacuugauccgucugugcauuauggucggcgcuaacgccucugauagaauggggaugggaaccacauacuuagcacucauggccacuuucaagaugaggccuauguuugcugugggccugcuuuuccgccggcugaccagcagagagguucuacuccugacgauagguuugucacugguggcgagugucgaauuaccaaauucccucgaggaacugggggacggacuugccaugggcaucaugauucugaaauugcucacagauuuucaaucucaucagcugugggcaacccuacugagccuuacuuucaucaagaccacauuuucccuccaccaugcuuggaaaacuauggccaugauucugucaaucgugagcuuguucccccuguguuuaaguaccacgucucagaagacaaccuggcucccgguucugcuuggcucccuggggugcaagccuuugacuauguuucucauagccgagaacaaaaucuggggaaggcgaagcuggccacugaacgaagguauuauggcugugggcaucgucucgauucuacugucaucucuucucaagaaugacguaccccuggcagggccuuugaucgccggaggcauguuaauagcguguuaugugauuagugguuccagcgcugaucugucucucgagaaagccgcagagguuagcugggaagaggaagccgagcacuccggggcuucacauaacauccugguggaaguccaggacgauggaacaaugaagaucaaagacgaggagcgcgaugacacccuuacuauucuguugaaggcaacacuacuggccgugaguggcguauacccccucagcauaccagcgacccuguucgugugguauuucuggcagaaaaagaagcagcggucuggcguccuuugggauacgccuucacccccagaaguugagagagcuguguuagacgaugggaucuacaggauuaugcagcguggacugcucggucgcagccaggugggcgucgggguguuucaagaaaauguuuuccacacuauguggcacguaacccggggagccguguugauguaucagggcaaaagacuggagccgaguugggcaagcgucaagaaagaccucaucuccuacggugggggauggaggcugcagggcucuuggaacacaggcgaggaagugcagguuauugccguggagccugggaagaaucccaaaaacguccaaaccgcuccaggaacauuuaagacucccgaaggugaggugggcgccaucgcacuugacuucaagccugggaccucgggaagcccaauaguaaaucgagaaggcaaaaucgucggucuguacgggaacggagugguuacgacaucaggcacuuauguguccgcuauugcccaggcgaaggccagucaggagggccccuugccugagaucgaagaugaggucuuucggaaacgcaaucuaaccauuauggaccugcauccggggucuggaaagacaagaagguaccucccagcaaucgugcgggaagcuauaaaacgaaaguuaagaacccugauucuugcccccacucgcguuguggcuagcgagauggcagaagcccugaaggguaugccuaucagguaucaaaccacagccgucaaauccgagcacacgggcaaggagaucguggaucucaugugccaugcuacuuucaccaugcguuugcugucaccaguacgggugcccaacuacaauaugauuaucauggacgaagcgcacuuuacagauccuucuagcauagcagccagaggguauauuaguaccaggguuggaaugggcgaggcugccgcaaucuucaugacugccacaccgcccgguuccgucgaggcuuuuccacagagcaacgcggugauucaggacgaggaacgcgauaucccugagcgaucuuggaacucaggguacgaguggauaaccgacuuccccggaaaaacggugugguuugucccauccauuaagaguggcaacgauaucgccaauugucucaggaaaaauggcaagcggguaauccagcugagcaggaagacuuucgacacagaauaucagaaaaccaagaacaaugauugggacuacgugguuaccacugacauuucggagaugggggcaaacuuccgcgcugaucgugugaucgacccuagacggugccuuaaacccgucauucuaaaggauggaccagaaagggugauacuggccgguccgaugccuguuacaguggcaucugccgcucagcgccgaggcagaaucgggcggaaucauaacaaagagggagaccaguacauuuauaugggccagcccuugaauaacgaugaggaccacgcccacuggaccgaagcgaagauguuacuggauaauaucaacacaccagaggguaucauucccgcacucuuugaaccugagagggaaaaguccgccgcuauagacggggaguaccgccugagaggcgaggccaggaaauccuucgucgaacuuaugcggcguggagaucugccaguguggcucucauauaagguagcuagugagggcuuucaauacucugaccgccgauggugcuucgauggggaaagaaauaaccagguguuggaggaaaauauggacguugagaucuggacuaaagagggagaaaggaagaaacugcggccccgcuggcuagaugcaagaacguauuccgacccucuggcccucagggaguuuaaggaguucgcugccggucggcgaagcgucucaggcgaccuuauucuggagaucgggaaauuaccgcagcauuugacccagagagcacaaaacgcgcuggauaaucucgugaugcugcacaacagugaacagggaggccgcgccuacaggcaugcuauggaggagcuuccagacacaauugaaacucugaugcucuuggcccugaucgcaguguuaaccgguggggucacacuauuuuuccugagcggccggggacucggcaagaccuccauagggcuucuguguguuauggcuucuagcguguugcuguggauggccuccguagagccccacuggaucgcagccucaauuauccucgaauuuuuccugauggugcuucucauuccugagcccgaucgucagagaacuccacaggacaaucaacuggcuuaugucgugaucggauugcuguuuaugauauuaacgguugcggccaacgagaugggucuacuggaaaccacaaagaaagaucucggcauugggcacguggcagucgagaaccaucaccaugcugccaugcuugacguagaucugcacccugccucugcauggacuuuguacgcuguggccaccacaaucauuacccccaugaugaggcauacuaucgaaaauacaacggcgaacauaagucugaccgcuaucgccaaucaggcagccauucucaugggacuggacaagggcuggccaaucucgaaaauggauauugguguuccucuuuuagcucuggggugcuacagccaggugaacccgcucacuuugacagcagccguccugaugcuaguggcgcacuaugcuaucauaggccccggacugcaagccaaggcaacccgcgaggcccagaaacggaccgcugccggcauuaugaagaauccaacagucgacgggaucguggcaaucgaucucgacccuguuguguacgaugcuaaguucgaaaaacagcuuggacagauuaugcuguugauccuguguacuucccaaauacuccugaugcgaacgaccugggccuuaugcgagucuauuacacuugcgacuggcccccugaccacacucugggaggguucaccagggaaguuuuggaacaccacuaucgccguaagcauggcaaauauuuucagaggauccuaucuagcuggcgccggucuggcauucaguuugaugaaaucucugggcgggggaaggcgcggcacgggggcucagggagaaacacucggcgagaaguggaaacggcagcuuaaccagcugagcaagucagaauuuaauaccuacaagagauccgguaucauggagguggaccguagugaagccaaagagggguugaagaggggagagacuaccaaacacgccgucagccggggcacagcgaagcugcgcugguucguugaacgaaaccucgugaaaccugaggguaaggucauagacuuaggcugugggagaggaggcuggucuuauuacugcgcugggcugaagaaagugacugaaguaaagggauauaccaaaggcggucccgggcaugaggaaccgaucccaauggcaacauacggauggaaucuugugaagcugcacuccggcaaagauguauuuuucauuccucccgagaagugugacacgcuacucugcgauaucggcgagucaagcccaaaccccaccauugaagaggggaggacucugcggguguugaaaauggucgaaccuuggcugcgcggaaaucaauuuuguaucaagauucucaacccguacaugcccucgguggucgagacacuugagcagaugcagagaaggcaugguggcaugcuggugcgaaauccauuaucucggaacaguacccacgaaauguauuggguuuccugcgggacuggaaauaucguaagcgccgugaacaugacaucacguaugcuguugaacagauucaccauggcucaccgcaagccuacguacgagagggacgucgaucucggcgccgguacccggcauguggcaguugaacccgagguggccaaucuggacauaauugggcagagaaucgaaaacaucaaacacgagcauaaguccacauggcacuaugaugaggacaauccuuacaaaacuugggcuuaucauggaucuuacgaagucaagccaagcggcagugcguccagcauggugaacggcguagugaaacuacuuaccaagcccugggauguuauuccuauggucacacaaauagccaugacugacaccacaccauuugggcagcagcgcguguucaaggagaaaguggauaccaggacucccaaggcaaaacgaggaacggcucaaaucauggaagucacagccaaguggcugugggguuuucucucucggaauaaaaagccgagaauuuguaccagggaggaguucacucgcaagguucguucaaacgcagccaucggcgcuguguuuguagacgagaaucaguggaacagugccaaagaggcgguggaagacgagcgguucugggaucugguccacagagaaagggaguugcacaagcaggggaaaugcgcaaccugcguguauaauaugaugggaaagcgcgagaaaaagcugggcgaguuugguaaggccaaagggucccgagcuauuugguacauguggcucggagcccgguuccuugaguucgaagcacugggcuuuaugaacgaggaccauugguucagcagagaaaauucuuuaucgggcguugagggggagggacugcacaaguuggguuacauccucagggauauaucaaaaaucccuggcgggaacauguaugcugacgauacagccggaugggacacgcgcauuaccgaagaugaccugcagaaugaggcuagaaucacugauauuauggaaccagagcaugcccuacuugcaaagagcaucuuuaaacugacauaccaaaacaaggugguccgggugcagaggcccgcgaaaaauggcaccguaauggacguuauaucccgucgagaucagcgcgguagugggcaagugggaacuuauggccucaacacauucaccaacauggaagcccaacugauuagacagauggagucugagggcaucuuuagcccuuccgaauuggagacaccaaauuuagcugaacggguccuggacuggcucgagaaguacgggguggaaaggcuuaagcgcauggccaucucaggagaugacuguguggucaaacccauugacgauagauucgcaacugcucugaccgcccuaaacgacauggguaagguucggaaagauauaccgcagugggagccuaguaagggcuggaaugacuggcagcaagugcccuuuugcucucaccacuuccaucagcugaucaugaaagaugggagggagauuguagugccaugucgaaaccaggacgaacucgucggacgugcaagagugagccagggcgccgguugguccuugcgcgagacggcgugccuggggaagucauaugcucaaauguggcagcuuauguacuuucaccggagggaucugagacucgccgcaaaugccaucuguagcgcuguuccuguggacuggauucccaccacaugcacuaccuggucuauccaugcccaccaucaguggaugacaacugaagauauguuauccgucuggaaccgcguguggauagaggaaaauccauggauggaggacaagacccacaucaguagcuggggagauguacccuaucugggcaaacgggaggaccaaugguguggcucguugauugggcugacggcaagggcuacaugggccaccaacauccagguugcgauuaaucaggugcgaagacucaucggaaacgaaaauuaccuugacuacaugacuuccaugaagcgguucaaaaacgagucugauccugaaggugcucugugguga

SEQ ID NO: 14106 - RNA, 9879 nt, Artificial Sequence
  derived and/or modified CDS sequence (opt3) from DENV-1__JQ045666__SS-prME
agcgugaccaugcugcucaugcuuaugcccacagcccuggcuuuccacuugacugcaagaggaggggaaccucauaugaucgucuccaagcaggaaagaggaaaaucuuuacuguuuaagacgucagccgguguuaacaugugcacccugauugcgauggaccucggcgaacugugugaagauacaaugacuuacaaaugcccacggauaaccgaaacagaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguugacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaacuugcugagacccagcacggaacggucuuggugcagauaaaguacgagggcacagacgcgccuugcaaaaucccauucucgacccaagaugaaaagggggcaacucagaacggacgccugauuacagccaaucccaucguuaccgacaaagagaagccugugaacauagaagcugagccacccuuuggcgagucuuauauuguaaucggugccggggaaaaagcacucaagcuguccugguucaagaaaggcucaaguaucggaaagauguuugaggccacugcuagaggcgccaggcggauggcaauucuuggggauaccgcgugggacuucggaagcaucgguggcgucuuuacauccguggggaaacugguucaucagauuuucggaacggcuuacggcguguuguuuucuggugucagcuggaccaugaagauagggaucggcgugcuccugacuugguuaggacuaaauucacgaaguacaucccuaagcaugaccuguauugccguaggccucgugacacuguaccuugggguuaugguccaggcagauucuggaugcgugaucaacuggaaaggccgcgaauugaagugugguucagggaucuucgugacuaaugagguccacaccuggacggaacaauauaaguuucaggccgacaguccgaaaagacugagcgcugccauuggaaaggcaugggaggagggcguuugcgguauaagguccgcuacacggcucgaaaacaucauguggaaacagauuucuaacgagcugaaucauaucuuacuggaaaacgacaugaaguucaccguggugguaggcgaugucgccgggauucuugcgcagggcaaaaagaugauccgcccucaacccauggaguacaaauauucguggaaaagcuggggcaaggccaagauaaucggggcugacgugcagaauacuaccuuuauuaucgauggaccaaacacaccugaaugucccgacgaucagagagcauggaauauuugggagguugaggacuacggcuucgguaucuuuacuaccaacauaugguugaagcucagggauuccuauacacaggugugcgaccaccgucugaugucagccgcuauuaaagauaguaaggccguccacgcagacaugggguacuggaucgaaucugagaaaaaugaaacguggaagcuagcgcgggccagcuucauugaggugaagaccuguaucuggccaaaaucccauacucuguggucaaacggaguucucgaaagcgagaugauaauccccaagauuuauggcgguccuaucucucaacacaauuaccgaccaggcuacuucacacagaccgcugggccguggcaucugggaaaacuugaguuggauuuugaccugugcgaaggcacuacagugguagucaacgagcacugcgggaauagaggacccuccuuaaggaccacgacugugaccggcaagauuauccacgaaugguguugccgcaguuguacacucccuccacugcgguucagaggugaggaugggugcugguauggaauggagauaaggcccgugaaagaaaaggaggaaaaccuugucaagagcaugguuucugccggcuccggugagguggacucauuuagucugggcuugcucuguauuagcaucaugaucgaagagguaaugcgcucgcgacugucccggaaaaugcuaaugaccgggacucuggcaguguucuuucuccugauuaugggacagcuuacauggaaugacuugauccgucugugcauuauggucggcgcuaacgccucugauagaauggggaugggaaccacauacuuagcacucauggccacuuucaagaugaggccuauguuugcugugggccugcuuuuccgccggcugaccagcagagagguucuacuccugacgauagguuugucacugguggcgagugucgaauuaccaaauucccucgaggaacugggggacggacuugccaugggcaucaugauucugaaauugcucacagauuuucaaucucaucagcugugggcaacccuacugagccuuacuuucaucaagaccacauuuucccuccaccaugcuuggaaaacuauggccaugauucugucaaucgugagcuuguucccccuguguuuaaguaccacgucucagaagacaaccuggcucccgguucugcuuggcucccuggggugcaagccuuugacuauguuucucauagccgagaacaaaaucuggggaaggcgaagcuggccacugaacgaagguauuauggcugugggcaucgucucgauucuacugucaucucuucucaagaaugacguaccccuggcagggccuuugaucgccggaggcauguuaauagcguguuaugugauuagugguuccagcgcugaucugucucucgagaaagccgcagagguuagcugggaagaggaagccgagcacuccggggcuucacauaacauccugguggaaguccaggacgauggaacaaugaagaucaaagacgaggagcgcgaugacacccuuacuauucuguugaaggcaacacuacuggccgugaguggcguauacccccucagcauaccagcgacccuguucgugugguauuucuggcagaaaaagaagcagcggucuggcguccuuugggauacgccuucacccccagaaguugagagagcuguguuagacgaugggaucuacaggauuaugcagcguggacugcucggucgcagccaggugggcgucgggguguuucaagaaaauguuuuccacacuauguggcacguaacccggggagccguguugauguaucagggcaaaagacuggagccgaguugggcaagcgucaagaaagaccucaucuccuacggugggggauggaggcugcagggcucuuggaacacaggcgaggaagugcagguuauugccguggagccugggaagaaucccaaaaacguccaaaccgcuccaggaacauuuaagacucccgaaggugaggugggcgccaucgcacuugacuucaagccugggaccucgggaagcccaauaguaaaucgagaaggcaaaaucgucggucuguacgggaacggagugguuacgacaucaggcacuuauguguccgcuauugcccaggcgaaggccagucaggagggccccuugccugagaucgaagaugaggucuuucggaaacgcaaucuaaccauuauggaccugcauccggggucuggaaagacaagaagguaccucccagcaaucgugcgggaagcuauaaaacgaaaguuaagaacccugauucuugcccccacucgcguuguggcuagcgagauggcagaagcccugaaggguaugccuaucagguaucaaaccacagccgucaaauccgagcacacgggcaaggagaucguggaucucaugugccaugcuacuuucaccaugcguuugcugucaccaguacgggugcccaacuacaauaugauuaucauggacgaagcgcacuuuacagauccuucuagcauagcagccagaggguauauuaguaccaggguuggaaugggcgaggcugccgcaaucuucaugacugccacaccgcccgguuccgucgaggcuuuuccacagagcaacgcggugauucaggacgaggaacgcgauaucccugagcgaucuuggaacucaggguacgaguggauaaccgacuuccccggaaaaacggugugguuugucccauccauuaagaguggcaacgauaucgccaauugucucaggaaaaauggcaagcggguaauccagcugagcaggaagacuuucgacacagaauaucagaaaaccaagaacaaugauugggacuacgugguuaccacugacauuucggagaugggggcaaacuuccgcgcugaucgugugaucgacccuagacggugccuuaaacccgucauucuaaaggauggaccagaaagggugauacuggccgguccgaugccuguuacaguggcaucugccgcucagcgccgaggcagaaucgggcggaaucauaacaaagagggagaccaguacauuuauaugggccagcccuugaauaacgaugaggaccacgcccacuggaccgaagcgaagauguuacuggauaauaucaacacaccagaggguaucauucccgcacucuuugaaccugagagggaaaaguccgccgcuauagacggggaguaccgccugagaggcgaggccaggaaauccuucgucgaacuuaugcggcguggagaucugccaguguggcucucauauaagguagcuagugagggcuuucaauacucugaccgccgauggugcuucgauggggaaagaaauaaccagguguuggaggaaaauauggacguugagaucuggacuaaagagggagaaaggaagaaacugcggccccgcuggcuagaugcaagaacguauuccgacccucuggcccucagggaguuuaaggaguucgcugccggucggcgaagcgucucaggcgaccuuauucuggagaucgggaaauuaccgcagcauuugacccagagagcacaaaacgcgcuggauaaucucgugaugcugcacaacagugaacagggaggccgcgccuacaggcaugcuauggaggagcuuccagacacaauugaaacucugaugcucuuggcccugaucgcaguguuaaccgguggggucacacuauuuuuccugagcggccggggacucggcaagaccuccauagggcuucuguguguuauggcuucuagcguguugcuguggauggccuccguagagccccacuggaucgcagccucaauuauccucgaauuuuuccugauggugcuucucauuccugagcccgaucgucagagaacuccacaggacaaucaacuggcuuaugucgugaucggauugcuguuuaugauauuaacgguugcggccaacgagaugggucuacuggaaaccacaaagaaagaucucggcauugggcacguggcagucgagaaccaucaccaugcugccaugcuugacguagaucugcacccugccucugcauggacuuuguacgcuguggccaccacaaucauuacccccaugaugaggcauacuaucgaaaauacaacggcgaacauaagucugaccgcuaucgccaaucaggcagccauucucaugggacuggacaagggcuggccaaucucgaaaauggauauugguguuccucuuuuagcucuggggugcuacagccaggugaacccgcucacuuugacagcagccguccugaugcuaguggcgcacuaugcuaucauaggccccggacugcaagccaaggcaacccgcgaggcccagaaacggaccgcugccggcauuaugaagaauccaacagucgacgggaucguggcaaucgaucucgacccuguuguguacgaugcuaaguucgaaaaacagcuuggacagauuaugcuguugauccuguguacuucccaaauacuccugaugcgaacgaccugggccuuaugcgagucuauuacacuugcgacuggcccccugaccacacucugggaggguucaccagggaaguuuuggaacaccacuaucgccguaagcauggcaaauauuuucagaggauccuaucuagcuggcgccggucuggcauucaguuugaugaaaucucugggcgggggaaggcgcggcacgggggcucagggagaaacacucggcgagaaguggaaacggcagcuuaaccagcugagcaagucagaauuuaauaccuacaagagauccgguaucauggagguggaccguagugaagccaaagagggguugaagaggggagagacuaccaaacacgccgucagccggggcacagcgaagcugcgcugguucguugaacgaaaccucgugaaaccugaggguaaggucauagacuuaggcugugggagaggaggcuggucuuauuacugcgcugggcugaagaaagugacugaaguaaagggauauaccaaaggcggucccgggcaugaggaaccgaucccaauggcaacauacggauggaaucuugugaagcugcacuccggcaaagauguauuuuucauuccucccgagaagugugacacgcuacucugcgauaucggcgagucaagcccaaaccccaccauugaagaggggaggacucugcggguguugaaaauggucgaaccuuggcugcgcggaaaucaauuuuguaucaagauucucaacccguacaugcccucgguggucgagacacuugagcagaugcagagaaggcaugguggcaugcuggugcgaaauccauuaucucggaacaguacccacgaaauguauuggguuuccugcgggacuggaaauaucguaagcgccgugaacaugacaucacguaugcuguugaacagauucaccauggcucaccgcaagccuacguacgagagggacgucgaucucggcgccgguacccggcauguggcaguugaacccgagguggccaaucuggacauaauugggcagagaaucgaaaacaucaaacacgagcauaaguccacauggcacuaugaugaggacaauccuuacaaaacuugggcuuaucauggaucuuacgaagucaagccaagcggcagugcguccagcauggugaacggcguagugaaacuacuuaccaagcccugggauguuauuccuauggucacacaaauagccaugacugacaccacaccauuugggcagcagcgcguguucaaggagaaaguggauaccaggacucccaaggcaaaacgaggaacggcucaaaucauggaagucacagccaaguggcugugggguuuucucucucggaauaaaaagccgagaauuuguaccagggaggaguucacucgcaagguucguucaaacgcagccaucggcgcuguguuuguagacgagaaucaguggaacagugccaaagaggcgguggaagacgagcgguucugggaucugguccacagagaaagggaguugcacaagcaggggaaaugcgcaaccugcguguauaauaugaugggaaagcgcgagaaaaagcugggcgaguuugguaaggccaaagggucccgagcuauuugguacauguggcucggagcccgguuccuugaguucgaagcacugggcuuuaugaacgaggaccauugguucagcagagaaaauucuuuaucgggcguugagggggagggacugcacaaguuggguuacauccucagggauauaucaaaaaucccuggcgggaacauguaugcugacgauacagccggaugggacacgcgcauuaccgaagaugaccugcagaaugaggcuagaaucacugauauuauggaaccagagcaugcccuacuugcaaagagcaucuuuaaacugacauaccaaaacaaggugguccgggugcagaggcccgcgaaaaauggcaccguaauggacguuauaucccgucgagaucagcgcgguagugggcaagugggaacuuauggccucaacacauucaccaacauggaagcccaacugauuagacagauggagucugagggcaucuuuagcccuuccgaauuggagacaccaaauuuagcugaacggguccuggacuggcucgagaaguacgggguggaaaggcuuaagcgcauggccaucucaggagaugacuguguggucaaacccauugacgauagauucgcaacugcucugaccgcccuaaacgacauggguaagguucggaaagauauaccgcagugggagccuaguaagggcuggaaugacuggcagcaagugcccuuuugcucucaccacuuccaucagcugaucaugaaagaugggagggagauuguagugccaugucgaaaccaggacgaacucgucggacgugcaagagugagccagggcgccgguugguccuugcgcgagacggcgugccuggggaagucauaugcucaaauguggcagcuuauguacuuucaccggagggaucugagacucgccgcaaaugccaucuguagcgcuguuccuguggacuggauucccaccucucgcacaacuugguccauccaugcccaccaucaguggaugaccacagaagauauguuaagugucuggaaccggguguggauagaggaaaauccauggauggaggacaagacucacaucagcucguggggagauguacccuaucugggcaaaagggaggaccaauggugcggcuccuugauugggcugaccgcacgagcuacgugggccacaaacauccagguugcgauuaaucaggugagacggcucaucggaaacgaaaauuaccuugacuacaugaccucuaugaagagguucaaaaacgagucagauccugaaggugcucugugguga

SEQ ID NO: 14107 - RNA, 9879 nt, Artificial Sequence
  derived and/or modified CDS sequence (opt3) from DENV-1__JQ045667__SS-prME
uccgugaccaugcugcucaugcuuaugcccacagcccuggcuuuccacuugacuacgcggggcggggaaccucauaugaucgucuccaagcaggaaagagggaaaucuuuacuguuuaagaccucagccgguguuaacaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacuaacagccgguguccaacccaaggagaggcuacacugguggaagaacaagaugccaauuucgucugccgccgaacuuuuguugacagaggcugggguaacggguguggauuguucggcaaaggcucccucauuaccugcgcaaaguuuaagugcgugacaaaacuggaggggaagaucguacaguacgaaaauuuaaaauauucagugauugucaccgugcacacuggagaucagcaucaaguugguaacgagaguacggaacacggcacaaccgcuacuaucacaccccaagccccuaccaccgagauccagcugacugacuacggggcgcucacacuugacuguagcccaaggacgggacuggauuucaaugaaaugguguugcuaaccaugaagggcaaaucuuggcugguccauaagcagugguuucucgaccugccgcuucccuggacuuccggugccucaacaagccaagagaccuggaaccggcaggaucuguuggugacauucaaaacugcacacgcuaagaagcaggagguaguugugcucgggagucaagaaggcgccaugcacaccgcucugacgggagccaccgagauucagacaucuggcacuaccacaauauuugcagggcauuuaaaaugccgucugaagauggacaaacuaacucucaagggaauguccuaugucauguguaccgguagcuucaaacuggaaaaggagguggccgaaacgcagcacggcacaguccuugugcagaucaaguacgaggggaccgaugcuccuugcaaaauuccauucucgacucaagacgagaagggaguuacacagaauggccgcuugaucaccgcgaaccccauagugacugauaaagaaaagccuguaaauauugaggcagaaccacccuuuggugagucuuauaucgucaucggggccggcgagaaagcucugaagcucuccugguucaagaaaggaucaaguauuggcaagauguuugaagccaccgcaagaggggccaggcggauggcuauccugggagacacagccugggauuucgguagcauuggcgggguguuuacguccguuggaaaacuugugcaucagauauucggcaccgcauacgguguccuguuuucuggggugagcuggacuaugaagaucggcauuggaguauugcucacauggcugggcuuaaacucacgaaguaccucccugagcaugacauguaucgcgguggggcuaguuacucucuaccugggagucauggugcaggcugacucuggcugcgugaucaauuggaaaggucgcgagcuuaagugugggucaggaauuuucgucaccaacgaaguucacacguggacagagcaauauaaguuucaggccgauaguccgaaaagauugagcgcagccauaggcaaggcuugggaagagggugugugcggcaucagguccgccacccggcuggagaacauuauguggaaacagaucucuaaugaacucaaccauauucuguuagagaaugacaugaaguucacugugguagucggggacguggcaggaauccuggcucagggcaaaaagaugauacgcccucaacccauggaauacaaauauucguggaaaagcugggggaaggccaagaucauuggagcggauguucagaacaccacauuuaucauugacggcccaaauacuccugagugucccgaugaccagagagccuggaacaucugggaaguggaggauuacgguuucgggauauuuaccacaaauauuuggcuuaaguugagggacuccuauacgcaggucugcgaucaccgucucaugucagcugcaaucaaagacaguaaggccgugcacgcugauaugggauacuggauugagucugagaaaaaugagaccuggaagcuggcccgggcaucguucaucgaaguuaagacuuguauauggccaaaaucccauacacuauggucaaauggcgugcuggagagcgaaaugaucauucccaagaucuaugguggcccuauuucucaacacaacuaccgaccaggguacuucacccagacugcgggaccguggcaucucggcaaacuggagcuugacuuugauuugugcgaggggacaaccguagucguggacgaacacugcggaaauagaggccccucccugaggacgacuaccgugacagguaagaucauacacgagugguguugccgcaguuguaccuuaccuccacuccgguucagaggggaagauggaugcugguauggcauggagauuaggcccgucaaagagaaggaagagaaccugguuaagagcauggugucugccgguuccggcgaaguagacucauuuagucuugggcuguuguguaucagcaucaugauugaggaagugaugcgcucgcgauggucccggaaaaugcucaugacuggaacacuggcugucuucuuucuacugaucaugggccagcucaccuggaaugaccugauucgucuuugcauaauggugggggccaacgcaucugauagaaugggaaugggcacaacuuacuuggcucugauggccaccuucaagaugaggccuauguuugcaguugguuuacucuuccgccggcugacgagcagagaggugcuucugcuaacaaucgggcucucacuggucgccaguguggaguugccaaauucccuggaagaguuaggagacggccucgcuaugggcauuaugauccugaaacuucugaccgauuuucaaucuuaucaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucgggucccugggaugcaagccucuuacaauguuucugauagcugaaaacaaaaucugggguaggcgaagcuggccauugaacgagggcauuauggccguagggaucgugucgauucuccugucaucucuacugaagaaugacguuccccuugccggaccucucaucgcuggcgguaugcugauggcauguuaugugauaaguggguccagcgccgauuugucuuuagaaaaagcggcugaggucagcugggaggaagaggccgaacacuccggagcaucacauaacauucugguggagguacagggcgacggcaccaugaagaucaaagaugaagaacgcgacgauacucucacaauccugcuuaaggccacccuguuggcugugaguggggucuacccccuaagcauuccagcaacgcuguucguuugguauuucuggcagaaaaagaagcagcggucuggagugcucugggacacuccuucacccccagagguggguagagccguccuggaugacggcauauacaggaucaugcagcgugggcuuuuaggacgcagccaggugggcguugguguauuucaagaaaauguguuccacaccauguggcaugucacaagaggggcggugcugauguaccagggaaaaagacucgagccgaguugggcuagcguuaagaaagauuugauuuccuauggcggcggguggaggcugcagggaucuuggaacaccggugaagaggugcaggucaucgccguggagccuggcaagaaucccaaaaacguacaaacagcaccagggacuuuuaagacccccgaaggagaggucggcgccauugcucucgacuucaagccugguacgucggggagcccaaucgugaaucgagaaggaaaaauaguuggccuguacggcaacgggguggucacaacuucaggaaccuauguguccgccaucgcacaggcuaaggccagucaggaggguccccuuccugaaauugaggacgagguuuuucggaaacgcaaucugacaaucauggauuugcacccgggcucugggaagaccagaagguaccuaccagcgauugugcgggaagccaucaaacgaaagcugagaacucucauauuagcacccacccgcgucguggcuagcgagauggccgaagcucugaagggaaugccuauuagguaucaaacaacggcaguaaaauccgagcacacuggcaaggaaaucguggaccuuaugugccaugccaccuucacaaugcgucugcucucaccaguucggguccccaacuacaauaugaucauuauggaugaggcccacuuuaccgacccuucuagcaucgcugcgagagguuauauaaguacuaggguggggaugggagaggcagccgcuauuuucaugacagccaccccgcccggcuccguggaagcauuuccacagagcaacgccgucauccaggaugaggaacgcgacauuccugagcgaucuuggaacucaggcuacgaauggaucacggauuuccccgggaaaacuguaugguuugugccauccauaaagaguggaaacgacauugcuaauuguuugaggaaaaacgguaagcggguuauccagcugagcaggaagacauucgauaccgaguaccagaaaaccaagaacaaugacugggauuauguggucacuacagacaucucggagaugggcgcgaacuuccgcgccgaccgugugauugauccuagacggugccucaaacccguuauccugaaggacgggccagaaagggugauucuugcaggaccgaugccugucaccguggcuucugccgcacagcgccgaggcagaauaggucggaaucauaacaaagagggggaucaguacaucuauaugggccagccccuaaauaacgacgaagaucacgcccauuggacagaggcuaagaugcuguuggacaauauuaacacuccagagggaaucauccccgccuuauuugaaccugagagggaaaaguccgcggcaauugauggcgaguaccgccugagaggggaagccaggaaaacguucguagagcucaugcggcguggagaccugccaguguggcuuagcuauaagguugcuucagaggguuuucaauacagugaucgccgauggugcuucgacggcgaaagaaauaaccagguccuggaggaaaauauggauguggagauauggaccaaagaaggggagaggaagaaacuccggccccgcugguuggacgccagaacauauucugauccucuggcucuaagggaguuuaaggaguucgcagccggacggcgauccgugagcggcgaccugauccucgagauugguaaacuuccgcagcaccugacucagagagcucaaaacgccuuagacaauuuggucaugcugcacaacucagaacaagggggccgcgcauacaggcaugcgauggaggaacucccagauaccaucgagacacugaugcuucuggcccucauugcuguuuugaccggaggcgugacucuguuuuucuuaagugggcggggacuagguaagacgagcaucggccugcucuguguaauggccuccucugugcuucuguggauggcaagcgucgagccccacuggauagcugccuccaucauuuuggaauuuuuccugauggugcuccugaucccugagcccgaccgucagagaaccccacaggauaaucaacuugcauacguugugauugggcuccuguuuaugaucuugacagucgccgcuaacgaaaugggacuguuagagacuaccaagaaagaccuaggcauaggucauguagcgguggagaaccaccaccaugccgcaaugcuggauguugaccuccacccugcuucagccuggacacuuuaugccguggcaaccacuauuaucacacccaugaugaggcauacgauugaaaauaccacugcuaacaucucucugacagccauagcgaaucaggcugccaucuugauggggcuggauaagggcuggccaauuaguaaaauggacaucggagucccucuccuggcacuuggcugcuacagccaggugaacccguuaacccugaccgccgcuguccucauguugguggcacacuaugccauuaucgggcccggacugcaagcgaaggcuacacgcgaggcccagaaacggacugcagccggcauaaugaagaauccaacgguugaugguauuguggcuaucgaccuagauccuguaguguacgacgccaaguucgaaaaacagcuggggcagaucaugcuccuuauucuguguaccagccaaaucuugcugaugcgaacaacuugggcacucugcgaguccauaacccuggcuacaggacccuuaaccacucuuugggaaggcucuccagguaaguuuuggaacacgacaauugccgucucaauggcgaauaucuucagaggcagcuaucuggccggggcaggacucgcuuucucccuaaugaaaagucugggcgggggaaggcgcggcaccggugcccagggggagacuuugggagagaaguggaaacggcagcugaaccagcucucuaagagcgaauuuaauauuuacaagagaucaggcaucauggagguugaucguuccgaagcaaaagagggucuuaagaggggcgaaaccacaaaacaugcugugagucgggggacugccaagcugcgcugguucgucgagcgaaacuuggugaaaccugagggaaagguaauagaccugggcugugggagaggaggcuggagcuauuacugcgccggucucaagaaagugaccgaaguuaagggguacacaaaaggaggccccggccacgaggaaccgaucccaauggcgacguauggguggaauuuagugaagcugcacucuggaaaagacgucuuuuucauuccucccgagaagugugauacccuucugugcgacaucggugaauccucaccaaaccccacuauugaggagggcaggacacuacgggugcucaaaauggucgaaccuuggcugcgcgggaaucaauuuuguaucaagauuuugaacccguacaugcccagcgugguugagacccuggaacagaugcagagaaagcauggaggcaugcucguaaggaauccacuuucgcgaaacucuacucacgagauguauugggugaguugcgguacagggaauaucgucuccgcugugaacaugaccagccggaugcuguuaaaccguuucacgauggcacauagaaaaccuaccuacgagcgcgauguugaccugggagccggcacaaggcacguggcugucgaacccgagguggccaauuuggauauaauuggccagcggaucgaaaacaucaagcacgagcauaaaucaacuuggcacuaugacgaagauaauccuuacaagaccugggcauaucauggguccuacgagguaaaaccaucuggaagcgccaguuccauggugaacgguguugucaagcuccugacaaagcccugggacgugauuccuauggugacucaaauagcuaugaccgauacaaccccauuuggccagcagagagucuucaaagagaagguugacacucgcacgcccaaagcgaagagggggacaauccaaauuauggaagugaccgccaaauggcuauggggauuucuuagccgaaauaagaagccgcggaucuguacuagagaggaguucaccaggaaaguacgcucuaacgcagcuauuggcgccguguuugucgaugagaaucaguggaacucagcaaaggaagccguggaggacgagcguuucugggaccugguucaccgggaaagagagcuccauaaacaggguaagugcgcuacaugcguguacaauaugauggggaaaagggaaaagaagcugggagaguuuggcaaagccaagggcagucgcgcgaucugguauaugugguugggggcacgauuccuggaguucgaggcccucggauuuaugaacgaggaucacugguucucccgggaaaauagccuuucuggugucgagggcgaagggcugcacaaauuaggauacauacugagagacaucucgaagauuccuggcgguaacauguaugcugaugacacggccgggugggauaccaggaucacugaggacgauuugcagaaugaggcacgcauuacagacaucauggaaccagagcaugcucuccuggccaaaucaauauuuaagcuaaccuaccaaaacaaagugguaagaguucagcggcccgcuaagaauggaacugugauggaugucauuagcaggcgugaccagcgaggcuccggccagguggggacauauggacuuaacaccuucacaaacauggaagcccaacugauccgccagauggagagugaagguaucuuuucuccuagcgagcucgagacuccaaaucuggcagaaagaguguuggauugguuagagaaguacggcgucgaacggcugaaaaggauggcgauuuccggggacgauuguguugugaagcccauagacgaccgcuucgccaccgcucucacggcccuuaacgauaugggaaaaguaagaaaggacaucccgcagugggagccuucaaaaggcuggaaugauuggcagcaagugcccuuuugcagucaccauuuccaccagcugauuaugaaggacggucgggaaaucgucgugccauguaggaaccaggaugagcuaguugggcgagcacgugugucucagggagcuggcuggagccugagagagaccgccugccucggcaaguccuaugcacaaauguggcaguugauguacuuucaccgccgggaccugaggcuugccgcgaaugcuauuuguucagccgucccuguggauuggauccccacaagcagaacuaccuggucuauacaugcacaccaucaguggaugacaacugaagacaugcuguccguauggaaccgcguuuggaucgaggaaaauccauggauggaggauaaaacccacauuaguagcuggggagacgugcccuaccucggaaagcgggaagaucaauggugcgguucguuaaucggccugacggccagggcuacaugggccaccaacauucaggucgcaaucaaucaggugcgaagauugauugggaacgagaauuaucuggacuacaugacuuccaugaaacgguucaagaacgagucugacccugaaggagcucucugguga

SEQ ID NO: 14108 - RNA, 9879 nt, Artificial Sequence
  derived and/or modified CDS sequence (opt3) from DENV-1__KU094071__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacaaaggcggagccggacgauguggacuguuggugcaaugcuaccgauacuuggguaacauaugggaccuguagucaaacgggagaacaccgccgagacaaacguagcguggcccuggcaccccaugucggcuugggucucgagacuagagccgagaccuggauguccucugaaggggcuuggaagcagauccagaagguggagacaugggcacugaggcacccuggauucacuguuauugcccuguuucucgcucaugccaucggcaccucgauuacacagaaaggcaucauauucaucuuacugaugcuugugaccccaucaauggcgaugcggugcgucgggauuggaaaccgcgauuuuguggaagguuugagcggcgggacguggguagacguugugcuggagcacggaaguugugucacuacaauggcaaaggauaaacccacccuagacaucgagcuccugaagacugaagugacaaauccugccgugcuuagaaaacugugcauugaggcuaagaucuccaacaccacgaccgauucuagguguccaacacaaggcgaagccacuuuggucgaggaacaggacgcaaauuucguuugccggcgcaccuuuguggaucgagguugggggaacggauguggccucuucggcaaggggagccugauaacaugcgcuaaauuuaagugcguaacuaaauuagagggaaagauugugcaguacgagaaucugaaauauuccgucaucgugaccguucacacaggugaccagcaucaagugggcaacgaaaccacugagcacgggacgauugccacaaucaccccccaggcgccuacuucagaaauccagcucaccgacuacggagcccuuacacuggauuguaguccaagaaccggcuuggacuucaaugagaugguccuacugacuaugaagaggaaaagcuggcucgugcauaagcagugguuucuggaucuuccgcugcccuggacaucuggugcauccacgccucaagaaaccuggaaccgggaggacuugcucguaacuuucaagacagcucacgccaaaaagcaggagguugugguccuggggucacaggaaggcgcuaugcacaccgccuuaacaggagcaacugagauucaaaccagcggcacgaccaaaauauuugccgggcaucugaagugccgucuaaaaauggauaagcucacacugaagggaaugaguuaugugauguguacugguucuuucaaacuugaaaaggaggucgcugaaacccagcacggcacaguguugguucaggugaaauacgaggggacugacgcgccaugcaagauccccuucuccacccaggaugagaaaggaguaacgcaaaauggccgccugauuacagcaaacccuaucgucaccgacaaggaaaagccagugaauauagaggccgaacccccguuuggugagagcuauauuguugugggggcuggcgagaaagcccucaagcugucgugguucaaaaagggaucuuccaucggcaaaaugcuugaagcaacugccagaggggcuaggcggauggccauccugggagauacagcaugggacuuugguucaauuggcggggucuucaccagugugggaaaguugguacaucagaucuuuggcacugcguacggugugcucuucagcgggguuuccuggaccaugaagauuggcauaggaauccuguuaacauggcugggccuaaacucucgaagcgcuucacucaguaugacguguauugccgucgggauggugacccuguaccuuggagugaugguccaggcagauuccggcugcguuaucaauuggaaaggucgcgaguugaagugugggagcggaaucuuugugacuaacgaagugcacacauggaccgagcaguauaaauucagagccgacucuccuaagaggcugucagcugccauuggcaaagcaugggaagaggguguaugcggcauacggagugcuacacgccucgagaacaucauguggaagcaaauuagcaaugaacugaaccauaucuuacuggagaaugacaugaaauuuacugucgugguuggggauguguccggaauucuuacccagggcagaaagaugaucgggccccagccaauggaacacaaguacucuuggaaaucguggggaaaggccaaaauaaucggcgcggacguccagaacacgacauucauuaucgaugguccuaauacccccgaguguccagacgaucaaagggccuggaacauuugggaaguggaggacuauggguuuggaaucuucacuaccaauauaugguugaagcuccgugauagcuacacacagguuugcgacccccggcugauguccgcugcaauuaaagauucaaaggccgugcacgcugacaugggcuauuggaucgagagugaaaagaacgagacuuggcgacuagccagagcaucuuuuauugaaguaaaaaccugugucuggccuaagagccauacacugugguccaauggugugcucgagucagaaaugaucauaccaaaaaucuacggcgggccgauuagccagcacaacuauaggcccggauacucuacgcagaccgcgggcccuuggcaucuggggaagcuugaguuggauuucgaccugugcgagggaacuacaguggucguugaugaacacugcggcaaucgcgguccauccuuacggaccacuacagugaccgggaaaaucauucacgagugguguugcagaaguuguacgcuccccccucugagguucaagggagaagacggcugcugguacgguauggagauccgcccaguaaaggacaaagaggaaaaccuugugaagagccuggucucugccggcuccggggagguggauucauuuaguuugggacuccuguguguuagcauaaugauugaagaggugaugcgaucgcgguggucccguaaaaugcuaaugacuggcacccuggcugucuuccuccugcuuaucauggggcaauugacauggaaugaccugaucagauuaugcauuauggugggagccaacgcaucugauaggaugggcauggguaccacuuaucucgcucugaucgccacauuuaagaugcgccccauguucgcaguugggcuucuguuucggagacuaaccagcagggaagugcuccuguugacaauuggacugucauuagucgccaguguagagcucccgaauucccuggaggaacuuggcgacggccuggcuauggggauaaugaucuugaaacuccugacugauuuccagucucaucagcuaugggcggcccugcuuagccucaccuuuauuaagacgacauucucccugcacuacgcauggaagaccauggcuaugguguugucaacuguuagccuguuuccuuuaugucucaguaccacaucucgaaaaacuaccuggcugccagugcuucugggauccuuggguugcaagccccucacgauguuccugaucgccgagaacaaaauuuggggccgcaagagcuggccucuaaacgaagggaucauggccgucggaauagugucgauccugcuuucaucucuccugaaaaaugacguacccuuggcuggcccauuaauugcaggugggaugcugaucgccuguuaugugauuaguggauccagcgcggaucucucucuggagaaggcugccgaagucagcugggaggaggaagcagagcauuccggcgccucacacaacauccuuguugaagugcaagacgauggcacaaugaaaauaaaggacgaggaacgggaugacacccugacuauuuugcuaaaggcuacacugcucgcagugaguggggucuacccuaucagcauccccgccacccuguuugugugguauuucagacagaaaaagaaacagaggucuggaguucuuugggauacuccauccccgccugagguagagcgugcgguguuagacgacgguauuuaccgcauacugcagcggggccucuuggggagaucacaagucggagugggcguuuuucaggaagguguguuccauacaauguggcacgucaccaggggggcugugcugauguaucagggaaagcgacucgagcccaguugggccagcguaaaaaaggaucugaucuccuacggcggcggguggcgguuccagggaucuuggaauacgggugaagagguccaagugauugcaguugagccaggcaagaaccccaaaaaugugcagacugccccugggaccuuuaagacaccagaaggagaggucggcgugaucgcucuugacuucaaacccgguaccucggggagcccuauuguuaaccgcgaaggaaagaucgugggccuguacggcaauggggucgugacaacuucaggaaccuauguauccgccauagcacaggcuaaagccagucaggaggguccguugccagaaaucgaggaugagguguuuagaaagaggaaccuaacgauuauggaccugcaccccggcucugggaagacacggcgauaccucccugcgaucguuagagaagccauuaaacgcaaguuaaggacucugauccuugcaccaacccgugucguggcuagcgagauggccgaagcucugaaaggaaugcccauacgguaucaaacaaccgcagugaaguccgagcauacuggcagagaaauugucgaucucaugugccacgccaccuucacaaugagguugcugucaccuguacgcgugccgaauuacaacaugaucaucauggacgaggcccauuuuacggaucccgcuucuauugcggcacgagguuauaucagcacuagaguugggaugggagaggccgcugccauauucaugaccgcaacaccaccuggcaguguggaagccuuuccccaguccaaugcugucauucaggacgaggaacgggauaucccagagaggagcuggaacucuggcuacgacuggauuaccgauuucccugggaaaacugugugguuuguucccucaaucaaguccggaaaugacauagcgaacugucuccgcaagaaugguaaacgugugauucaacugaguagaaagacauucgacaccgaauaucagaaaacgaagaacaacgauugggacuacgucgugacuacagauaucagcgagaugggcgccaauuuucgggcagacaggguaaucgauccacgccgaugcucgaaaccggugauucuuaaggacgggccugagagaguuauccuagcuggacccaugccagucaccguggccucugcagcccagcggaggggccgcauugguagaaaccagaauaaggaaggggaucaauacauauauaugggccagccccugaacaaugacgaggaucacgcucauuggaccgaagccaaaauguuguuagacaacaucaauacuccugagggaauuaucccagcgcuguucgagcccgaaaggggcaaguccgcagccaucgauggggaguaccggcuccguggagaagcucgcaaaacauucguggagcugaugcgaagaggugaccuuccugucuggcugagcuauaagguugccucagaaggcuuucaguacagugauaggaaauggugcuucgacggggagcggaacaaucaggugcucgaggaaaacauggacguagagauuuggaccaaggaaggagagcgcaaaaaguugagaccgagguggcuggaugcucggacauauucugacccacaagcacuacgagaauuuaaggaguucgccgcuggcagacgcuccgugagcggugaucugauacucgagaucgggaaacuuccccagcaccugacucagagggcccagaaugcauuagacaacuuggucaugcugcacaauucagaacaaggcggaaaggcguaccggcaugccauggaggaacucccugauacgauugagacccugaugcuucuggcucucaucgccguguugacaggcgggguuacucuguuuuucuuaaguggacguggucuaggcaaaaccagcauugggcugcucugugugauggcauccucuguccuucuguggguagcuagcguggaaccccacuggaucgccgcauccauaaucuuggaguuuuuccugaugguucuccugauuccagagccugacagacagaggacaccccaggauaaccagcuugccuauguggucaucggacuccuguuuaugauuuugaccguggcugcgaaugaaaugggccuguuagagacuacgaagaaagaccuagguaucgggcaugucgccguggaaaaccaccaccaugcaaccaugcuggauguugaccuccgcccagcuucagccuggacacuuuacgccguggcaacuaccauaauuacaccuaugaugcggcacaccaucgagaacacuacagcuaauauuucucugacggccaucgcgaaccaagcugccauauugaugggccuggauaagggauggccgaucaguaagauggacauuggcguaccccuccuggcacuugggugcuacucgcaggugaauccaccuaccuuaaucgccgcuguccugaugcucguugcacauuaugccauuaucggacccggcuugcaggcgaaagcuacucgagaggcccaaaagagaacagcagccgguauaaugaaaaacccaaccguggaugggauugucgcuaucgaccuggacccugugguauacgaugccaaguucgaaaaacagcuaggacagaucaugcugcucauucuuuguaccagccagauccuguccaugaggacaacuugggcauugugcgagucuauaacgcuggcuaccggcccccucacaacucugugggaagguucaccgggcaaguuuuggaauaccacaauugccgugagcauggcgaacaucuuccgcggguccuauuuagccggagcaggccuugcuuuuccacugaugaagagucucgggggaggccggagagguaccggggcccaaggagagacucuaggcgaaaaauggaagcgucagcugaaucaguugucuaaaagcgaguucaacacguacaagaggucagguauuauggagguugaccgguccgaagcaaaagagggccugaagcgcggggaaacaaccaagcacgcugugagucgaggaacugccaaacucagaugguucgucgagaggaaucuugugaagccugaaggcaaagucaucgaucugggguguggacggggcgguuggagcuauuacugcgccggguugaagaaagugaccgagguuaagggauauacaaaaggcggccccgggcaugaggaaccaauacccauggcgacuuacggauggaaccugguaaagcuccacucugguaaggacguguuuuucaccccuccggagaaaugugauacauuacugugcgacaucggcgaauccucacccaauccaacgauugaggaagggcgcacccuuagaguccugaagaugguggagccuuggcuaaggggaaaccaguuuuguaucaaaauucucaaucccuacaugccuagcguuguggagacucuggaacaaaugcagcgaaagcacggcgguauguugguccggaacccacugucgcguaauucuacacaugagauguauugggugaguugcgggaccggaaacaucguauccgcugugaauaugacuagcagaaugcuccuuaaccgcuucacaauggcacacaggaaacccaccuacgaacgggauguugaccugggcgccggcacgagacaugucgcuguggagccugagguggccaacuuagauauuaucgggcagcgcauagaaaauauuaagaacgagcacaagucaaccuggcacuaugacgaagauaauccauacaaaacaugggcauaucauggauccuacgaggucaagcccucugguagcgccaguuccaugguuaacggcgugguaaggcuguugacuaaaccgugggacgugaucccuauggucacccagaucgcuaugacagacacuaccccauuugggcaacagcgaguguucaaggaaaaaguugauacacggacccccaaggcgaagagaggaacugcccagauuauggaggugacggcaagguggcucuggggcuuucugagccgcaauaaaaagccucguauauguacacgggaggaauucaccagaaaagucaggucuaacgcugccaucggugcaguguuuguagacgagaaucaauggaacucagccaaggaagcuguugaggaugaacgcuucugggaccuagugcaccgagagcgggagcuucauaaacaggggaagugcgccacuugcgucuauaauaugaugggaaagagagaaaaaaagcugggcgaguuuggcaaagcgaaggggaguagggcaauuugguacauguggcucggagcccgcuuccuggaauuugaggcuuuggguuucaugaacgaagaucacugguucuccagagagaauagccugucuggcguggagggggaaggacuccauaaacuuggcuacauccugcgggacauuucgaagaucccaggugggaacauguaugccgaugacaccgcaggaugggauacaaggauaacggaggacgauuuacagaaugaagcuaaaaucaccgacauuauggagcccgagcacgcccuguuggcuacuucaaucuuuaagcucacauaccagaacaaggugguccguguucaacgaccggccaaaaauggcaccgugauggauguaauuagccgcagagaccagcggggcuccgggcaggugggaacuuauggucugaacacauucaccaacauggaaguccagcuaaucaggcaaauggagagugaaggcauauuuucuccuagcgagcuugaaacacccaaucuggcagagcgcgugcucgacuggcuggagaagcacgggguugaaagauugaaacggauggcgauuuccggagaugacuguguggucaagccaacugaugacagguucgccaccgcuuuaacggcccugaacgauaugggcaaagugcgaaaggacaucccucagugggagcccucaaaggguuggaaugauuggcagcagguaccauuuugcagucaucacuuccaucaacucaucaugaaagacgggcgugaaauuguugugcccuguagaaaccaggaugagcuugucggacgcgcacgggugucucagggcgcuggcuggagccugagggaaaccgccugccuagggaaguccuacgcacagauguggcaacugauguauuuucacagacgcgaccuccgguuggccgcgaaugcuauauguucagccguuccuaucgauugggugccaacaagcaggacuaccuggucuauucacgcacaucaccaguggaugacaacugaggacaugcuguccgucuggaaccgaguguggaucgaggaaaauccguggauggaggacaaaacccauguaaguagcugggaagaugugcccuaccuuggaaagagagaggaccaguggugcgguucgcugauuggccucacggcccgggcuacaugggccaccaacauccaagucgcaauaaaucagguuaggcgcuuaaucgggaacgaaaauuaucuggauuacaugacuuccaugaaacguuucaaggacgagucugauuuggagggagcucugugguga

SEQ ID NO: 14109 - RNA, 9879 nt, Artificial Sequence
  derived and/or modified CDS sequence (opt3) from DENV-1__HQ624983__SS-prME
agcgugaccaugcugcucaugcuuguccccaccgcacuggcuuuccacuugacuacgagaggaggggaaccucauaugaucguuuccaagcaggaaaggggaaaaucuuuacuguuuaagaccucagccggugugaacaugugcacacugauugccauggaccucggcgaguucugugaagauacuaugaccuacaaaugcccacggauaagugaagcggaaccggacgauguagacuguuggugcaaugcuacagauaccugggugacuuaugggacauguagccaaaccggagagcaccgccgagacaagcguuccgucgcccuggcaccccaugugggccuuggucuggagacgagaacugaaaccuggaugucuucggagggggccuggaaacagauccagaggguugaaacaugggcuuugcggcacccuggauuuacugugauugcacucuuccuggcccaugcuaucggcaccucaauuacacagaagggcaucauauuuauccugcucauguuagucaccccaagcauggccaugcgcugcguggggauuggaaguagagauuucguugagggucuguccggcgcgacguggguugacgugguccuugagcacgggucuugugugacuacaauggcaaaggauaaacccaccuuggacaucgaacugcuaaagacugaggugacaaacccugccguccucaggaaacugugcauugaagcuaagaucagcaauaccacgaccgauucccgguguccaacacaaggagaggccacucuuguugaagaacaagacgcaaacuuugugugccgccgaaccuucguagauagaggcugggguaauggguguggacuguuuggcaaaggcucauugauaacaugcgcuaaguucaagugcgugacuaaacucgaggggaagauuguccaguacgaaaaccugaaauauagugugaucguuaccgugcacacaggagaccagcaucaagucgguaaugagagcaccgaacacggcacuacggccacaauuacaccccaggcgccuucuacugagauccaguuaaccgacuacggggcccugacacucgauuguuccccaaggaccggacuugacuuuaacgaaauggugcuguugacuaugaaggagaaaucauggcuaguacauaagcagugguuccuggaucucccgcugcccuggacaagcggcgcaaguacgucucaagagaccuggaaucggcaggaccuucugguuacuuuuaaaacagcucacgccaagaagcaggaaguggucguguuggguucccaagagggggcuaugcacaccgcccucacaggcgcaacugaaauccagaccagcggaacgaccacaauuuucgccggccaucugaaaugccguuuaaagauggauaaacugacucuaaaggggaugucguaugucauguguaccggaucuuucaaacucgagaaggaaguggcugagacacagcacgguacuguucuggugcagauaaaguacgagggcaccgacgcgccuugcaaaaucccauuuuccacgcaagaugaaaaggggguaacacagaacggacgccuuauuaccgcaaaucccaucgucacugacaaagagaagccugugaacauagaagccgagccacccuucggcgagucauauauuguuaucggugcuggggaaaaagccuugaagcugaguugguuuaagaaaggcagcuccaucggaaagauguucgaggcaacagccagaggcgcuaggcggauggccauucucggggauaccgcaugggacuuuggaucuaucgguggcguguucacuagcgucgggaaacuggugcaucagauuuuuggaaccgcguacggcguacuuuucucaggugugaguuggacaaugaagauagggaucggcguucuguugacguggcucggacuaaauucccgaagcaccucuuuaucaaugacuuguauugcugucggccuggugacacuauaccucggggugaugguccaggccgauaguggaugcguuaucaacuggaaaggccgcgaacugaagugugguagcgggaucuuugugaccaaugaggugcacacauggacugaacaauauaaguuccaggcagacuccccgaaaagacuuucugccgcuauuggaaaggccugggaggagggcguaugcgguauaaggucggcaacccgguuggaaaacaucauguggaaacagauuagcaacgagcugaaucauauccuccuggaaaacgacaugaaguuuacggucgugguuggcgauguggcugggauuuuagcccagggcaagaagaugauccgcccucaacccauggaguacaaauauuccuggaagucauggggcaaggcgaaaauaaucggggccgacguccagaauacaaccuucauuaucgauggaccaaacacuccugaaugucccgacgaucagagagcuuggaauauuugggagguggaggacuacggcuuugguaucuucaccacaaacauauggcugaaacuuagggauaguuauacucagguuugcgaccaccguuugaugucugcagccauuaaagauagcaaggcugugcacgccgacaugggguacuggaucgaauccgagaaaaaugaaaccuggaagcucgcacgggcgucauucauugagguaaagacauguaucuggccaaaaagccauacgcuguggucuaacggaguccuagaauccgagaugauaauccccaagauuuauggcgguccuaucagucaacacaauuaccgaccaggcuacuuuacccagacugccgggccguggcaucugggaaaacucgagcuggauuucgaccuuugcgaaggcacaaccgugguggucgaugagcacugcgggaacagaggacccagcuugaggacuacaaccguuacgggcaagauuauccacgaaugguguugccgcucuuguacucugccuccauuacgguuuaaaggugaggacgggugcugguauggaauggagauaagacccgugaaggaaaaggaggaaaaucucguaaaauccauggugucagcuggcaguggugaggucgacagcuucucgcugggccuucuguguauuuccaucaugaucgaagaggugaugaggucucgcuggagccgaaagauguugaugaccgggacacucgccguauuuuuccugcuaauuaugggacagcugaccuggaacgaucucauccggcugugcauuauggugggcgcaaaugcuucagaccguauggggaugggaaugacuuaccuugccuugauggcaacauuuaaaaugagaccuauguucgccgucggccuguuauuuaggcgccucaccagucgggaggugcugcuucugacaauaggucuaucccucguugcuucuguggaacugccaaacagcuuggaggaacugggggauggauuagcgaugggcaucaugauucucaagcugcuuacugacuuccaaucccaucagcugugggccaccuugcucucacugacguuuaucaaaacaaccuucagccuacacuaugcauggaagacuauggcuaugguccugaguauuguaucucuuuuuccccucugucuguccaccacaagccagaagacuaccugguugccggugcuguuaggcucgcucgggugcaaaccucugacgauguuccuuaucgccgagaauaagauauggggaagaaaaucauggccacugaacgaagguaucauggccguuggcauugugucuaucuugcucaguucccugcuaaagaacgaugucccccuggcugggccucuuauugcaggaggcaugcucaucgccuguuacgugauaagcgguucuagcgcggaccuguccuuggagaaagcugccgagguaucaugggaagaggaagcagagcauaguggggccagccacaauauuuuaguggaaguccaggaugacggaacaaugaagaucaaagaugaggagagggacgauacccugacuauccuccugaaggcuacacuucuggcaguuucuggcguguaucccuuguccauuccagccacccuauucgugugguacuuuuggcaaaagaaaaagcagcgaucaggcguccugugggacacuccuagucccccagaaguggagcgcgcgguucucgaugacgggauauaucggaucaugcagagaggacugcuugguaggagccagguaggcgugggggucuuccaagaaaacguguuucauacaauguggcacguuacccguggagcuguguuaauguaccagggcaaacgccuggagccguccugggccucugucaagaaagaccucauuucguacggugggggauggcgguugcagggcagcuggaauacgggcgaggaagugcagguaaucgcagucgagccugggaagaaccccaagaaugugcaaacugccccaggaaccuucaaaacaucagaaggugagguuggcgcuauugcccuggauuuuaagcccgggaccuccggaaguccuaucgugaacagagaaggcaaaauagucggucucuaugggaauggagugguuacaacuucuggcaccuacgugagcgcaaucgcucaggccaaggcgucccaggagggcccacugcccgagauugaagacgaggucuucaggaaacgaaaccuuacgaucauggaucugcacccugggucaggaaagacacggcgcuauuugccggccauugugagagaagcaaucaagaggaaacuacggacucugauacucgcuccaacccgaguaguggccucugagauggcugaagcauuaaaggguaugcccauuagauaccaaacaaccgccguuaaaagcgagcauacuggcaaggagaucgucgaccugaugugccacgccaccuuuacaaugcgccuucugaguccugugagggugccaaauuauaacaugaucauuauggaugaagcucauuucacggaccccuccagcaucgcggcacguggguacauaucuacucgggucggaaugggcgaggccgcugccauuuuuaugaccgcaacaccuccggguucaguagaagccuucccccaguccaaugcugugauccaggaugaggaaagagacauuccagagaggaguuggaacagcggguaugaguggaucaccgauuuuccuggaaaaacuguuugguucgugcccucgauaaagucuggcaaugacauugcgaacugucuccgcaagaauggcaaacgagucauccaguuguccagaaagacauucgauaccgaauaccagaagacgaagaacaacgacugggacuacgugguuacuacagauaucagcgagaugggggccaauuuucgggcagacagggugauugauccacgccguugccugaaaccugucauccucaaggacggacccgaaagagugauucuggcugguccaaugccgguaaccguggccucagcagcccagcggaggggccgcauagggcgaaaccacaauaaggagggagaucaguauaucuacaugggccagccucuuaacaaugacgaggaucaugcucacuggaccgaagccaaaaugcuacuggacaacauuaauacucccgaggguaucaucccagcguuguucgaacccgagagagaaaagagugcagccauugauggggaguaucgguuaaggggcgaggcucgcaaaacauuuguugaacugaugagaaggggagaccucccugucuggcugucuuacaagguggccuccgagggcuuccaauauagcgaucggcguuggugcuuugacggggaacgcaacaaucaggugcuugaggaaaacauggaugucgagauauggaccaaagagggagaacgaaagaaacugagaccaagguggcucgacgcucggacauacucagaccccuuggcacugcgcgaguucaaggaauuugccgcugguagaaggaguguuagcggcgaucuaauccuggagauugggaagcucccucagcaccuuacucagcgggcccaaaaugcacuggacaacuuagugauguugcauaauuccgaacagggaggccgagcguauagacacgccauggaggagcugccggauacgaucgaaacccucaugcugcuugcucugauugccguacucacagguggggugacuuuguucuuucugucuggccgcggauuaggcaaaaccagcaucgggcuacugugugucauggcauccucagugcuccuuuggauggcuucuguugagccacauuggauagccgcaaguaucauucuggaguucuuuuugauggugcugcucauccccgagccugacaggcagcggacaccccaggauaaccaacuggccuacgucguaauuggacuucucuucaugauccugaccguggcugcgaaugagauggguuugcuggaaacuacgaagaaagacuuaggcauagggcacguugccguggagaaccaccaucacgcagcuaugcuagaugucgaccugcauccagccucggccuggacccucuacgcaguggcuacaacuauuaucaccccuaugaugcgucacacaauugaaaacaccacugccaauaucagccuuacagcgauagcuaaccaggccgcaauccugaugggauuggauaagggcuggcccauuuccaaaauggacaucggugucccacugcucgcccuggggugcuauucucaggugaauccucuuacguuaaccgcugcaguucugaugcucguggcccauuacgcgauuaucggcccgggauugcaagcuaaggccacuagagaggcacagaagaggacagccgcuggcauaaugaaaaaccccaccguagaugggauuguggccaucgaccuggauccagucguuuaugacgcaaaguuugaaaaacagcuaggacagaucaugcugcucauucuuuguaccucacaaauccuguugaugcgcacaacuugggcucugugcgagagcauaacgcucgccaccggcccucugacaacuuuaugggaggguucccccgggaaguucuggaauaccacaauugcggugaguauggccaacaucuuccggggaucuuaccuugcaggcgcuggucuggccuuuagccucaugaaaucacuaggcgggggacgaagaggcaccggggcacagggagaaacucugggcgagaaguggaagaggcaguugaaucaccuguccaaaagugaguucaacacguauaagcgcagcgguauuauggaggucgaccggucugaagcuaaagaggggcucaagagaggagagacaaccaaacacgccgugucccguggcacugccaaacuuaggugguuuguagaacggaaucuggugaagccagaggguaaaguuaucgauuugggcugugggcgcggaggcuggucauacuauugcgcggggcugaagaaagugaccgaagucaagggauacacaaaaggcgguccugggcaugaggaacccauaccgauggcuacuuacggauggaaccucgugaaguuacacagcggcaaagacgucuucuuugugccaccugagaagugugauacccugcuuugcgacaucggcgagucgucucccaauccaacaauugaagaggggcgaacgcugagaguucuaaagaugguagaacccuggcucaggggaaaccaguucuguaucaaaauucugaauccuuauaugccgaguguggucgagaccuuggagcaaaugcagcggaagcaugguggcaugcuggugcgcaacccccucuccagaaauagcacucacgaaauguacuggguuucaugcgggacaggaaacaucguguccgcagucaauaugaccucuaggaugcuucugaaccgauuuacuauggcccaccggaaaccaacauaugagcgugauguggacuuaggcgcugguaccagacauguagccguggaaccugagguugcaaaccuggauauuaucgggcagcgcauagaaaauauuaagcacgagcauaaaagcacguggcacuacgacgaggauaaccccuauaagaccugggccuaccauggaaguuaugaagucaagccuuccggcagcgcuucuucaauggugaauggcguggucaaauugcucacaaagccaugggacguuauccccauggugacucagaucgcgaugaccgauacaacuccuuucgggcaacagaggguauuuaaagagaagguggacacccggacaccaaaagccaagagaggaaccgcacagauuauggaagucacugcuaaguggcugugggguuuccuaagucgcaacaaaaagcccaggauauguacgcgagaggaauuuacacggaaagugagauccaaugccgcaaucggcgccguuuucguggacgagaaccaauggaauagcgcuaaggaggccgucgaagaugagagguuuugggaccuugugcaccgcgaacgugagcugcacaaacaggggaagugcgcgaccugcguauacaacaugaugggaaagcgggagaaaaagcucggcgaguucgguaaagcaaaggggucuagagccauuugguacauguggcugggagcuagguucuuggaguuugaagcccugggcuucaugaaugaggaucauugguuuucgcgcgaaaacucacucagcggcguugagggggagggacuucacaaacuggguuauaucuuacgagacauuuccaagaucaguggcgggaauauguacgcagaugacacugcuggaugggauacccggauaacagaagacgaucugcagaacgaggccaaaaucacggacauuauggaaccggagcaugcuuugcucgccaauucuaucuucaagcugaccuaucagaacaagguggucagagugcaaaggccugccaaaaauggcacugugauggaugucauuagccgcagagaccagcgggguuccgggcagguuggaacauacggccuaaacaccuuuacuaacauggaagcgcagcuuaucaggcaaauggagucagagggcauauucaguccaucugaacuggagacacccaaucucgccgaacgugugcuggauugguuggagaaguaugggguagaacgauuaaaacgcauggcuauuagcggagacgacuguguggucaagccuaucgaugacagauuugccaccgcacugacagcucucaacgauauggguaaagugcggaaggacaucccacagugggagcccuccaagggcuggaaugauuggcagcagguuccguucugcucacaccacuuucaucaacuuauuaugaaagacgggagggagauaguggucccuugucgcaaccaggaugaacuggugggcagagcacggguaagccagggagcagguuggucucuaagggagacugccugccuggggaaguccuacgcgcagauguggcaacucauguauuuccaccgacgugacuugagacuggcugccaaugcaaucuguagugccguucccguggauugggucccaaccagccgcacgaccuggucgauucaugcucaccaucaguggaugacagccgaagacaugcuuuccguguggaaccggguuuggaucgaggaaaauccuuggauggaggauaaaacucacauuucuucaugggaggacgugcccuaccugggaaagagggaagaccaguggugcggcagccucaucggcuuaaccgcaagagcuacaugggccacuaacauacaagucgcgaucaaucaggugcgccggcugauugggaacgagaauuacuuggauuauaugaccaguaugaaaagguuuaagaacgaauccgacccagagggagcucugugguga

SEQ ID NO: 14110 - RNA, 9879 nt, Artificial Sequence
  derived and/or modified CDS sequence (opt3) from DENV-1__FJ384655__SS-prME
agcgugaccaugcugcucaugcuucugcccacagcauuggcuuuccacuuaacuacgcggggcggggagccucauaugaucgucuccaagcaggaaaggggaaagucucugcuauuuaagaccucagccgguguuaacaugugcacacucauugcaauggaccugggcgagcuuugugaagauacuaugaccuacaagugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaagacagaggugaccaacccugccgugcuuagaaagcugugcauugaagcuaagaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaagugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagagaaaagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggaaaggcuugggaggagggcgucugcgguaucagaagcgccaccaggcucgaaaauauuauguggaagcagauauccaacgagcugaaucauaucuuacuggaaaacgacaugaaauucacugugguugugggcgacgcaaaugggauucuugcucagggaaagaaaaugauccggccucaacccauggagcacaaguacucuuggaagucguggggcaaagccaagauuaucggggcggauauacagaacaccacauuuaucauugacggaccagauacuccugaaugucccgacgagcagcgcgccuggaauaucugggaggucgaagauuauggcuucgguauuuuuaccacaaacaucugguugaaacucagagacagcuacacgcagaugugcgaucacaggcugauguccgcugcaauaaaggacucaaaagccgugcaugcugauaugggguauuggauugagagugaaaagaaugagaccuggaagcuagcccgugcaucuuucaucgaaguuaaaacuuguauuuggccaaagagccacacacugugguccaacggagugcucgagucagagaugaucauacccaaaaucuacggcgguccuauuagccaacauaauuaucggccaggcuacuucacccagacugcggggccguggcaccugggaaaacuugaauuggacuuugaucugugcgagggcacaaccguagucguggacgaacacugcgggaaccgaggacccucuuuaagaacgacuaccgugacaggcaaaaucauucaugagugguguugcagguccuguacccucccuccacugcgcuuccggggugaggaugggugcugguacggaauggaaaucagacccgucaaggagaaggaagagaaucuuguuaggaguauggugagcgccggcucuggugaaguagacuccuuuucacugggcauauugugugugaguauuaugaucgaggaggucaugcgcagccgauggucgcggaaaaugcucaugacugggacacuggcuguguuccuacugcucaucaugggacagcugaccuggaacgaccuuauucguuugugcaucaugguuggcgccaaugcauccgauaagauggggaugggaacaacuuaucuggcuuuaauggccaccuuuaaaaugagaccuauguucgcagugggccuccuguuuaggcgccuugccucucgggaaguccugcuacucacgauuggucugagcuugguggcuucaguugagcugccaaacaguuuagaagaacucggggacggacuggcgaugggcauaaugaugcuuaagcuguugacagaguuccaaccccaccaucucuggaccacucugcuaucccugaccuuuaucaaaacaacucuuucucucgauuacgccuggaagaccacggcaauggugcugagcauugucuccuuguucccgcuguguuuaucaacaaccagccagaagacuacauggcucccuguacugcuuggcaguuuugggugcaaaccacugaccauguucuugaucacugagaacaagauuuggggaagaaaaucuuggccccucaaugaggguaucauggcuauaggcaucguguccauucugcuaagcucgcugcuuaagaacgacguuccucucgccgggccccugaucgccggaggcauguugauugcuuguuaugugaucucagguucuagugcagauuuaucccuggaaaaagccgcggaggucagcugggaagaggaagcugagcacucugggacaagccauaauauacucguggagguacaggacgauggagccaugaagauuaaagacgaagagagggaugacacccugacgauccuucugaaggcaacuuugcuagccguguccggcgucuacccaaugucaaucccugcuacccuguuuguuugguauuucuggcagaagaaaaagcaacgaaguggcgugcucugggauacacccagcccaccggaaguggagggggcaguccuggacgauggaauuuaccgcauacuucagcgggguuuacugggcagaucucagguggggguuggaguauuccaggacggcguguuucacaccauguggcacgucacaaggggugccgugcucauguaucaagggaaacguuuggagccuuccugggcgucaguuaagaaagaccugaucaguuacggaggcggcuggcgcuuccaggggagcuggaacacuggagaagaggugcaggucauugcuguggaacccgguaagaauccaaagaacguacagaccacgcccggcacauuuaaaacuccugagggggaagucggagccaucgcacucgauuucaagccaggcaccuccgguucucccauugugucgcgggaggggaaaaucguuggacuguacggcaauggcguggucacaaccagcgggacuuaugugucagccauagcucaagccaaggcaucccaggagggaccucuuccggaaaucgaggacgaaguuuuuaaaaagagaaaccugaccauuauggauuugcauccagguaguggcaagacaaggcgauaccuacccgcuaucgugcgggaggccauuaaacgcaagcugagaacgcucaucuuagcgccuacuagggucguggccucugaaauggcagaggcucugaaagggaugccaauacgguaucagaccacagccguaaagagcgagcacaccggacgagaaauuguggaccuuaugugccaugcuacuuucacaaugagacugcucucccccguucgcgucccuaauuacaacaugaucaucauggaugaggcacacuuuaccgacccggccucaauugccgcuaggggcuauaucucuacgcguguggguaugggggaagcggcagccauauucaugacugcuacacccccaggaagcguggaggccuuuccucaaaguaaugcagucauucaggaugaggaacgggacauccccgagagauccuggaacagcggcuacgauuggauuaccgacuucccaggcaaaaccguaugguuugugccuucuaucaagucagggaaugauauagccaacuguuugaggaagaauggaaaacgcguuauucagcugucccgaaagacuuucgacacagaauaucagaaaaccaagaacaacgacugggauuacguggucacaacugacaucagugagaugggugcuaauuucagagcggaucgggugaucgaccccaggcgcugccucaaaccaguuauucugaaggauggcccggaacgugugauccuugccgggccuaugcccgucacgguggcaagcgcugcccaaagacggggaaggauuggccgcaaccagaauaaggagggugaccaguacguauauauggggcagccacuaaacaaugaugaggaccaugcacacuggaccgaagccaaaaugcuguuggauaacauaaauacacccgagggcaucauuccugcuuuauuugaaccagagcgagaaaagucggccgcgaucgacggaggcuacagacugagaggggaagcaaggaaaacuuucguggagcucaugcgcagaggagaucugcccguuuggcuuucuuauaaggucgccuccgaagguuuucaauacagcgacaggcgguggugcuucgauggcgagcguaacaaucaggugcuggaagagaacauggacguggaaaucuggaccaaagagggggagcgcaagaaacuccgaccuagaugguuggacgcuaggacauauucagauccgcuggcccuacgggaauuuaaggaguucgcugcaggacgcagaagugucucuggcgaccugauucucgaaauagguaaacuuccacagcaccugaccuuaagggcccagaaugcuuuggauaaccugguuaugcuccauaauuccgagcaagggggcaaagccuaccggcacgcaauggaggagcugcccgacacuaucgagacgcuuaugcugcucgcguugauugccgugcugaccggaggcguaacauuauuuuuccuaagcgggaagggacuggguaaaacuucaaucggccuccuuugugugaccgcuaguagcgcccuguuguggauggcauccgucgaaccucauuggauugcugccucuaucauacuggaguuuuuccucauggugcugcuuauccccgaaccagaucgacagagaacaccucaggacaaccagcucgcauauguugugauugggcuguuguuuaugauccugaccgucgccgcuaaugagaugggauuacuagagacuacaaagaaagaucugggcauuggucacguagcggccgaaaaccaccaacaugcaacgaugcucgacguggaucuucgccccgcuagcgccuggacccuguacgccguugcaacuacagugaucaccccaaugaugaggcacaccauagagaacacaacugcuaauauuuccuugacggccaucgcgaaccaggcugccauucugauggggcucgacaagggcuggccuaucucaaagauggauauaggagucccgcugcuugcauuaggcugcuacucucaggugaauccccugacccucacagccgcugucuugaugcugguggcacauuaugccaucauugggccaggacuacaagcgaaagcuacucgggaagcccagaagcguaccgcagccggcaucaugaaaaacccuacaguugacgguauuguggcuaucgaucuggaccccguaguguacgacgccaaguucgagaaacagcucgggcagauaaugcuucugauuuuguguaccagucaaauccugcucaugagaacuacgugggcacugugcgaaucgaucacauuagcuaccggaccacuuacuacccugugggagggcagcccugguaaguuuuggaauacaacuauugccgucuccauggcgaacaucuucaggggcucuuaucucgccggggcaggacuagcuuucucacugaugaaauccuugggcgggggacgccggggcaccggugcccagggggagacacugggagaaaaauggaagcgacagcucaaucagcuuagcaaaagugaguuuaacacguacaagagaucuggcauaauggaaguugauaggagcgaggcaaaagaaggucugaagcgcggcgagaccacuaagcacgcugugucacgggggacagccaaauugagaugguucgucgagcguaaucuggugaagcccgaaggaaaaguaauugaccucggcugugggaggggaggcugguccuauuacugcgccgguuuaaagaaagugaccgagguuaagggguauacuaaaggaggcccgggccaugaggagccagugccuauggcgacauacggguggaaccuggucaaacuucacaguggaaaggauguguuuuucaugcccccagaaaaaugugacacccugcuaugcgauaucggugagagcucucccaauccuacgauugaggaaggccggacccuccgcguccugaagaugguggagccgugguugcgagggaaccaauuuuguaucaaaauacugaaucccuacaugccauccguuguagaaacacucgagcagaugcagagaaagcacggaggcaugcuugugaggaacccucugucacggaauagcacucaugagauguauugggucucgugcgguaccgggaacaucgugucugcuguuaauaugacaagucgcauguuacugaacagauucacuauggcacacaggaaacccaccuacgaacgagacguggauuugggagccggcacacggcaugucgcuguggagccugaaguagccaaccucgacauuaucggccagcguauugagaauaucaagaacgaacacaaguccaccuggcacuaugaugaggacaauccauacaaaacuugggcauaucaugggagcuacgaggugaagcccucaggauccgccucuagcaugguuaacggugucgugagacugcuaacgaaaccuugggaugugauuccaauggucacacaaaucgcuaugaccgacacuacccccuuuggccagcagcgcguuuucaaggaaaaaguggacacaaggacgccgcgggcgaagagagggaccgcccaaauaauggagguaacugcaaaguggcuuuggggauuucugagucgcaauaaaaagccuaggauuuguacacgagaagaguucacccggaaagugagauccaacgcugccaucggcgcagucuuuguggaugaaaaucaguggaacagcgccaaggaggcuguugaggacgaaagguucugggaucucgugcaccgcgagcgugaacugcauaaacaggguaagugcgccacuugcgucuauaauaugauggggaagcgggagaaaaaguugggagaauuuggcaaagcgaagggcucuagagcaaucugguacauguggcugggggccagguuccucgaguucgaggcucuuggauuuaugaacgaagaccacugguucucacgcgagaauagucuguccgguguggaaggcgagggguuacauaaacugggauacauuuugcgagauauaagcaagaucccaggcgguaacauguaugccgacgauacagcagggugggacacccggauuacagaggaugaccuccagaaugaagcuaaaaucacugauauuauggagcccgaacacgcccugcuagcuaccucuaucuuuaaacuuacguaccaaaacaagguaguuagagugcagaggccugccaaaaauggaaccgucauggacgugauaucgcgcagagaucagcggggcucaggccagguggggacauauggacugaacacuuucaccaacauggagguccaacucaucaggcagauggaaagcgaggguauuuuucugccauccgaguuggaaacacccaauuuagcagagcguguucuggacuggcucgaaaagcacggcgcggagcgacuuaaacgcauggccaucaguggggacgauugugugguaaagccgauugacgauagauucgcuacugcccugaucgcacuaaacgacaugggaaaagugcggaaggauauaccucagugggaacccucuaagggcuggaaugacuggcagcaagucccauuuugcagccaucacuuccaucagcugauuaugaaagaugguagggagaucgugguuccuugucgcaaccaggacgagcucguggggagagcucgggucucccagggagccggcuggucauugagggaaaccgcaugccugggcaagaguuacgcccaaauguggcagcuuauguauuuucaccgacgugaucugagacucgcggcuaaugccaucuguucugcagugcccguagacuggguuccaacgagccgcacaaccugguccauucacgcccaucaccaguggaugacuacagaggauauguuaucaguguggaaccgggucuggauagaagagaaucccuggauggaagacaaaacccaugugagcucuugggaggagguuccuuaccuggggaagagggaagaccaauggugcggauccuugaucggucugacugcuagagccaccugggcaacaaacauucagguggcuaucaaucagguccgccggcucauuggcaacgagaauuaucuugauuacaugacgaguaugaaaagguucaagaacgaaagcgacccagagggggcccugugguga

SEQ ID NO: 14111 - RNA, 9879 nt, Artificial Sequence
  derived and/or modified CDS sequence (opt3) from DENV-1__KC759167__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucggugacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacuacucaagacagaggugaccaacccugccauccugaggaaacuuugcauugaagcuaagaucucuaauacgaccacagauagccgguguccaacucaaggagaggcccccgaagucgaggagcaggacgcaaacuucguuugccgccgaaccuuuguggauagaggcugggguaauggguguggacuguucggcaaaggcuccuugauaacaugcgcuaaguuuaagugcguaacuaaacucgaagggaagauugugcaguacgagaaccugaaauauucagucaucgugaccguucacacaggagaccagcaucaaguggguaaugaaaguaccgagcacggcacuacggccacaauuaccccucaggcgccaacuaccgaaauccaguuaacagacuacggggcccugacccucgauuguagcccgaggacuggacuugacuucaacgagaugguccuguugacaaugaaggagaaaucuuggcuagugcauaagcagugguuucuggaucucccccugccuuggacguccggcgcaucaaccagccaagaaacuuggaaucggcaggaccuucugguaacauucaaaaccgcucacgccaagaagcaggagguuguggucuuggguagucaagaaggggcuaugcacacagcccucacuggcgcaaccgagauccagacgucuggaaccacaacuauuuuugccggccaucugaaaugccguuuaaagauggauaaacugacccuaaaggggauguccuaugugauguguacaggaagcuucaaacucgaaaaggaggucgcugagacucagcacgguaccgugcugguucagauaaaguacgaaggcacggacgcgccaugcaaaauccccuucucgacacaagaugagaagggggugacccagaacggacgccuuauuacugcaaauccuaucguaacagacaaagaaaagccagucaacauagaggccaaacccccguuuggcgagucuuguauugugaucggugcuggggaaaaggccuugaagcuguccugguucaaaaagggcucaaguaucggaaaaauguuugaggcaaccgccagaggcgcuaggcggauggccauucucggggauacugcaugggacuucggaagcaucgguggcguuuuuaccuccguggggaagcugguccaucagauuuucggaacagcguauggcgugcuuuuuucugguguaagcuggacgaugaaaauagggaucggcgugcuguugaccuggcucggacugaauucacgaaguacuuccuuaagcaugacaugcauugcuguuggccuggucacccuauaccucggggugauggugcaggccgauucuggaugugucaucaacuggaagggccgcgaacugaagugcgguucagggaucuucguuacaaaugaggugcacacuuggaccgaacaauacaaauuucaggcagacaguccuaagagacuuagcgccgcuauuggaaaagccugggaggagggcgugugugguauaagguccgcaacgcgguuggaaaacaucauguggaagcagauuucuaacgagcugaaucauauccuccuggaaaacgacaugaaauucacaguagucgugggcgauguugcugggauuuuagcccagggaaagaaaaugauccgcccccaaccaauggaguauaaguacucguggaagagcuggggcaaagcgaagauaaucggggccgacgugcagaauaccacuuuuauuaucgauggaccuaacacccccgaaugcccagacgaucagagagcuuggaauauuugggaggucgaggacuauggcuucgguaucuuuacaacuaacauauggcugaaacuuagggauuccuacacccaggugugugaccaccguuugaugucagcagccauuaaggauaguaaagcuguucacgccgacaugggguauuggaucgaaucugagaagaaugaaacauggaagcucgcacgggcgagcuucauugaggugaaaacgugcaucuggcccaagucccauacccuguggucaaacggaguacuagaaagcgagaugauaaucccuaaaauuuacggcgguccaaucucucaacacaauuaucgaccgggcuacuucacucagacagccgggcccuggcaucugggaaagcucgagcuggauuuugaccuuugcgaaggcaccacugucgugguggaugagcacugugggaacagaggaccuuccuugaggacaaccacggucacuggcaaaauuauccacgaauggugcugucgcaguugcaccccacccccucugcgguucagaggugaggacggguguugguacggaauggagauaaggccaguuaaggaaaaggaggaaaauuuagugaaaagcaugguaucugcuggcuccggugagguggacucauuuagucucggccugcuuugcauuagcaucaugaucgaagaggucaugcgcucgcgauggucccggaagaugcugaugacaggggccuuggcaguguuccuccugcuaauuaugggacagcugaccuggaacgaucucauccgucuguguauuaugguuggcgcuaaugccucugacagaauggggaugggaacuacauaucuugcauugauggccaccuuuaaaaugaggcccauguucgcugugggccuguuauuucgcaagcucacaagccgggagguccugcuucugacuauaggucuaucacucguggcgaguguugaacugccgaacuccuuggaggaacugggggauggauuagccaugggcaucaugauucucaaacugcuuaccgacuuccaaucucaucagcugugggcaacguugcucagccugacauuuaucaagaccacuuucucccuacacuacgcuuggaagaccauggccauggugcugucaauugucagccuuuuuccucucugccugaguacaacuucucagaaaaccacgugguugccaguacuguuaggcucccucggguguaagccccugacaauguuccuuaucgccgagaauaaaauauggggaagaaggagcuggccucugaacgaagguaucauggcugugggcauuguuucgaucuugcucucaucucugcuaaagaacgaugugccccuggcagggccacuuauugccggaggcaugcucaucgcgugcuaugucauaagugguuccagcgcugaccugucuuuggagaaagccgcagaggugagcugggaagaggaagccgagcauuccggggcuucacacaauauuuuaguagaagugcaggaugacggaaccaugaagaucaaagaugaggagcgagacgauacucugacaauccuccugaaggcaacccuucuggccgucaguggcguuuacccuuugagcauucccgcgacucuauuugugugguauuucuggcgcaagaaaaagcaacggucuggcgugcugugggacacaccauccccgccugaagucgagagagcugugcucgaugacgggauauacaggaucaugcagcguggacugcuuggucgcucacagguuggcguagggguguuccaggaaaacgucuuucauaccauguggcacgugacgcggggagccguuuuaauguaucaaggcaaaagacuggagcccaguugggcaagcgugaagaaagaccucauuuccuacggugggggauggagguugcagggcucuuggaauacuggcgaggggguccaggugaucgccguagaaccaggaaagaaccccaagaauguccagaccgcuccugguacauucaaaaccccagagggcgaagugggggccauugcacuggauuuuaagcccggaacaucgggcagcccuaucguuaaccgagaggguaaaauaguggggcucuacggaaauggcgucgugacuaccucaggcacguauguuuccgcuaucgcccaagcgaaggccagucaggaagggccgcugccagagauugaggacgaaguguuccggaaacgcaaccuuacaaucauggaucugcaccccggaucugguaagacuagaagguacuugccugcaauuguccgggaggcuaucaagcgaaaacuaagaacccugauacucgccccaacacgcgugguagcuagcgaaauggcagaggccuuaaagggcaugcccauuagguaucagaccacugccgugaaauccgaauacaccgggaaggagaucguugaccugaugugucaugcuacauuuacgaugcgucuucugucaccuguccgggugccgaauuauaacaugaucauuauggaugaggcgcacuucacugaccccucuagcaucgcagccagaggauacauaaguaccagggugggcaugggugaagcugccgcaauuuuuaugacagccaccccaccuggguccgucgaggcuuucccccaaagcaaugcgguaauccaggaugaagagcgcgacauuccagaacgaucuuggaacucaggauaugaguggaucacugauuuuccuggcaaaacagugugguucguucccuccauaaagaguggcaaugacauugccaacugccucagaaagaaugggaaacgggugauccaguugagcaggaagaccuuugauacggaguaccagaaaacuaagaacaacgacugggacuacgucgugacaaccgauaucucggaaaugggagcaaauuuccgcgcugaccguguuauugauccaagacggugccugaaaccggugauccucaaggacgguccugagagggucauucuggccggccccaugccagugaccguagcaucugccgcucaacgccgagggagaauaggacggaaccauaauaaggaaggcgaucaguauaucuacaugggucagccccuuaacaaugacgaggaucacgcccauuggacugaggcgaaaaugcuacuggacaacauuaauacaccugaagggaucaucccagcauuguucgagcccgaaagggagaaguccgccgcuauugauggcgaauaucgcuuaagaggagaggccaggaaaaccuacguggagcugaugcggcguggcgaccucccuguuuggcugagcuauaaggucgcuucagaaggguuucaguacagugaucgccgaugguauuucgacggagagagaaacaaucaagugcuugaagagaacauggauguggaaauauggacaaaagagggugagaggaagaaacugcggccgcgcuggcucgacgcaagaacuuacucugacccauuggcccugagggaauuuaaggaguucgcugccggccggcgauccgucagcggggaucuaauccuggaaauuggaaagcucccccagcaccuuacgcagagagcacagaaugcgcuggacaacuuaguuauguugcacaauucagagcaaggcggucgcgccuacaggcaugcuauggaagagcugccugauaccaucgagacacucaugcugcuugcccugauugcagugcucacugggggcguaaccuuguuuuuccugaguggacggggcuuagggaaaacaagcaucggacuacugugugugauggcuuccucuguccuccuuuggauggccagcguggaaccccacuggauagcagccuccaucauucuggaguuuuucuugaugguucugcucaucccagaaccugaccgucagagaaccccccaggauaaccagcuggcuuauguggucauuggucuucucuuuaugauccugacuguagcggccaaugagaugggcuugcuggagacgaccaagaaagacuuagggauaggacauguggcaguuggcaaccaccaccaugcugccaugcuagauguggaccugcacccagccucagcauggacacucuacgcugucgccacuaccauuaucacaccuaugaugaggcauaccauugaaaacacuacagcgaauaucucucuuacggcuauagccaaccaagcagccauccugauggguuuggauaagggguggccgauuaguaaaauggacaucggcgugccccugcucgcucugggaugcuauucgcaggucaauccacuuaccuuaacugcagccgugcugaugcucguugcgcacuacgcuauuaucggcccuggguugcaggccaaggcaacacgcgaggcccaaaagcggaccgcugccggaauaaugaaaaaccccaccguggauggcauuguagcaaucgaccuggauccaguggucuaugacgcuaaguucgaaaaacagcuaggucagaucaugcugcucauucuuuguacaagccagauccuguugaugcgaacuacgugggcccugugcgaguccauaacccucgcgacagggccucugacuaccuuaugggaaggaucucccggcaaguuuuggaauacaaccauugccguuucaauggcaaacaucuucagagguagcuaccuugcuggcgccgggcuggcauuuucccucaugaaaagucuaggaggcgggaggcgcggaacuggcgcucaaggugagacgcugggggagaaguggaagcggcaguugaaucagcugucuaaacucgaauucaacagcuauaagagaucaggaauuauggagguggaccguuccgaagccaaagagggccuuaagaggggugaaacaaccaaacaugccgucagucggggcacugcgaagcugcgcugguucguggagcgaaauuugguaaagccggaggggaaagugaucgaucugggauguggcagagggggauggagcuacuacugcgcuggccucaagaaaguuaccgaagugaaggguuauacaaaagggggaccaggccacgaggaaccuauacccauggcaacuuacggcuggaacuuagucaagcugcacucugggaaagacguguuuuucaucccacccgagaagugugauacccuucugugcgacauuggagaauccucaccuaauccgacaaucgaggaggguaggacgcuacggguccucaagaugguggaacccuggcugcgcggcaaccaguuuuguauuaaaaucuugaauccauauaugccuagcguuguagagacccuggaacaaaugcagagaaagcaugggggaaugcucgugaggaacccccuuucgcgaaauucuacucacgagauguacugggucaguugcggcacagguaacauuguguccgccguuaauaugaccagccggaugcuguuaaaccguuucacuauggcucauagaaaaccuacauaugagcgcgauguggaccugggggccggaaccaggcacgucgcaguggaaccagagguagccaacuuggauaucauaggccagcggauugaaaauaucaagcacgagcauaaaucaacguggcacuacgacgaagauaaccccuauaagaccugggcuuaccauggcuccuacgaggugaagccuucugggagcaguuccagcaugguuaauggagucgugaaacuccugacaaagccaugggacgugauccccauggucacucagauugcgaugaccgauacaacuccguuuggucaacagagaguuuucaaagagaagguggacacccgcacaccuaaagccaagaggggcaccgcacagauaauggaaguaacugcuaaguggcuauggggguuucuuucucgaaacaaaaagccacggaucuguacgagagaggaauucacaaggaaagugcgcucaaaugccgcaauuggagccgucuuuguggacgagaaccaauggaauagugcuaaggaagccguugaggaugagcguuucugggaccuggugcaccgggaaagagagcuccauaaacagggcaagugcgcgaccugcgucuauaacaugauggguaagagggaaaaaaagcugggggaguuuggaaaagcaaagggcucccgcgccaucugguacaugugguugggcgcucgauuccuggaauuugaggcccucggguucaugaaugaggaucacugguucagccgggaaaacucucuuucgggaguggagggugaaggccugcacaaauuaggguauauucugagagacaucucaaagauacccggaggcaauauguacgcagaugacacugcugguugggauaccaggaucacagaggacgauuugcagaacgaggcccgcauuacggacaucauggaaccugagcaugcucuccuggccaaaagcauuuuuaagcuaaccuaucagaauaagguaguuagagugcaacggccagcaaaaaacgggacugucauggaugugaucuccaggcgugaccagcgaggaaguggccaggugggcacauacgggcuuaauaccuucacuaacauggaagcgcagcugauacgccaaauggagucugaagagauuuuuagccccuccgagcucgaaacaccgaaccuggccgagagagucuuggauugguuagaaaaguauggaaucgagcggcugaaaaggauggcuaucucaggugacgacuguguugugaagccuauugauaaucgcuucgccaccgcacucacagcucuuaacgacaugggcaaaguaagaaaggauauaccccagugggaaccaaguaagggguggaaugacuggcagcaggugccucugugcucucaccauuuucaccaacuaaucaugaaagauggacgggagauugucgugcccuguaggaaccaggacgagcugguuggccgagcccgugugagccagggugcaggguggucccucagagaaacugccugcuugggaaagucauacgcgcagauguggcaacugauguacuuccaccgccgggaucuuaggcuggcugccaaugcaaucuguagcgccgucccaguggacuggauucccaccucuagaacgaccugguccauccaugcucaccaucaguggaugacaacugaggauaugcucaguguauggaaccgcguuuggauagaagagaauccuuggauggaagacaaaacccacaucagcucguggggcgaugugccauauuuaggcaagcgggaggaccaguggugcgggucccugauuggauugacagccagggcaacuugggcuaccaacauccaagucgccauuaaucaggugcgaagacugaucgguaacgagaauuaccucgacuauaugacgucuaugaaacgguuuaagaacgaaucagauccggagggcgcgcuuugguga

SEQ ID NO: 14112 - RNA, 9879 nt, Artificial Sequence
  derived and/or modified CDS sequence (opt3) from DENV-1__JQ048541__SS-prME
uccgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaauaugugcacacuaauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucuugacccaagaugaaaagggggugacucagaacggacgccugauuacagcaaaucccaucguaaccgacaaagagaagccugucaacauagaagccgagccacccuuuggcgagucguauauugugaucggugcuggggaaaaagcccucaagcugucuugguucaagaaaggcuccucaaucggaaagauguuugaggcaacugccagaggcgcuaggcggauggccauucuuggggauaccgcaugggacuucggaaguaucgguggcguuuuuacaagcguggggaaacugguccaucagauuuucggaacggcguacggcguguuguuuuccgguguaucuuggaccaugaagauagggaucggcgugcuccugacuugguuaggacugaauagccgaucaacaagucuauccaugaccuguauugcuguuggccucgucacacuguaccuuggggugauggugcaggccgauagcggaugcgucaucaacuggaaaggccgcgaauugaagugugguucugggaucuucguuacuaaugaggugcacaccuggacggaacaauauaaguuucaggcagacucaccgaaaagacugagugccgcuauuggaaaggccugggaggagggcgugugcgguauaaggagcgcaacacggcucgaaaacaucauguggaaacagauuuccaacgagcugaaucauaucuuacuggaaaacgacaugaaguucaccguagucgugggcgauguugcugggauucuugcccagggcaagaagaugauccgcccucaacccauggagcacaaauacucuuggaagucguggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauagcuacacacaggugugcgaccaccgucugauguccgcagccauuaaagauucaaaggcuguucaugccgacaugggguauuggaucgaaagugagaaaaaugaaacguggaagcuagcacgggcgucuuucauugaggugaagaccuguaucuggccaaaaagccacacucugugguccaacggaguacucgaaucagagaugauaauccccaagauuuacggcgguccuaucagccaacauaaacugcgaccaggcuauuucacacagaccgccgggccguggcaccuuggaaaguuggagcuggauuuugacuuaugcgaaggcacuacagucgugguggaugagcacugcgggaauagaggacccucucucaggaccacgacugucaccggcaaaauuauccaugaaugguguugccgcuccuguacacugccuccacuucgguucagaggugaggacgggugcugguacggaauggagauaaggcccguuaaggaaaaggaggaaaaccuggugaaaaguaugguaagcgcuggcucuggugagguggacuccuuuucauugggccuccuguguauuaguaucaugaucgaagaggucaugcgcagccgauggucgcggaagaugcuaaugaccgggacucuggccguguucuuucuccugauuaugggacagcuuacauggaaugauuugauccguuccugcauuaugguuggcgcaaacgcuucugacagaauggggaugggaaccacauaccuggccuuaauggcaacuuucaaaaugaggccuauguuugccgugggccuccuguuccgccggcuuaccagcagagagguccugcuacucacgauaggucugucauugguggcuaguguugaacugccaaauuccuuagaggaacucggggauggacuggcgaugggcaucaugauucuuaagcuguugacagacuuucaaucucaccagcucugggccacccugcuaagccugacuuucaucaaaaccacauuuucccuucauuaugcauggaagacuauggcuauggugcucucaauugucagccuguuccccuugugucugaguaccacgucucagaagacaaccugguuaccgguacuccugggcucccuugggugcaaaccucugacuauguuuuugaucgccgagaacaagauauggggaaggaaaagcuggccacucaaugaagguaucauggccgugggcauuguuucgauccugcuaucaucucugcuuaagaacgaugugccccucgcugggccucugauugcaggaggcauguugaucgccuguuacgucauaagugguuccagcgcggacuuaucucuggagaaagcugccgaggugagcugggaagaggaagcagagcacuccggggccucacauaacauucucguagaagugcaggaugacggaacaaugaagaucaaagaugaggagcgagacgauacccugacuauccuucugaaggcuacauugcuagcagucaguggcguuuauccccugagcauuccagccacccucuucgugugguacuucuggcaaaagaaaaagcagcgcucuggcgugcugugggacacgccuucacccccagaagucgagcgggcggugcuugaugacgggauauauagaaucaugcagaggggauuacugggucguagccagguuggcguagggguguuucaagaaaaugucuuccacacuauguggcacgugacccgcggagcuguucucauguaccagggcaaacgguuggagccgaguugggccagcgugaagaaagaccugauuuccuauggugggggauggagacuccagggcucuuggaacacaggcgaggaaguccaggugaucgcaguagagccugggaagaaucccaagaacguccaaaccgccccaggaacauuuaaaacucccgaaggugaggugggcgcuauugcccuggauuucaagccugggaccucgggaagcccaaucguuaauagggaaggcaaaauagugggucuuuacgggaacggagucgugacgacaucaggcacuuacguuuccgcaaucgcucaggccaaggcgagucaggagggcccccugccugagauugaagacgagguguuucgaaaacggaauuugaccaucauggaucuacauccggggucuggaaagacacgcagauaucugccagccauugucagggaagcaaucaagcggaaacuccgaaccuuaauacuggcucccacuagagugguagccagcgagauggcugaagcacuuaaggguaugccuauucgcuaccaaaccacagccgugaaauccgagcacacgggcaaggagaucguugaccugaugugccaugccacuuucaccaugaggcucuugucaccaguccgugugcccaacuauaauaugaucauuauggaugaagcucacuuuacagacccuucuagcaucgcggcacggggguacauaaguaccagagugggaaugggcgaggccgcugccauuuucaugacugcaacaccgcccgguuccgucgaagccuuuccacagagcaacgcuguaauccaggaugaggaaagggacauuccugagcgcucuuggaacucaggguaugaguggaucaccgauuuccccggaaaaacggugugguuuguuccauccauaaagaguggcaacgacauugcgaauugucugcgaaagaacggcaaaagagugauccagcucagccggaagacuuucgauacagaauaccagaagaccaagaauaacgacugggacuaugucgugaccacugauaucucggagaugggggccaacuucagggcagaccgcguuauugauccucguagaugccugaaacccgugauccuuaaggacggaccagaacgggucauucuagcugguccgaugccugugacaguagccucugcagcccagaggcgcggccgaauagggagaaaucauaacaaggagggagaucaguacaucuacaugggccagccccugaauaacgacgaggaucacgcucacuggaccgaagccaaaauguuguuagacaauauuaacacaccagaggguaucauccccgcgcuguuugaaccugagcgggaaaaguccgcagccauugauggggaguauaggcuccgcggcgaggcuagaaaaacuuucguggaacugaugaggcggggagaccuuccaguuuggcugagcuacaaggucgccucagagggcuuucaauauagugaucgucgcuggugcuucgacggggaacgaaauaaccaggugcucgaggaaaauauggauguggagauauggacgaaagagggagaaagaaagaaauugaggccccgguggcuggacgcucgcaccuacucugacccucuagcacugagagaguuuaaggaguucgccgcugguaggcgguccgucagcggcgaucucauccuugagauugggaagcugccgcagcauuuaacacagcgagcccaaaacgcauuggacaaucugguuaugcuccacaacucagaacagggaggcagagcguaucgccaugccauggaggagcugccagauacuaucgaaacccuuaugcugcucgcuuugauugccgugcugacaggugggguaaccuuauuuuuccuaaguggcaggggacugggcaaaacuagcaucgggcuccuuugugugauggcauccucuguccuguuguggauggcuagcguggagccccacuggauagccgcauccaucauucuggaauuuuuccucaugguucugcuuaucccugagcccgaccggcagcguacgccacaggauaaucaacucgccuacguggucauuggacuguuguuuaugauccugaccguagcugcgaacgagauggguuuacuagaaacaacuaagaaagaccugggcauagggcacguggccguugagaaucaucaccaugcaaccaugcucgauguggaccuucacccugcuucagccuggacacuguaugccgucgcaaccacuauuaucacacccaugaugagacauacgauugaaaacaccacugcuaacaucucuuugacagccauagcgaaucaggcugccauccugaugggacucgauaagggcuggccaauuaguaaaauggacaucggugugccucugcuugcauuagggugcuacucgcaggucaacccgcugacccucaccgccgcuguguugaugcugguugcacacuacgccauuaucggccccggacuacaagcgaaggcuacaagggaggcccagaagcgcacugcagccggcauaaugaaaaauccaacgguggaugggauuguagcuaucgaccuggauccuguggucuaugacgccaaguucgaaaaacagcucggacagaucaugcuucugauuuuguguaccagccaaauccugcucaugcggacaacuugggcacugugcgaguccauaaccuuagcuacaggcccccuuaccacucugugggaggguucuccagggaaguuuuggaacacgacaauugccguuucaauggcgaauaucuuccgaggaagcuaccucgccggcgcaggucuagcuuucucccugaugaaaaguuugggcgggggaagaaggggcaccggggcccagggagaaacucugggcgagaaguggaagcgccagcucaaccagcuuucuaaaagcgaauuuaauaccuauaagcggucagguauuauggagguggacagauccgaagcaaaagaggggcugaagcguggagagacaacuaaacacgcugucaguaggggcaccgccaaguugcggugguucguggaacgcaaccugguaaagccugaggguaaagugaucgaucucggcugugggcgaggaggcuggagcuacuauugcgccggguuaaagaaaguuacagaagugaagggauacacgaaaggcggucccgggcaugaggaaccgauaccaauggcgaccuauggauggaaucuggucaaacuuuacucuggcaaagacguguuuuucaugccucccgagaagugugauacucugcuaugcgacaucggcgaguccucaccaaaccccacaauugaagaggggagaacccucaggguccugaagaugguggaaccuugguugcggggaaaucaauuuuguaucaaaguucugaacccguacaugcccagcguaguggagacucucgagcagaugcagcgcaagcacgguggcaugcuugucagaaauccacugucgaggaacucuacacaugaaauguauugggugaguugcgggaccggaaauauuguuuccgcugugaacaugacgagccgaauguuacugaaucgguucaccauggcacaccguaaaccuacauacgagagagaugucgacuugggcgccgguacucgccacguggcuguagaacccgagguggccaaccucgauaucauugggcagaggaucgaaaacauaaagcaugagcacaaaucaaccuggcauuaugacgaggauaauccuuacaagacaugggcauaucacggauccuacgaaguuaagccaucuggcagcgccaguuccauggucaacggcguggugaaacugcuaacuaagcccugggacgucauuccuaugguuacccaaaucgcuaugacagauaccacuccauuugggcagcagcggguguucaaagagaagguagacacgagaacacccaaagcgaagcgcggaaccgcccaaaucauggaagugacugcaagguggcuuugggguuuucugagccgaaauaagaaaccgcggauuuguaccagagaggaguucacaaggaagguccgcucuaacgcugccauaggcgcaguguuuaucgacgagaaucaguggaacucagccaaagaggcuguugaagaugagcguuucugggaccucgugcaucgggaaagagagcugcacaagcaggggaaaugcgccacgugcgucuauaauaugaugggaaagagggaaaagaaauugggcgaguuugguaaggcgaaagggagucgcgcaauuugguacauguggcugggagcccgauuccucgaguucgaagcucuuggcuuuaugaacgaggaucacugguucucccgggaaaauagccugucuggcguggagggggagggauuacauaagcuggguuacaucuugagagacauuucgaaaaucccuggcgggaacauguaugccgaugacaccgcaggaugggauacuaggauaacagaagacgaucuccagaaugaggcuaagaucaccgacauuauggaaccagagcacgcccugcuagcuaaagccaucuuuaaacuuacuuaccaaaacaagguaguucgcgugcagagacccgccaaaaauggcacagucauggaugugauuucacggagggaccagcgugguagcggacaggugggaaccuauggccugaacacauucacuaauauggaagcgcaacucauccgacagauggaguccgagggcauauuuaguccuucugaacuggagaccccaaacuuggccgaacgcgucuuagauuggcuggagaaguacgggguugaaagacucaaacggauggcuauuagcggagacgacugugugguaaagcccaucgaugacagguucgccacggcacuuaccgcucugaacgauauggguaaagugcgcaaggacaucccgcagugggagccuuccaagggcuggaaugauuggcagcaaguccccuuuugcucacaucacuuccaccagcuaauuaugaaagacgggagagagauagugguuccaugucggaaccaggaugaacuggugggaagggcccgagucagucagggcgcagguugggggcuccgugagacagccugcuugggaaagucuuaugcgcaaauguggcagcugauguacuuucauagacgcgaccuucggcuggcugccaaugcaaucuguagcgccgugccuguagauuggguucccacuuccaggaccacauggucaauucacgcucaucaccaguggaugacuaccgaagacaugcucagcguguggaacagagucuggaucgaggaaaauccauggauggaggauaaaacgcauauuucuuccugggaggacgugcccuauuuaggcaagcgcgaagaccaauggugcggcagucugaucggguugacagcccgggcaaccugggcuacuaacauacagguugccaucaaucaggugaggcgacugauuggaaacgagaauuaccucgauuacaugacaagcaugaaaagauucaagaacgaaucggacccugagggugcgcuuugguga

SEQ ID NO: 14113 - RNA, 9879 nt, Artificial Sequence
  derived and/or modified CDS sequence (opt3) from DENV-1__JN697056__SS-prME
agcgugaccaugcugcucaugcuucugcccaccgccuugacuuuccacuuaacgacccgaggaggggagccucauaugaucgucuccaagcaggaaaggggaaaaucucuguuguuuaagacgucagcugguguuaauaugugcacucucauugcaauggaccugggcgagcuuugugaugacaccaugacauacaaaugcccacggauaaccgaaacugagccggaugacguggauuguuggugcaaugccacagaaaccuggguaacguaugggacuuguagucaaaccggagagcaccgccgagacaagcguagcguggcgcuggcuccccauaucggcuugggucucgagacaagaacugaaaccuggauguccucugagggggccuggaggcagauucagaaagucgaaacaugggcacugcggcacccuggauucaccgugaucgcccuguuucucgcucaugcaauuggcacgucgaucacucagaagggcauaaucuucauuuuacugaugcuuguuacaccaucaauggccaugcgcugcguggggaucggaaacagagauuuugucgaggguuugagcggcgcuaccuggguggacguaguucuggagcacgggaguugugugacuacaauggccaaggauaaacccacccuagacauugaacuccugaagacggaggucaccaauccugcggugcuuaggaaacugugcaucgaagcaaagauauccaacacaacuaccgauucucgguguccaacacaaggagaggccacuuugguggaagaacaggacaccaauuucgucugccgccgaacauuuguugauagaggcugggguaacggguguggacucuucggcaaaggcagccugauuaccugcgcuaaguuuaagugcgugacuaaauuagaggggaagaucguacaguacgaaaaucugaaauauuccgugauugucacggugcacacaggagaccagcaucaaguugguaacgagaccacugaacacggcaccaucgccacaaucacaccccaggcaccuacuucagagauucagcucacagacuacggggcucuuacgcuggauuguaguccaaggaccggauuggacuucaaugaaauggugcuacugacuaugaaggagaaaagcuggcucguccauaagcagugguuucuggaucuuccgcugcccuggacaucuggcgccuccaccucacaagagacauggaaccggcaggacuugcucgugacuuucaaaaccgcgcacgccaagaagcaggaaguaguugugcuggguagccaagagggggcaaugcacacggcuuuaaccggcgccacagaaauacagacaaguggaaccacaacuaucuuugcuggccaucugaaaugccgucuaaagauggauaaacucacccugaaggggauuucuuaugucauguguacgggaccuuucaaacuugagaaggaaguggccgagacacagcacgguaccgucuuggugcagguuaaguacgagggcacugacgcaccaugcaaaauccccuucuccagccaagaugaaaagggggugacacagaauggacgccugguaaccgccaacccuauagucacugacaaagagaagccagugaauauugaagcugagcccccguuuggcgagucguauaucguugugggugcgggggaaaaagcacucaagcugucuugguucaagaaaggcuccucaaucggaaagauguuugaggccaccgcuagaggcgccaggcggauggcaauucuuggggauacagccugggacuucggaaguaucgguggcgucuuuacgagcguggggaaacugguacaucagauuuucggaaccgcuuacggcguguuguuuuccgguguuucuuggacuaugaagauagggaucggcauucuccugacaugguuaggacugaacagccgaucaaccagucuauccaugacauguaucgccgucggcaugaucacucucuaccugggggugauggugcaggcagauagcggaugcgucauuaauuggaaaggccgcgaacuuaagugugguucugggauauucguuaccaacgaggugcacacguggacagaacaauauaaguuucaggcggacucaccuaaaagauugagugcugccaucggaaaggcaugggaggagggcgugugcgguauuaggagcgccacccggcuggaaaacaucauguggaaacagauuuccaaugagcucaaccauauccuguuagaaaaugacaugaaguucacuguagucgugggcgauguuucugggauacuggcucagggcaagaaaucgauccgcccccaaccaauggagcacaaauacagcuggaaguccuggggcaaggccaaaauuaucggggcagacgugcagaacaccacauuuauuaucgauggaccuaauacucccgaauguccagacgaucagagagcuuggaacauaugggaggucgaggacuauggcuucgguauuuuuaccacaaauaucuggcuuaaguugagggauucauacacacaggugugcgaccaccgucucaugagugccgcgauuaaagauucuaaggccguucaugcugacaugggguauuggaucgaaagcgagaaaaacgaaaccuggaagcuggcacgggccuccuucauagaggugaagacuuguaucuggcccaaaucacacacacuauggagcaauggaguacuggaaucugagaugauuaucccuaagauuuacggcgguccaaucucccaacauaacuaucgaccgggcuacuucacccagacugcugggcccuggcaccucggaaaacuggagcuugauuuugacuugugcgaaggcacaaccgucgugguggaugagcacugcgggaauagaggaccuagucugaggacgacuaccgucacaggcaagauaauucaugaaugguguugccgcagcuguaccuuaccaccccuccgguucaaaggugaggacgggugcugguacggaauggagaucagaccuguuaaggaaaaggaggaaaaccuggugaaaucuaugguauccgccggcucaggugagguggacaguuuuagccuuggccuguuguguaucucgauuaugaucgaagaggucaugaggucccgcuggucuaagaaaaugcucaugacugggacacuggcaguguuccuacugcucaccaugggacagcugacauggaaugaucuuauucgauugugcauaaugguuggcgcgaacgccagcgacaauauggggaugggaacuaccuaucuggcuuuaauggccacguuucggaugcguccaauguucgcagugggccuccuguuuagaaggcuuacaucacgcgagguccugcuacucaccgugggucugaguuugguugcuuccguggaacugcccaacucuuuagaggaacucggggauggacuggccaugggcaucaugauucuuaagcuguugacugacuuccaaagccaccagcucugggcaacccugcuaucccugacauuugucaaaacuaccuucucacuucauuacgccuggaagacgauggcuaugauccucagcauuguaagucuguugccgcuguguuuaucuacaaccucccagaagacuacauggcucccugugcugcuuggcagccuggggugcaaaccauugaccauguuucucaucacugagaacaagauauggggacggaaaucguggccccugaaugaagguaucauggcgguuggcauugugucaauccuacugucuagucuucucaagaacgaugucccucuggccgggcccuugauugcaggaggcauguuaaucgcuuguuaugugauauccgguagcucugccgaccugagccucgagaaagccgcugagguauccugggaagaggaagcagagcacucaggggccagucauaauauucugguggaaauccaggaugacggaacaaugaagaucaaagaugaggagagagacgauaccauuacgauacuucugaaggcgacuuugcuagcuaucagcggcgucuacccaaugucuauuccugccacccuguucguuugguauuuuuggcaaaagaggaaacagcgauccggcgugcucugggacacacccucaccaccggaaguggagcgcgcaguccuggaugacgggaucuaccggauucuucagagaggauuacuggguaggagucaggugggcguugggguauuccaagaaggaguguuccacaccauguggcacgucacacguggcgccgugcucauguaucaggguaagcgcuuggagccuagcugggcuuccguuaaaaaggaccugaucucuuacgggggaggcuggcgguuucagggcucguggaacacuggggaggaagugcaggucauagcaguggagcccggcaaaaauccaaagaacguacaaaccgcccccgguacguucaagacaagcgaaggcgaggucggggcgaucgcucucgauuuuaaaccuggaacuucaggcuccccaauugugaauagagaagguaagaucguugggcuguacggaaacggcguggucaccacaaguggcaccuaugugucugccauugcacaggccaaagcuagccaggaggggccccuuccugagaucgaagacgagguuuucaggaagcgaaaucugacuauaauggauuugcauccgggauccgguaaaacccggcgcuaccuaccagccauugugagagaagcaaucaagaggaagcugcggacacucgucuuagcucccacgcgagugguagccucagagauggcggaagcccugaaaggcaugccuaucagauaucaaacuaccgcagugaagucugagcacacagggcgcgagauuguugaccuuaugugccaugcuaccuuuacuaugaggcugcucagcccaguccgugugcccaacuacaauaugaucauaauggaugaagcccacuucacagacccugcuaguauugcagcccggggauauaucuccaccagagugggcaugggugaggccgcugcgauuuuuaugacggcaacuccgcccgggagcgucgaagccuucccacagucuaacgcuguaaucuuggaugaggaaaaagacauaccugagaggucauggaacuccggauacgauuggauuacagacuuucccggcaagaccgugugguucguuccaaguaucaaaagcggcaacgauaucgccaauugucugcgcaagaacgggaagcgagugauucagcucucgagaaaaaccuuugacacugaguaucagaagacuaaaaauaaugacugggauuacgucgugaccacagacaucucugaaaugggagcaaacuuccgggccgauaggguuauugacccucgccguugccugaagcccgugauacuuaaagaugguccagagagagucauccuagcuggcccgaugccugugacuguagcguccgccgcacaacggagggggcgcauuggacgaaaucagaacaaggaaggcgaccaguacaucuauaugggucagccccugaauaacgaugaggaccaugcucacuggacggaggccaagauguuguuagauaauaucaacaccccagaagggauuauacccgcacuguucgagccugaaagagagaaaagcgccgcuaucgacggcgaauaccggcucaggggagaggcccgcaagacauuuguggagcugaugagaaggggcgaucuuccaguuuggcugucauauaaagucgcgagugaaggguuccaauacucugaccggcguuggugcuuugauggagagcgcaauaaccaggugcucgaagagaauauggacguggaaauuuggacuaaggagggugagagaaagaaguugagacccagguggcuggacgcacggaccuauuccgauccucuagcccugcgcgaguucaaagaguuugcugccggcagaaggagcgucucaggggaccucauccuugaaauuggaaagcugccgcagcacuuaacacagcgggcucaaaacgcauuggauaaucugguuaugcuccauaacagugagcagggcgguaaggccuaccgacacgcuauggaagaacugccagacaccaucgagacucuuaugcugcucgccuugauagcagugcugaccgggggaguaacguuauucuuucuaagcggaagaggccuggggaaaacauccaucggacuccuuugugugaugucuagcuccgcgcuguuguggauggccucagucgaaccccauuggauugcugccucuaucauucuggaguucuuucucauggugcugcuuaucccugaacccgaucgccagaggacuccacaggacaaucaacucgcauauguugugauaggucuguuguucaugauucugaccgucgcugccaacgagaugggcuuacuagagacaaccaagaaagaucuggggaucggacacgcagccgcugaaaaccaccaucacgcggccaugcucgacguagaucuucauccugcaagugcuuggacucuguacgccguggccacaacgauuaucacccccaugaugcggcacacuauagagaauacaaccgcaaacaucucguugaccgcuauugccaaucaggcggcuauccugaugggccucgacaaggguuggccaauuagcaaaauggauaucgggguuccucugcuugccuuaggcugcuacucccaggugaacccgcugacacucacugcagccgucuugaugcugguggcucauuaugcaauaauuggacccggccuacaagccaaggcgacgcgugaagcucagaagagaaccgccgcagggaucaugaaaaauccaacagucgacggaaucguggccauugaucuggacccuguuguguacgacgcuaaguuugagaaacagcucggccagaucaugcuucugauauuguguacuucucaaauucugcucaugaggaccacaugggcccugugcgaaucaaucaccuuagcaacugguccccuuacgacacugugggaggggagcccaggaaaguucuggaacaccacuauugcuguauccauggccaauaucuuucgcggcaguuaucucgcgggugccggccuagcauucucucugaugaaaagccuagggggaggccggcgagggaccggagcucagggcgagacacugggugaaaaguggaagagacagcucaaccagcuuucaaaauccgaguucaauauauacaagaggagugggaucguggaagucgaucgcagcgaggccaaagaaggacugaagcggggcgagacuaccaaacacgcaguuucuagagguacagcuaaguugcguugguuuguggagaggaaccuggucaagccugaaggcaaagugauugaccucggguguggacggggcgggugguccuauuacugcgccggauuaaagaaaguaacggaggugaagggcuauaccaaaggugggcccggacacgaggaaccgaucccaauggccacuuacggcuggaaucugguuaaacuuuacucaggcaaagauguguucuuuauuccucccgaaaagugugacacacugcuaugcgauaucggggagagcucgccaaaccccaccauugaggaaggacgcacucuccgaguccugaagaugguggagccuugguugagagguaaucaauucuguaucaaaauacugaacccguauaugcccucugucguggaaacacucgagcagaugcagaggaagcauggcgggaugcuuguucggaauccacugagucgcaacuccacccacgagauguacuggguaagcugcggaacgggcaauauugugucagcggucaacaugaccuccagaauguuacugaacagguuuacaauggcucaucgaaaaccuacuuaugaacgggacguggauuugggugcagggacccgucacguugccguggagcccgaagucgcuaaucucgacaucaucggacagagaauugagaacauaaagaaugaacacaaaucuacauggcauuacgaugaggacaacccuuauaagacuugggccuaccacggcagcuaugaggugaagccaaguggcuccgcaagcucuaugguaaauggggugguucgccugcuaaccaaacccugggaugucaucccuauggugacacaaauugccaugaccgacacuacgccauucggacagcagaggguguuuaaggaaaaagucgacacacggacccccaaggcuaaaagagguacugcgcaaaucauggagguuaccgccaaguggcuuuggggcuuccugucacgcaacaagaaaccgaggauuuguacacgagaagaguuuacgcggaaggugagaaguaaugcagcuaucggggccguauucguggaugaaaaccaguggaacuccgcaaaagaggccgucgaggacgaaagguuuugggaucucgugcgccgugagcgggaacugcauaagcagggaaaaugcgcuaccugcguuuacaacaugaugggcaagagagagaagaaauugggugaguucgggaaggccaaaggaagcagggcgauaugguacauguggcugggcgcacgcuuucucgaguucgaggcccuuggcuucaugaaugaagaccacugguuuucucgagagaacucgcugucagggguggaaggagaggguuuacauaagcugggcuauaucuugcgggauauuagcaaaaucccugggggaaauauguacgcugacgauacugccggcugggacacaagaauuaccgaggaugaccuccagaacgaagcaaagaucacugauauaauggagccagaacacgcucugcuagccacauccauuuucaaacuuaccuaucaaaauaaggucgugaggguacagcgccccgcuaagaacgguacaguuauggacgugaucaguagacgggaucagagggggucuggacaggucggcacuuacggccugaacaccuuuacgaauaugggggcccaacucauccgucagauggagagcgaaggaauuuuccugccuuccgaguuggagaccccaaacuuagcaggucgagugcuggacuggcucgaaaaacacggcauagagcgccuuagacggauggcgaucucaggggacgauuguguggucaagcccauugacgauagguuugccacagcucugacugcccuaaaugacaugggaaaaguucgcaaggauaucccgcagugggaaccuaguaaaggcuggaacgacuggcagcaagugcccuucugcucucaucacuuucaucagcugauuaugaaggaugguagagagaucguagugccaugucggaaucaggacgaacucgucgggagggcacgagugagccagggagcuggcugguccuugcgugagaccgccugccugggcaagucauaugcacaaauguggcagcuuauguacuuccacagacgcgaucugcggcucgccgcgaacgcuauauguagcgccguuccuguggacuggguccccacaucuaggacuaccugguccauccacgcacaucaccaguggaugacgacagaggauauguuaaguguguggaauagaguauggauugaagagaacccauggauggaagacaaaacccauguuagcucgugggaggacgugcccuaucuggggaagcgcgaagaucaauggugcggauccuugaucggucugacugcccgggcuacaugggccaccaauauucaggucgcaaucaaccaggugaggcgacucauuggcaaugagaacuaccuugacuacaugacuucuaugaaaagauuuaagaaugagucagauccugaaggggcucugugguga

SEQ ID NO: 14114 - RNA, 9879 nt, Artificial Sequence
  derived and/or modified CDS sequence (opt3) from DENV-1__JN697057__SS-prME
agcgugacaaugcugcuaaugcuuaugcccacagcacuggcuuuccacuugacuacgaggggaggggagccucauaugaucgucuccaagcaggaaaggggaaaaucuuuacuguuuaagacaucagccgguguuaacauuugcacacuuauagccauggaccucggcgagcugugugaagauacuaugaccuacaaaugcccacggaucacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauucagaggguggaaacuugggcucuccggcacccuggauucaccguuaucgcacuguuucuggcccaugcuauuggcacaucgaucacccagaagggcauaaucuucauucucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacugcucaagacagaggugaccaacccugccgugcugaggaaacuuugcaucgaagcuaagauaucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauuacuugcgcuaaguuuaagugcguaaccaaacuggaggggaagaucgugcaguacgaaaacuuaaaauauucagucauugugacaguucacaccggagaccagcaucaaguggguaaugagaguacugaacacggcacgacagccaccaucacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauucagaccucuggaacaacuaccauauuugccggccauuuaaaaugccgucugaagauggauaaacuaacacucaaggggauguccuaugugauguguacugguagcuucaaacuggagaaggaagucgcugagacccagcacggaacggugcuuguucagaucaaguacgagggcacagacgcgccuugcaaaauuccauucucgacccaagaugaaaagggggugacucagaacggacgcuugaucacagcaaaucccauaguaaccgacaaagagaagccugucaacauugaagccgagccacccuuuggcgagucuuauaucgugaucggugcuggggaaaaagcccugaagguuuccugguucaagaaaggcucaaguauuggaaagauguuugaggcaacugccagaggcgcuaggcggauggccauccucggggauaccgcaugggacuucggaagcauugguggcguguuuacauccgucgggaaacuggugcaucagauauucggaacggcguacggcguacuauuuucuggugugagcuggaccaugaagaucgggauuggcguucuguugacuuggcucggacuaaauucacgaaguacauccuuaagcaugaccuguaucgcugucggccuggugacacuauaccucggggugaugguccaggccgauucuggaugcguuaucaacuggaaaggccgcgaacugaagugugguucagggauuuucgugacuaaugaggugcacaccuggacggaacaauauaaguuucaggcagacaguccgaaaagacuuagcgccgcuauaggaaaggccugggaggagggcguaugcgguaucagguccgcaacacgguuggaaaacauuauguggaaacagaucucuaacgagcugaaucauauucuccuggaaaacgacaugaaguucaccgucgugguuggcgauguggcugggaucuuagcccagggcaagaagaugauacgcccucaacccauggagcacaaauacucguggaaaagcuggggcaaggcgaagaucauuggggccgacguccagaauacuaccuuuaucauugauggaccaaacacaccugaaugucccgacgaucagagagcuuggaauaucugggagguggaggacuauggcuucgguauauuuacuaccaacauuuggcugaaacuuagggauuccuacacacagguuugcgaccaccguuugaugucagcagccaucaaagauaguaaggcugugcaugccgacaugggguauuggauugaaucugagaaaaaugaaacguggaagcucgcacgggcgagcuucaucgagguaaagaccuguauauggccaaaaucccacacucuguggucaaacggaguccuagaaagcgagaugaucauucccaagaucuacggcgguccuauuucucaacauaauuaucgaccaggcuacuucacacagaccgccgggccguggcaccugggaaaacucgagcuggauuuugaccuuugcgaaggcacuacagugguggucgaugagcacugcgggaacagaggacccuccuugaggaccacgacuguuaccggcaagaucauacaugaaugguguugccgcaguuguacacugccuccauuacgguucagaggugaggacgggugcugguacggaauggagauuaggcccgugaaagaaaaggaggaaaaucucguaaagagcauggugucugcuggcuccggugaggucgacucauuuagucugggccuucuguguaucagcaucaugauugaagaggugaugcgcucgcgauggucccggaaaauguugaugaccgggacucucgccguuuucuuucugcuaaucaugggacagcugacauggaacgaucucauucgucugugcauaauggugggcgcaaaugcuucugacagaauggggaugggaaccacauaucuugccuugauggcaacuuucaagaugaggccuauguuugccgucggccuguuauuccgccggcucaccagcagagaggugcugcuucugacgaucggucuaucacucguugcuaguguggaacugccaaacuccuuggaggaacugggggauggauuagcgaugggcauuaugauccucaaacugcuuacagacuuucaaucucaccagcugugggucaccuugcucagccugacuuucauuaagaccgccuuuucccuacauuacgcauggaaaacaauggcuaugguacugucaaucgugagccuuuucccccucugucugaguacuaccucucagaagacgacaugguugccgguucuguuaggcucccucgggugcaagccucugaccauguuucuuauagccgagaauaaaaucuggggaaggaaguccuggccacugaacgaagguauuauggccgugggcaucgucucgauuuugcucucaucucugcucaaaaaugaugugccccuggcugggccucuuaucgcaggaggcaugcucauagccuguuauguaauuagugguuccagcgcggaccugucuuuggagaaggcugccgaggugagcugggaagaggaagcagagcacuccggggccucacauaauaucuuagucgaaguucaggaugacggaacuaugaaaaucaaggaugaggagcgagacgauacacugaccauucuccugaaagcuacucuucuggcagugaguggcguguaccccuugagcauaccagccacacuauucgucugguauuucuggcaaaagaagaaacagcgcucuggcgugcugugggacaccccuucacccccagaaguugagcgggcgguacucgaugacgggaucuacagaauuaugcagaggggacugcuuggucguagccaggugggcgucgggguguuucaagaaaacguuuuccacacgauguggcacgugacucgcggagcugucuuaauguaucagggcaagcggcuggagccgaguugggccagcgugaaaaaggaccucaucuccuacggugggggauggagauugcagggcucuuggaauaccggcgaggaaguacaggucauugcaguggagccugggaaaaaccccaagaauguucaaacagccccaggaaccuuuaagacacccgaaggugaggugggcgcuaucgcccuggauuucaaaccugggacuucgggaagcccaauagucaacagggaacgaaagaucgugggccucuacgguaaugggguugugaccacgucaggaacauaugucuccgcaauugcucaggccaaagcgagucaggagggcccccugccugagaucgaagacgagguguuucggaagcgcaaccuuacuauuauggaucugcauccgggcucugggaaaaccagaagguacuugccagccaucguacgggaagcaauaaagcgaaagcuaagaacacugauucucgcucccacccgcgugguugccagcgagauggcugaagcauuaaaaggaaugccuaucagguaucaaacuaccgccgucaaguccgagcacacagguaaagagaucguggaccugaugugccaugccacguucacuaugcgucuucugucaccagugcggguccccaauuacaacaugauuaucauggaugaagcucacuuuaccgacccuucuagcauagcggcaagaggcuauauuaguacaaggguagggaugggagaggccgcugccaucuucaugaccgcaacuccgcccggcuccguggaagccuuuccacagagcaaugcuguuauucaggaugaggaacgcgacaucccugagcgaucuuggaacucagguuacgaguggauaacagauuuccccgggaagaccgugugguuugucccauccauuaaaaguggaaaugacaucgcgaacugucucagaaagaauggcaagcgggugauccaguugagcaggaaaacguucgauacugaauaucaaaagaccaaaaacaacgacugggacuacguugugaccaccgauauuucggagaugggcgccaauuuccgcgcagaccgugucaucgauccuagacggugccugaagcccgugauucucaaagacgggccagaaaggguaauacuggcuggaccgaugccugugacuguugccucugcagcccagcgccgagguagaaucggccggaaccauaauaaggagggggaucaguacauuuauaugggacagccccuuaacaaugacgaggaucacgcucacuggacagaagccaagaugcuacuggacaacaucaauaccccagagggcaucauucccgcguuguuugaaccugagagggaaaaauccgcagccauagauggugaguaccgcuuaagaggggaggcuaggaagacauucgucgaacugaugcggcguggcgaccucccaguguggcugagcuauaaaguggccucagagggauuucaauacagugaucgccgauggugcuucgacggcgaaagaaacaaucagguccuugaggaaaacauggauguugagaucuggacuaaggagggggaaaggaaaaagcugcggccccgcuggcucgacgcuagaacguauucugacccuuuggcacugagggaguuuaaagaguucgccgcuggacggcgauccgugagcggugaucuaauucuggagaucggcaagcucccgcagcaucuuacccagagagcccaaaaugcacuggacaacuuaguaauguugcacaauucagaacaagggggacgcgcguacaggcaugccauggaggagcugccagauacaauugaaacucucaugcugcuugcucugaucgccgugcucaccggcggugucacauuguuuuuccugagugggcggggcuuaggaaagaccagcauaggccuacugugugugauggcauccucuguucuccuuuggauggcuagcguggagccccacuggaucgccgcauccauuauccuggaauuuuucuugaugguccugcucauuccugagcccgaccgucagagaacuccacaggauaaccaacuggccuauguagugaucgggcuucucuuuaugauacugacgguugcugcgaaugagaugggauugcuggaaaccaccaaaaaggacuuagguauuggccacguggccgucgagaaccaucaccaugcagcuaugcuagauguggaccugcacccugccucagccuggacucucuacgcagucgcuaccacaaucauuacccccaugaugaggcauacuaucgaaaacacaacggccaauauaucucuuaccgcgaucgcuaaccaggccgcaauucugaugggguuggauaaaggauggccaaucaguaagauggacauuggcgugccucugcucgcccuggguugcuacucgcagguuaauccgcuuacuuuaacagcugcagugcugaugcucgccgcgcacuaugcuaucauagggcccggcuugcaagccaaagcaacccgcgaggcccagaagcggaccgcugccggaauuaugaagaacccaacaguagauggcaucguggcaaucgaccuggauccugucguuuacgacgcuaaauucgaaaagcagcuagggcagauuaugcugcucauccuuuguacuagccaaauacuguugaugcgaacgaccugggcccugugcgaguccauuacacucgcgacuggaccccugaccacauuaugggagggcucuccagguaaauuuuggaauaccacuaucgccgugucaauggcaaacauuuucagagggagcuaucuugcuggagccggccuggcauucucccucaugaagagucuagguggcgggaggcgcggaacgggcgcucagggggaaacacugggagagaaauggaagcggcaguugaaucagcugucuaagagcgaauuuaacaccuacaaaagaucaggcaucauggaggucgaccguuccgaagccaaggagggucucaaaagaggggaaacuaccaagcacgccgugagucggggaacagcgaaacuucgcugguucguagaacgaaaucuggugaagccugagggcaagguuguggauuuggguuguggcagagggggauggagcuauuacugcgcuggccugaaaaaggucacugaagugaaaggguauaccaagggaggccccggucaugaggaaccgauaccaauggcaacauacggguggaaccucgucaaauuacacucuggaaaggacguguuuuucaucccucccgagaaaugugauacgcugcuuugcgacauuggcgaguccucaccaaaucccaccaucgaagagggcaggacucugcggguucuaaagaugguagaaccuuggcuccgcgggaaccaauuuuguauuaagauccugaauccguacaugcccagcguggucgagacauuggagcagaugcagagaaaacauggagguaugcuggugaggaacccacucucgcgaaauucuacccacgaaauguauuggguuaguugcggcacugggaacauuguguccgccgucaauaugacaagccggaugcuucugaaccguuucaccauggcucacagaaagccuacguacgagcgcgauguggacuuaggagccggcaccaggcauguagcaguggaacccgagguugccaaccuggauaucauaggucagcggauugaaaauaucaaacacgagcauaagucaacauggcacuaugacgaggauaacccuuacaaaacuugggcuuaucauggguccuacgaagucaagccaucuggaagcgcgaguuccauggugaauggcguggucaaguugcucaccaaacccugggacguuaucccuauggugacacaaauugccaugacugauaccacaccauuuggccagcagagaguauucaaggagaaaguggacacccgcacucccaaggcaaaaagggggacggcucaaauaauggaagucacagcccgauggcuguggggauuucuaagccggaacaagaagccgagaaucuguaccagggaggaguucacucgcaaagugcguucuaaugcagccauuggugcuguuuuuguggacgagaaccaguggaacucagccaaggaggcggucgaagaugagcgguucugggaccuugugcacagagaaagggagcugcacaaacagggcaagugcgcaaccugcguauauaacaugauggggaaacgcgaaaagaagcucggagaguuuggcaaagccaaggguagucgagcuaucugguacauguggcugggggcccgguucuuggaguucgaagcacugggauuuaugaaugaggaucauugguucuccagagaaaacagccucucuggcguugagggcgaggggcuucacaaacugggauacauuuuaagggacaucucgaagauaccugguggcaauauguaugcugaugacacagccgggugggauacgcgcaucaccgaagacgaucugcagaacgaggcuaaaauuacugacaucauggaaccaaagcaugccuugcucgcaaaagcgauuuuuaagcugacauaccaaaauaagguggucagagugcagcggcccgccaaaaacggaaccgugauggaugucaucucaaggcgugaccagcgaggcagcggucagguugggacuuauggacuaaauacauucaccaacauggaggcucaacuuauacgccagauggaauccgagggcauuuuuaguccuucugagcuggaaacaccaaaccucgccgagagagugcuggauugguuggaaaaguacggcguagagcgguuaaaaaggauggcaaucagcggggacgacuguguggucaagcccaucgaugaccgcuucgcuacugcccugaccgcacucaaugauaugggaaaagugagaaaggacauuccgcagugggaaccuuccaaggguuggaacgauuggcagcaaguucccuuuugcucacaccacuuccaucagcuuauaaugaaagacggccgggagaucguggucccauguaggaaucaggaugagcugguggggcgagcccguguaagucagggagcgggcuggucucuaagagaaacggcuugccuggguaagagcuaugcccaaauguggcagcucauguacuuucaccgccgggacuugaggcuggcagccaacgcuauuuguuccgccguuccuguggauuggguccccaccucaagaacaacuuggagcauccaugcacaccaucaguggaugaccacagaggacaugcuuucuguguggaaucgcguuuggauugaagagaacccauggauggaagauaaaacucacaucuccaguugggaggacgugcccuaucuggggaagcgggaggaccaauggugcggaagccucauaggcuuaaccgcuagggccacgugggcgacaaauauccaggucgcuauuaaccaggugcgaagacugaucggcaaugaaaacuacuuggauuacaugaccucgaugaaacgguucaagaaugaguccgacccugaaggggcccugugguga

SEQ ID NO: 14115 - RNA, 9879 nt, Artificial Sequence
  derived and/or modified CDS sequence (opt3) from DENV-1__HQ624984__SS-prME
agcgugaccaugcugcucaugcuuaugcccacugcccuggcuuuccacuugacuacgcggggaggggagccucauaugaucgucuccaagcaggaaagaggaaaaucuuuacuguuuaagaccucagcggguguuaauaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagucggccuggaaacagauccagaggguggaaacuugggcucuccggcacccuggguucaccguuauugcacuguuucuggcccaugcuaucggaacaucaauuacccagaagggcaucauauucauccucuuaaugcuggugacgccaagcauggccaugcgcugcgucggcauugggaguagagauuuuguggagggacuuuccggugcgacuuggguagacguuguguuggagcacggcucuugugucacaaccauggcaaaggauaaacccacucuggacaucgaacuacucaagacagaggugaccaacccugccauucugaggaaacuuugcaucgaagcuaagauaagcaauacgaccacagauucccgguguccaacucaaggggaggccacccugguggaagaacaagacgcaaacuucgucugccgccgaacauuuguugauagaggauggggcaaugguuguggguuguucggaaaaggcucacucauuacuugcgcuaaguuuaagugcgugaccaaacuggagggcaagaucguacaguacgaaaacuuaaaauauagugugauugucacagugcacaccggggaccagcaucaaguuggaaaugagagcacugaacacgguacgacagccaccaucacuccccaggcgccuaccacagagauccagcugaccgacuacggcgcccucacucuugauuguucuccaaggacagggcuggacuucaacgaaaugguguugcuaacgaugaaggagaaauccuggcugguccauaagcagugguuucucgaucugccgcuucccuggaccucaggagcaagcacaagucaagagacauggaaucggcaggaccuguuggugaccuucaaaacagcucacgccaagaagcaggaaguaguugugcucggcucucaagagggugcuaugcacacugcccugaccggggcaacggaaauucagaccuccggcacaacuaccauauuugccggacauuuaaaaugccgucugaagauggauaaacuaacacucaagggcaugagcuaugucauguguacugggucguucaaacuggagaaggaaguggcugagacccagcacggaacgguccuugugcagaucaaguacgaggguacagacgcgccuugcaaaauuccauucucuacccaagaugaaaagggcguuacucagaacgggcgcuugaucacagcaaaucccauagugaccgacaaagagaagccuguaaacauugaagccgagccacccuuuggagaguccuauaucgucaucggcgcuggugaaaaagcccugaagcucucaugguucaagaaagggaguagcauuggcaagauguuugaggcaacugccagaggagcuaggcggauggccauccugggcgauaccgcaugggacuucggguccauuggagguguguuuacaucuguuggcaaacuugugcaucagauauucgggacggcguacggaguccuguuuagcggcgugucauggaccaugaagaucgguauugggguauugcucacuuggcugggcuuaaauagucgauccacaagccugucuaugaccuguaucgcugugggccuaguuacacucuaccugggcgucauggugcaggccgauucagggugcgugaucaacuggaaaggacgcgaacuuaaguguggcagugguauuuucgucacuaaugagguucacaccuggacggaacaauauaaguuucaggcagacagcccgaaaagauuguccgccgcuauagggaaggccugggaggagggagugugcggcaucaggucugcaacacggcuggaaaacauuauguggaaacagaucucgaacgagcucaaucauauucuguuagaaaacgacaugaaguucaccgugguagucggugauguggcuggcauccuggcccaggggaaaaagaugauacgcccucaacccauggaguacaaauauagcuggaaguccuggggaaaggcgaaaaucauuggcgccgacguucagaauacuaccuuuaucauugaugggccaaacacaccugaaugucccgacgaucagagagcuuggaauaucugggagguggaggacuacggauucggcauauuuacuaccaacauuuggcuuaaguugagggauucauauacacaggucugcgaccaccgucucaugagugcagccaucaaagauucuaaggcugugcacgccgacauggguuacuggauugaaagcgagaaaaaugaaacguggaagcuggcacgggcguccuucaucgagguuaagaccuguauauggccaaaaucacauacucuauggagcaacggggugcuggaaucugagaugaucauucccaagaucuauggaggcccuauuucccaacacaauuaccgaccagguuacuucacacagaccgccggcccguggcaucucgggaaacuggagcuugauuuugacuugugcgaaggaacuacaguagucguggaugagcacugcggcaacagagggcccagucugaggaccacgacugugaccggaaagaucauacacgaaugguguugccgcagcuguacauuaccuccacuccgguucagaggcgaggacgguugcugguaugggauggagauuaggcccgucaaagaaaaggaggaaaaucugguuaagucuaugguguccgcuggaucaggcgagguagacaguuuuagccuuggucuguuguguaucucgaucaugauugaagaggugaugcgcucccgauggucucggaaaaugcucaugaccggcacucuggccgucuuccuacugcucaucauggggcagcugacauggaacgaucuuauucguuugugcauaauggugggagcaaaugcuagcgacagaaugggcauggggaccacauaccuggccuuaauggcaacuuuuaagaugaggccuauguucgccguuggacuccuguuucgccggcuuaccucaagagaggugcugcuacucacgaucggccugaguuuggucgcuuccguggaacugccaaacucuuuagaggaacucggugaugggcuggcgaugggaauuaugauccuuaaacuguugacagacuuccaaagccaucagcucugggccacccugcuaucccugacuuuuauuaagaccacauucucacuucacuaugcauggaaaacuauggcuaugguucucagcaucgugagucuguuucccuugugucugucuaccacgucccagaagacaaccugguuaccgguccuccugggcagccuuggcugcaagccucugacuauguucuugauagccgagaauaaaaucugggggaggcgaucguggccacucaacgaaggaauuauggccguagguaucgugucaauucugcuaucuagucugcuuaagaacgauguuccccucgcuggcccucugaucgcagggggaauguugauagccuguuacgugauuuccggcagcucugcggacuuaagccuggagaaagcugccgaggucuccugggaagaggaagcagagcauucaggugccagucacaauauccucguggaaguacaggaugacgggacaaugaagaucaaagaugaggagcgcgacgauacccugacuauucuucugaaggcuacauugcuagcagugagcggagucuauccccugucuauaccagccacccucuuuguuugguacuucuggcagaaaaagaagcagcgguccggcgugcugugggacacgccuucacccccagaaguggagagagcgguccuugaugacggcaucuauaggauuaugcagcguggguuacugggacgcagucagguggguguuggcguauuccaagaaaacguguuucauacuauguggcacgucaccagaggggcugugcucauguaccagggaaaaagauuggagccgagcugggccuccguuaagaaagaccugaucucuuacggcgguggguggaggcuccagggaucguggaauacaggcgaggaagugcaggucauugcaguggagccuggcaagaaccccaaaaauguacaaaccgccccagggacauucaagacuagcgaaggagaggucggugcuaucgcccuggauuuuaagcccggcaccucaggguccccuauagugaaccgagaaggaaaaaucguuggccuuuaugguaaugggguggucacgacaaguggaacuuacgugucugcaauugcucaggccaaggcgagccaggagggcccacugcccgagaucgaagacgagguuuuccggaaacgcaacuugaccauuauggaucuacacccuggcuccgggaagacaagaagguaucugccggccaucgugcgggaagcaauaaaacgaaagcucagaaccuuaauucuggcuccaacucgcgucguggccucagagauggcugaagcacuuaagggaaugcccaucagguaccaaaccacagccguaaaaucugagcauacggguaaggagaucguggaccugaugugccacgccacuuuuaccaugcgucucuugagcccuguucgggucccaaauuauaacaugauuaucauggaugaagcucauuucacagaccccaguuccauagcggcaagaggcuacauuagcaccaggguggggaugggagaggccgcugccaucuuuaugacugcaacaccuccgggcucuguggaagccuucccccagucaaaugcucugauucaggaugaggaacgcgacaucccagagcgauccuggaacagugguuaugaguggauaaccgauuuuccugggaaaacggucugguucguacccagcauuaagucgggaaaugacaucgcgaacugucucaggaaaaauggcaagcgggugauccagcugucuaggaagacuuuugauacagaauaccagaaaaccaagaacaacgacugggacuacguugugaccacugauauuuccgagaugggcgccaauuuccgcgcagaccgugucaucgauccaagacggugccuuaaaccugugauucuaaaggacgggcccgaaaggguuauacuggcuggaccaaugccggugacagucgccagcgcagcccagcgccgagguagaaucggccggaaccacaauaaagagggggaucaguauauuuacaugggacagccuuugaacaaugacgaggaucaugcucacuggaccgaagccaagauguuacuggacaacaucaauacacccgagggcaucauuccagcacucuucgaacccgagagggaaaagucagcagccauagauggugaguaucgccugagaggggaggcuaggaaaacuuuuguggaacuuaugcggcguggcgaccugccuguauggcucaguuacaagguggccucugagggauuccaauauuccgaucgccgauggugcuuugacggcgaaagaaacaaucagguuuuggaggaaaacauggaugucgagaucuggacgaaagagggggaaaggaagaaacugcggccacgcuggcuagacgcuagaaccuacagcgacccccuggcacucagggaguucaaggaauuugccgcuggacggcgaucagugaguggugaucuuauucuggagaucggcaaauuaccucagcacuugacacagagagcccaaaaugcacuggacaaccucgugaugcugcauaauagcgaacaaggcgggcgcgcguauaggcacgccauggaggagcuuccggauacuauugaaacccugaugcucuuggcucugaucgccgucuuaacaggggguguuacccuauucuuucuguccgggcggggccucggaaagacuucuauaggccuucugugugugauggcaagcuccguauugcuguggauggcuucaguggagccacauuggaucgccgcaucuauuauccucgaguucuuucugaugguccuucucauucccgagccugaccgucagagaacgccccaggauaaccaacuggccuacgugguuaucggguugcuguucaugauauuaaccguggcugcgaaugagaugggacuacuggaaacaacuaagaaagaccucgguauuggccacgucgccguagggaaccaccaucacgcagcuaugcuugauguggaccugcauccagccagugccuggaccuuguacgcaguugcuacaaccaucauuacuccuaugaugaggcacacaaucgagaacacgaccgccaauauaucgcugacugcgaucgcuaaccaggccgcaauucucaugggacuggauaagggcuggcccaucagcaaaauggacauuggugugccacuuuuagcccuggggugcuauucccaggucaauccucucacauugaccgcugcagugcugaugcuagucgcccauuacgcgaucauaggcccgggacugcaagcuaaggccacccgcgaagcacagaaacggacagccgcuggcauuaugaagaaccccacuguggaugggaucguugccaucgaccucgauccagugguauaugacgcaaaguuugagaaacagcuuggacagauuaugcuguugauccuguguacgucucaaauacuccugaugcgaaccacaugggcuuuaugcgaaucaauuacucuugccaccggcccucugacaacccucugggaggguagccccgggaaguucuggaauacuacgaucgcgguguccauggccaacauuuuuagaggaaguuaccuagcaggcgcuggucuggccuucucuuugaugaaaagccugggcgggggaaggcgcggcacaggggcacagggagagacccucggcgaaaaguggaaacggcagcuuaaucagcugucaaaguccgaguucaacacuuauaagagaagugguaucaccgaagucgaccguagcgaggcuaaagaaggguugaagaggggagagacaacuaaacacgccguuucucggggcaccgccaagcugcgcugguuuguggagcgaaaucucgucaaaccagaagguaaggugauagauuuaggcugugggagaggaggcugguccuacuauugcgcggggcugaagaaaguaacagaggugaagggauacacgaaaggcgguccugggcacgaagaacccaucccgauggcuaccuacggauggaaccuuguuaagcugcauucaggcaaagacguguucuuuauuccaccugaaaagugugauacucuacucugcgacaucggcgagagcucgcccaauccaacaauugaggaagggaggacccugcgggucuugaaaaugguggagcccuggcugcgcggaaaccaauucuguaucaagauucucaauccuuauaugccgucugucguggaaacucuugagcagaugcagagaaagcacgguggcaugcugguuaggaaccccuuaagucgaaauuccacacaugagauguacuggguaagcugcgggaccggaaacaucgugucagcagucaauaugacgucccggaugcuguugaaccguuuuaccauggcccacagaaaaccaacauaugaacgcgauguggaccucggcgcugguacuaggcacguugccguggagccugaagucgcaaaccuggauauaauugggcagcggaucgagaauaucaagcaugaacacaaaucuaccuggcauuacgacgaggauaaccccuauaagacaugggccuaccacggaagcuaugaggugaaaccuaguggcuccgcuagcucuaugguaaauggcgugguuaagcuacuuacuaagccaugggacgucauucccauggugacccaaauagcgaugacagauaccacuccuuucgggcagcagagaguguuuaaagaaaaggucgacacgcgcacaccaaaagccaagaggggaaccgcacaaaucauggagguuacugcuaaauggcugugggguuuccucucacgaaacaagaagccccggauuuguaccagagaagaguuuacaaggaaagugcgcaguaaugccgcaaucggcgccguauucguggacgaaaaccaguggaacuccgcuaaggaggccgucgaggaugaacguuuuugggaccuggugcaucgggagagagaauugcacaaacaggggaagugcgcgacgugcguuuacaacaugaugggaaaaagggagaagaagcugggcgaguucgguaaagcaaaggggagccgcgccauuugguacauguggcucggagcucgauuucuugaguucgaggcccugggcuucaugaaugaagaucacugguuuucucgggagaacucguuaucaggcguggaaggggagggacugcauaaauuggguuauauccucagagacauaagcaagaucccgggcgggaauauguacgcagaugacaccgcuggaugggauacuaggauuacagaggacgaucugcagaacgaagcccgcaucaccgacauuauggagccugaacacgcucuacuugccaaauccaucuucaagcugacuuaucaaaauaaagucgugagaguacagcggccagcaaagaacggcacaguuauggaugugauaaguaggcgugaccagcgagguucugggcaggucggaaccuacggccucaauacauuuacuaacauggaggcgcaacugauucgccagauggaaagcgagggcaucuucucccccucagaguuggaaaccccuaacuuagccgagagagugcuggauuggcucgaaaaguaugggguggagcggcuuaaaaggauggcuaucaguggagacgacugugucguuaagccaauugaugaccgcuuugccacggcacugaccgcucuaaaugauauggguaaagugagaaaggacauaccccagugggaaccgucuaaaggcuggaacgauuggcagcaaguaccuuucugcagccaucacuuucaccagcugaucaugaaggacgggcgggagauugugguccccuguaggaaucaggaugagcucgugggacgagcccguguuucccagggcgcagguuggucauugagagaaacagccugccugggaaagagcuacgcgcaaauguggcagcuuauguauuuccaucgccgggaccugaggcucgcugccaacgcaaucuguucugccgugccagucgauuggauuccuacuuccagaaccacauggaguauccacgcucaucaccaguggaugacuaccgaggacauguuaagcguguggaaucgcguauggauagaagagaaccccuggauggaagauaaaacgcauaucucguccuggggagacguuccauaccugggcaagcgggaggaccaauggugcggcucuuugauugggcugacagccagggcaaccugggcuacuaauauccagguggccauuaaccagguccgaagacucaucggaaaugagaacuaccuugauuauaugacaucaaugaaacgguuuaagaaugaaagcgaccccgagggugcgcugugguga

SEQ ID NO: 14116 - RNA, 9879 nt, Artificial Sequence
  derived and/or modified CDS sequence (opt3) from DENV-1__HQ891314__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagagcaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucacggaaaugguccuacugaccaugaaggagaaaucuuggcucgugcauaagcagugguuucuggaucuuccgcugcccuggacuuccggcgcaucaacaagccaagagaccuggaaccggcaggacuugcucguaacauucaaaacugcucacgccaagaagcaggaaguugugguccuggguagucaagagggggcuaugcacaccgccuuaacgggcgcaaccgaaauccagacaucuggaacuaccacaaucuuugccggccaucugaaaugccgucuaaagauggauaaacucacucugaaggggauguccuaugugauguguaccggaagcuucaaacuugagaaggaagucgcugagacgcagcacgguacaguguugguucagauuaaguacgagggcaccgacgcgccuugcaaaauaccauucucgacucaagaugaaaagggggugacacagaauggacgccugaucaccgcaaaccccauuguaacugacaaagagaagccugucaauaucgaagccgagccacccuuuggcgagucuuauauagugauuggugcuggggaaaaagcccucaagcuguccugguucaagaaaggcucaaguaucggaaagauguuugaggcaaccgccagaggcgcuaggcggauggccauccuuggggauacagcaugggacuucggaagcauugguggcguuuuuacguccguggggaaacugguccaucagaucuucggaaccgcguacggcguguuguuuucugguguaagcuggacuaugaagauugggauaggcgugcuccugacaugguuaggacugaacucacgaaguaccucccuaagcaugacauguaucgcuguuggccucgucacucuguaccuuggggugauggugcaggccgauucuggaugcgucauuaauuggaaaggccgcgaauugaagugugguucagggaucuucguuaccaacgaggugcacacguggacagaacaauauaaguuucaggcagacaguccgaaaagacugagcgccgcuaucggaaaggccugggaggagggcgugugcgguauuagguccgcaacccggcucgaaaauauaauguggaaacagaucucuaacgagcugaaccauauuuuacuggaaaaugacaugaaguucacuguagucgugggcgauguugcugggauccuugcccagggaaaaaagaugauucgcccucaacccauggagcacaaauacucguggaagaacuggggcaaggcgaaaaucauaggggccgacgugcagaauagcaccuuuaucauugauggaccaaacacaccugaauguuccgacgaucagagagcuuggaauaucugggaggucgaggacuauggcuucgguauuuuuacuaccaacaucugguugaagcucagggauucauacacacaggugugcgaccaccgucugaugagugcagccauaaaagauucuaaggcuguucaugccgacaugggguauuggauugaaagcgagaaaaaugaaacguggaagcuagcacgggcguccuucaucgaggugaagaccuguauuuggcccaaaucacacacucuguggagcaacggaguacucgaaucugagaugaucauaccaaagaucuacggcggucccauuucccaacauaauuaucgaccuggcuacuucacacagaccgccgggccauggcaccugggaaaacuugaguuggauuuugaccugugcgaaggcacuacagucgugguggaugagcacugcgggaacagaggaccgaguuuaaggaccacgacugucaccggcaagaucauucaugaaugguguugccgcagcuguacacuccccccucugcgguucagaggugaggacgggugcugguacggaauggagaucaggccaguuaaagaaaaggaggaaaaucuugugaagucuaugguauccgcuggcucaggugagguggacaguuuuagccugggcuugcucuguauaucgauuaugaucgaagaggucaugcgcucccgauggucucggaaaaugcugaugaccgggacucuagccguguucuuucugcucaucaugggacagcugacauggaacgaucuuauucguuugugcaucaugguuggcgcaaaugcuagcgacagaauggggaugggaaccacauaucuggccuuaauggcaacuuucaagaugaggcccauguuugccgugggccuccuguuccgccggcuuaccucaagagagguccugcuacucacgauuggucugaguuugguggcuuccguugaacugccuaacucuuuagaggaacucggggauggacuggcgaugggcauaaugauccuuaaacuguugacagacuuucaaagccaccagcucugggccacccugcuauccaugacuuucauuaagaccacauuuucacugcauuacgcauggaaaacuauggcuauggugcuuagcaucgucagucucuucccacuguguuugucuaccacgucccagaagacaaccuggcugcccguauuacucggcagccuggggugcaagccgcuuacuauguuucugauugccgagaauaaaaucuggggaaggaagucguggccuuugaacgaagguauaauggccgugggcaucguuucaauucuccugucuagucuacugaaaaacgaugugccacuugcugggccccucaucgcaggaggcaugcugauugccuguuaugucaucuccgguagcucugcggacuugagcuuagagaaggcugccgagguguccugggaagaggaagcagagcacucaggggccagucauaauauacugguagaagugcaggaugacggaacaaugaaaauuaaggaugaggagcgagacgauacccucacuauccugcuuaaagcuacacuguuggcagucagcggcguuuacccucuaucuauccccgccacccuguucgugugguauuucuggcaaaagaagaaacagcgcuccggcgugcucugggacacgccaucaccucccaaggucgaacgggcggugcuggaugacgggauuuacagaauaaugcagaggggacuuuuaggucguagucagguuggcguagggguguuucaagagaacgucuuccacacuauguggcacgugacccgcggagcuguucugauguaucagggcaaacggcucgaaccaagcugggccuccgugaagaaagacuugaucucuuacggugggggauggagacugcagggcucguggaauacaggcgaggagguccaggugauugcaguagaaccggggaagaacccuaagaauguccaaaccgcccccggaacauuuaaaacuccagagggugaagugggcgcuaucgcccucgauuucaagcccgggaccagcggaucaccuauuguuaacagggagggcaaaaucgugggucuguacgggaauggagucgugacgacauccggcacuuauguuagugcaauagcucaggccaaggcgucucaggaaggcccacuucccgagaucgaggacgaaguguuucgaaaacggaaccugaccauuauggauuugcauccugggagcggaaagacacgcagauaccuaccggccaucgucagggaggcaauuaagcggaaaaugcgaacccugauccucgcuccaacuagagugguagccuccgaaauggcugaggcauuaaaggguaugcccauacgcuaucaaaccacagccgugaaaucagaacacacgggcaaggagauuguugaccugaugugccaugccacuuucaccaugaggcuucugucuccuguccgugugccaaauuacaacaugaucaucauggaugaggcucacuuuacagaccccagcaguauugcggcacggggguauaucuccaccagagugggaaugggcgaagccgcugccauauucaugacugcaacaccuccggguagcgucgaggccuuuccccagucuaaugcuguaauucaggaugaagagagggacaucccagaacgcucauggaacuccggguacgaguggauuaccgauuucccuggaaaaacggugugguuuguucccaguaucaaggcgggcaaugacauagccaacugucuccgaaagaauggcaaaagagugauucaguugagccggaagacuuucgauacagaguaucaaaaaaccaagaacaacgacugggacuacgucgugaccacugauaucucggaaaugggggcaaauuucagggcugaccgcguuaucgauccacguagaugccugaaaccugugauucucaaggacggacccgagcgggucauccuggccgguccaaugccggugacaguagcaucugccgcucagaggcgcggccgaauugggagaaaccauaauaaggaaggagaucaguacauauauaugggccagccucuuaacaaugacgaggaucacgcccacuggaccgaggcgaaaaugcuacuggacaacaucaauacacccgaagguauuaucccagcauuguuugagcccgaacgggagaaguccgccgcuaucgauggggaauacagguuacgcggcgaggccagaaaaacuuucguggagcugaugaggcggggagaccucccuguuuggcugagcuauaaggucgcuucagaaggcuuucaauacagugaucgucgcuggugcuucgacggggagcgaaacaaucaggugcuugaagagaacauggauguggaaauuuggacgaaagagggagagagaaagaaacugaggccacgguggcucgacgcacgcaccuauucugaccccuuggcccugagagaauuuaaggaguucgcugccgguaggcgguccgucagcggcgaucuaauacuggaaaucgggaagcucccucagcaucuuacacagcgagcacaaaaugcgcuggacaacuuaguuauguugcacaauucagagcagggaggcagagccuaccgccaugcuauggaagagcugccggauacuauugagacccucaugcugcuugcccugaucgcagugcucacaggugggguaaccuuguuuuuccugaguggcaaaggauuaggcaagacuagcauugggcuacugugugugauggcuuccucugcccuccuuuggauggcaagcgucgaaccacacuggaucgccgcuuccauaauccuggaguuuuucuugauggugcugcucauucccgaaccugacaggcagcggacgccccaggauaaccaacuggcguauguugugaucggacuucucuuuaugauucugaccgucgccgcaaaugagauggguuugcuggagacaacuaaaaaggacuuaggcaucgggcacguagcuguggaaaaccaucaccaugccgccaugcuagauguugaccugcacccagcaucagcuuggacccucuacgccguggcgacaaccauaauuacuccuaugaugcgucauacaaucgagaacacgaccgcuaauauuucucuuacugccaucgcaaaccaggccgcuauacugaugggauuggauaaaggcuggcccaucaguaagauggacauuggugucccacugcucgcacuggggugcuacucgcaggugaauccucuuacauuaaccgccgcgguccugaugcucguggcucacuaugccaucauuggcccgggauugcaagcaaaggccaccagagaagcucagaaaaggacagccgcaggcaucaugaagaaccccacuauagaugggauuguugcuaucgaccuggauccagugguauacgacgccaaauucgagaagcagcuaggacagaucaugcugcucauucuuuguacgagccaaauccuguugaugcgcaccacaugggcgcugugcgaauccauaacucucgccaccggcccucugacaaccuuaugggaggguucucccgggaaauuuuggaauacuacgauugcagugucaauggcuaacaucuuccggggaagcuaucuugccggcgcaggucuggcuuucucccucaugaagagucuaggcgggggacgaagaggcacaggggcccagggagagacccugggcgaaaaguggaaaaggcaguugaaucagcugucuaagagcgaguuuaacacuuacaaacgcucagguauuauggaagucgaccgguccgaggccaaggaagggcucaaaagaggagagaccacaaagcacgcgguuagucguggcacugcuaagcuuaggugguucguggagcggaaucuggucaaaccagaagguaaggugaucgauuugggcugugggcgcggaggcuggagcuauuacugcgcagggcugaaaaagguaaccgaggugaaaggauauacaaagggcgguccugggcaugaagagcccauaccgauggccacguacggauggaaccucguuaaauuacacucuggcaaggacguguuuuucaucccaccugaaaagugugauacccugcuuugcgacauuggcgaguccucacccaauccaacuaucgaggaagggcgaacacugagaguccuaaaaaugguggagcccuggcucaggggaaaccaauuuuguauuaagauccugaauccuuacaugccgagcgucguggaaaccuuggagcagaugcagcggaaacaugguggcaugcugguucgcaacccccucucgagaaauucuacucacgagauguauuggguaaguugcgggacaggaaacauuguguccgcugucaauaugaccagcaggaugcuucugaaccgauucacgauggcccaccggaagccaaccuacgaacgugauguggacuuaggcgcagguacaagacauguugccguggagccugaagucgcuaaccuggauaucauagggcagcgcauugagaauaucaaacacgaacauaagucaacuuggcacuaugacgaggauaaccccuacaagaccugggcguaucauggauccuacgaggugaaaccuucuggcagcgccaguuccaugguaaauggcgugguuaaguugcucacaaaaccaugggacgucauccccauggugacucaaauugcaaugaccgauacaaccccuuuugggcagcagaggguguucaaggaaaaagucgacacucggacgccaaaggcuaagagaggaacagcccaaauaauggagguuaccgcacgcuggcuguggagcuuucuaucuaggaacaaaaagccccgaaucuguacucgggaagaguucaccagaaaagugaggucaaaugccgcuauuggugccguauuuguggacgaaaaccaguggaauagugcgaaggaggcagucgaggaugaccgcuucugggaucuugugcaccgugaacgggagcugcacaaacagggcaagugcgccacaugcguuuauaacaugauggggaagagagaaaaaaagcucggagaguuuggcaaagcuaaggguuccagggccaucugguacauguggcugggggcacgcuucuuggaauucgaggcucugggauuuaugaaugaggaccauugguucagccgagaaaacucucucucgggcguggagggcgaagggcuucacaaacugggauacauuuuacgggauaucucaaagauaccggguggcaauauguaugccgacgauacggcugggugggacaccagaaucacugaggaugaccugcagaacgaggccaaaauuacagauaucauggaaccugagcaugcauugcucgcgaagagcauuuuuaagcugaccuaccaaaauaaagucgugaggguacagcgcccagccaagaacggaacuguuauggacgugaucuccagacgggaucagaggggcaguggucaggucgggacauauggacuaaauaccuucacaaacauggaagcucaacuuauacgucagauggagucugaagagauuuuuagccccaacgagcuggaaacuccuaaucucgccgagcgagugcuggacugguuggaaaaauacggcguggagcgcuuaaagagaauggcaaucuccggcgacgauugugucguuaaaccaaucgacgaucgguucgcuaccgcccugacggcacucaacgacauggggaaggugaggaaggauauuccccagugggaaccgucaaaaggauggaaugacuggcagcaaguaccuuuuugcagucaccacuuccaucagcuuauaaugaaggauggucgcgagaucgugguccccuguagaaaccaggacgagcuggugggccgggccaggguuucucagggggcgggauggagccuacgagaaaccgcuugccugggcaaauccuaugcccaaauguggcagcucauguacuuucaccguagagauuugcgccuggcagccaaugcuauuuguucagccgugccagucgacugggugccuacaagccggacuaccuggucuauccaugcacaccaucaguggaugacaacugaggauaugcuuuccguauggaacaggguuuggauugaagagaaucccuggauggaagacaagaccagagugaguagcugggaggacgucccauaucuggguaaacgcgaggaucaauggugcgggucgcucaucggauuaacggcucgggccacaugggcgaccaacauacagguggcuaucaaucagguuaggcgacugauuggcaacgaaaauuacuccgacuacaugacuucuaugaagagauucaagaacgagucagaacccgagggcgccuugugguga

SEQ ID NO: 14117 - RNA, 9879 nt, Artificial Sequence
  derived and/or modified CDS sequence (opt3) from DENV-1__HQ891315__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagagcaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggaagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacugaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggaaaaaagaugauucgcccucaacccauggagcacaaauacucguggaagaauuggggcaaggcgaaaaucauaggggccgacgugcagaacagcacuuuuaucauugauggaccaaauaccccugaauguuccgacgaucagagagcuuggaacaucugggaggucgaggacuauggcuucgguauuuuuacaacuaauaucugguugaagcucagggauucauacacccaggugugcgaccaccgucugaugagugcagccauaaaagauucuaaggcuguucaugccgacaugggguauuggauugaaagcgagaaaaacgaaacauggaagcuagcacgggcguccuucaucgaggugaagacguguauuuggcccaaaucacacacccuguggagcaauggaguacucgaaucugagaugaucauaccaaagaucuacggcggucccauuucccaacauaacuaucgaccuggcuacuucacucagacagccgggccauggcaccugggaaaacuugaguuggauuuugaccugugcgaaggcaccacugucgugguggaugagcacugcgggaauagaggaccgaguuuaaggacaaccacggucacuggcaagaucauucaugaaugguguugccgcagcuguacccuccccccucugcgguucagaggugaggacgggugcugguacggaauggagaucaggccaguuaaagaaaaggaggaaaaccuugugaagucuauaguauccgcuggcucaggugagguggacaguuuuagccugggcuugcucuguauuucgaucaugaucgaagaggucaugcgcucccgauggucucggaaaaugcugaugacagggacccuagccguguucuuucugcucauuaugggacagcugacuuggaaugaucuuauccguuugugcauuaugguuggcgcaaacgcuagcgacagaauggggaugggaacaaccuaucuggccuuaauggcaacauucaagaugaggcccauguuugccgugggccuccuguuccgccggcuuacuucaagagagguccugcuacucaccauaggucugaguuugguggcuuccguugaacugccuaauucuuuagaggaacucggggauggacuggcgaugggcaucaugauucuuaaacuguugacggacuuucaaagccaccagcucugggccacacugcuauccaugaccuucaucaagacuaccuuuucacugcauuacgcauggaaaacaauggcuauggugcuuagcauugucagucucuucccacuguguuugucuacuaccucccagaagacgacauggcugcccguauuacucggcagccuggggugcaagccgcuuaccauguuucugaucgccgagaacaaaauauggggaaggaagucguggccuuugaacgaagguaucauggccgugggcauuguuucaauccuccugucuagucuacugaaaaaugaugugccacuugcugggccccucauugcaggaggcaugcugaucgccuguuaugucauauccgguagcucugcggacuugagcuuagagaaggcugccgagguguccugggaagaggaagcagagcacucaggggccagucauaacauucugguagaagugcaggaugacggaacuaugaaaaucaaggaugaggagcgagacgauacacucaccauccugcuuaaagcuacucuguuggcagucagcggcguuuacccucuaucuauucccgccacacuguucgugugguauuucuggcaaaagaagaaacagcgcuccggcgugcucugggacaccccaucaccucccaaggucgaacgggcggugcuggaugacgggauauacagaaucaugcagaggggacuuuuaggucguagucagguuggcguagggguguuucaagagaaugucuuccacacgauguggcacgugacucgcggagcuguucugauguaucagggcaaacggcucgaaccaagcugggccuccgugaagaaagacuugauuucuuacggugggggauggagacugcagggcucguggaacaccggcgaggagguccaggugaucgcaguagaaccggggaagaauccuaagaacguccaaacagcccccggaaccuuuaaaacaccagagggugaagugggcgcuauugcccucgauuucaagcccgggacuagcggaucaccuaucguuaauagggagggcaaaauagugggucuguacgggaacggagucgugaccacguccggcacauauguuagugcaaucgcucaggccaaggcgucucaggaaggcccacuucccgagauugaggacgaaguguuucgaaaacggaaucugacuaucauggauuugcauccugggagcggaaagacccgcagauaccuaccggccauugucagggaggcaaucaagcggaaaaugcgaacacugauacucgcuccaaccagagugguagccuccgaaauggcugaggcauuaaaggguaugcccauucgcuaucaaacuaccgccgugaaaucagaacacacaggcaaggagaucguugaccugaugugccaugccacguucacuaugaggcuucugucuccuguccgugugccaaacuacaauaugaucauuauggaugaggcucacuuuaccgaccccagcaguaucgcggcacggggguauauauccacaagagugggaaugggcgaagccgcugccauuuucaugaccgcaacuccuccggguagcgucgaggccuuuccccagucuaacgcuguaauccaggaugaagagagggacauuccagaacgcucauggaauuccggguacgaguggaucacagauuucccuggaaaaaccgugugguuuguucccaguauaaaggcgggcaacgacauugccaauugucuccgaaagaacggcaaaagagugauccaguugagccggaagacguucgauacugaguaucaaaaaacaaagaacaaugacugggacuacgucgugaccaccgauaucucggaaaugggggcaaacuucagggcugaccgcguuauugauccacguagaugccugaaaccugugauccucaaggacggacccgagcgggucauucuggccgguccaaugccggugacuguagcaucugccgcucagaggcgcggccgaauagggagaaaucauaacaaggaaggagaucaguacaucuauaugggccagccucuuaauaacgacgaggaucacgcccacuggacagaggcgaaaaugcuacuggacaauauuaacacccccgaagguaucaucccagcauuguuugagcccgaacgggagaaguccgccgcuauugauggggaauacagguuacgcggcgaggccagaaaaacauucguggagcugaugaggcggggagaccucccuguuuggcugagcuauaaggucgcuucagaaggcuuucaauacagugaucgucgcuggugcuucgacggggagcgaaauaaccaggugcuugaagagaauauggauguggaaauauggacuaaagagggagagagaaagaaacugaggccacgguggcucgacgcacgcacguauucugaccccuuggcccugagagaauuuaaggaguucgcugccgguaggcgguccgucagcggcgaucuaauccuggaaauugggaagcucccucagcaucuuacccagcgagcacaaaacgcgcuggacaauuuaguuauguugcacaacucagagcagggaggcagagccuaccgccaugcuauggaagagcugccggauacaaucgagacucucaugcugcuugcccugauugcagugcucaccggugggguaacauuguuuuuccugaguggcaaaggauuaggcaagaccagcaucgggcuacugugugugauggcuuccucugcccuccuuuggauggcaagcgucgaaccacacuggauagccgcuuccaucauucuggaguuuuucuugauggugcugcucauccccgaaccugacaggcagcggacuccccaggauaaucaacuggcguauguugugauuggacuucucuuuaugauccugacggucgccgcaaacgagauggguuugcuggagaccacaaaaaaggacuuaggcauagggcacguagcuguggaaaaccaucaccaugccgccaugcuagauguugaccugcacccagcaucagcuuggacucucuacgccguggcgaccacaauuaucaccccuaugaugcgucauacuauugagaauacaacggcuaacaucucucuuaccgccauagcaaaucaggccgcuauccugaugggauuggauaaaggcuggcccauuaguaagauggacaucggugucccacugcucgcacuggggugcuacucgcaggugaacccucuuacuuuaacagccgcgguccugaugcucguggcucacuaugccauuaucggcccgggauugcaagcaaaggccaccagagaagcucagaaaaggaccgccgcaggcauaaugaagaaucccacaauugaugggaucguugcuaucgaccuggauccagugguauacgacgccaaauucgagaagcagcuaggacagauuaugcugcucauccuuuguacuagccaaauacuguugaugcgcacgaccugggcgcugugcgaauccauuacacucgccacuggcccucugaccacauuaugggaggguucucccgggaaauuuuggaacaccacuaucgcagugucaauggcuaauauuuuccggggaagcuaucuugccggcgcaggucuggcuuucucccucaugaagagucuaggcgggggacgaagaggcacgggggcccagggagagacacugggcgaaaaguggaaaaggcaguugaaccagcugucuaagagcgaguuuaauaccuacaaacgcucagguaucauggaagucgaccgguccgaggccaaggaagggcucaaaagaggagagacuaccaagcacgcgguuagucguggcacagcuaagcuuaggugguucguggagcggaaccuggucaaaccagaagguaaggugauagauuugggcugugggcgcggaggcuggagcuauuacugcgcagggcugaaaaagguaacugaggugaaaggauauaccaagggcgguccugggcaugaagagcccaucccgauggccacauacggauggaaucucguuaaauuacacucuggcaaggacguguuuuucauuccaccugaaaagugugauacgcugcuuugcgacaucggcgaguccucacccaacccaaccauugaggaagggcgaacucugagaguccuaaaaaugguggagcccuggcucaggggaaaucaauuuuguaucaagauucugaacccuuacaugccgagcgucguggaaacauuggagcagaugcagcggaaacaugguggcaugcugguucgcaauccccucucgagaaacucuacccacgagauguauuggguaaguugcgggacuggaaauaucguguccgcugucaacaugacaagcaggaugcuucugaaccgauucaccauggcccaccggaagccaacguacgaacgugauguggacuuaggcgcagguaccagacauguugccguggagccugaagucgcuaaucuggauauaauugggcagcgcaucgagaacaucaaacacgaacauaagucaacauggcacuaugacgaggauaaucccuacaagacuugggcguaucauggauccuacgaggugaaaccuucuggcagcgccaguuccaugguaaacggcgugguuaaguugcucaccaaaccaugggacgucauucccauggugacacaaauagcaaugacugauaccacaccuuuugggcagcagaggguguucaaggaaaaagucgacacccggacuccaaaggcuaagagaggaacggcccaaaucauggagguuacagcacgcuggcuguggagcuuucuaucuaggaauaaaaagccccgaauuuguacccgggaagaguucacuagaaaagugaggucaaacgccgcuaucggugccguauuuguggacgaaaaucaguggaacagugcgaaggaggcagucgaggaugaccgcuucugggaucuugugcaccgugaacgggagcugcacaaacagggcaagugcgccaccugcguuuauaauaugauggggaagagagaaaaaaagcucggagaguuuggcaaagcuaaggguuccagggccauuugguacauguggcugggggcacgcuucuuggaauucgaggcucugggauuuaugaacgaggaccauugguucagccgagaaaauucucucucgggcguggagggcgaagggcuucacaaacugggauacaucuuacgggauauaucaaagaucccggguggcaacauguaugccgacgauacagcugggugggacacgagaauuaccgaggaugaccugcagaaugaggccaaaaucacugauauuauggaaccugagcaugcauugcucgcgaagagcaucuuuaagcugacauaccaaaacaaagucgugaggguacagcgcccagccaagaauggaaccguuauggacgugauauccagacgggaucagaggggcaguggucaggucgggacuuauggacuaaacacauucaccaacauggaagcucaacuuauucgucagauggagucugaagagaucuuuagccccaaugagcuggaaacaccuaaccucgccgagcgagugcuggacugguuggaaaaauacggcguggagcgcuuaaagagaauggcaaucuccggcgacgauugugucguuaaaccaauugacgaucgguucgcuacugcccugaccgcacucaaugacauggggaaggugaggaaggauauaccccagugggaaccgucaaaaggauggaacgacuggcagcaaguaccuuuuugcagucaccacuuccaucagcuuaucaugaaggauggucgcgagauugugguccccuguagaaaucaggacgagcuggugggccgggccaggguuucucagggggcgggauggagccuacgagaaacggcuugccugggcaaauccuaugcccaaauguggcagcucauguacuuucaccguagagauuugcgccuggcagccaacgcuaucuguucagccgugccagucgacugggugccuaccagccggacaacuuggucuauucaugcacaccaucaguggaugaccacagaggauaugcuuuccguauggaauaggguuuggaucgaagagaaccccuggauggaagacaagacuagagugaguagcugggaggacgucccauaucuggguaaacgcgaggaucaauggugcgggucgcucauaggauuaaccgcucgggccacgugggcgacaaauauccagguggcuauuaaccagguuaggcgacugaucggcaaugaaaacuacuccgacuacaugaccucuaugaagagauucaagaaugagucagaacccgagggcgccuugugguga

SEQ ID NO: 14118 - RNA, 9879 nt, Artificial Sequence
  derived and/or modified CDS sequence (opt3) from DENV-1__HQ891316__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagagcaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggaagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacugaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggaaaaaagaugauucgcccucaacccauggagcacaaauacucguggaagaauuggggcaaggcgaaaaucauaggggccgacgugcagaacagcacuuuuaucauugauggaccaaauaccccugaauguuccgacgaucagagagcuuggaacaucugggaggucgaggacuauggcuucgguauuuuuacaacuaauaucugguugaagcucagggauucauacacccaggugugcgaccaccgucugaugagugcagccauaaaagauucuaaggcuguucaugccgacaugggguauuggauugaaagcgagaaaaacgaaacauggaagcuagcacgggcguccuucaucgaggugaagacguguauuuggcccaaaucacacacccuguggagcaauggaguacucgaaucugagaugaucauaccaaagaucuacggcggucccauuucccaacauaacuaucgaccuggcuacuucacucagacagccgggccauggcaccugggaaaacuugaguuggauuuugaccugugcgaaggcaccacugucgugguggaugagcacugcgggaauagaggaccgaguuuaaggacaaccacggucacuggcaagaucauucaugaaugguguugccgcagcuguacccuccccccucugcgguucagaggugaggacgggugcugguacggaauggagaucaggccaguuaaagaaaaggaggaaaaccuugugaagucuaugguauccgcuggcucaggugagguggacaguuuuagccugggcuugcucuguauaucgauuaugaucgaagaggucaugcgcucccgauggucucggaaaaugcugaugacagggacccuagccguguucuuucugcucaucaugggacagcugacuuggaaugaucuuauucguuugugcaucaugguuggcgcaaacgcuagcgacagaauggggaugggaacaaccuaucuggccuuaauggcaacauucaagaugaggcccauguuugccgugggccuccuguuccgccggcuuacuucaagagagguccugcuacucaccauuggucugaguuugguggcuuccguugaacugccuaauucuuuagaggaacucggggauggacuggcgaugggcauaaugauccuuaaacuguugacggacuuucaaagccaccagcucugggccacacugcuauccaugaccuucauuaagacuaccuuuucacugcauuacgcauggaaaacaauggcuauggugcuuagcaucgucagucucuucccacuguguuugucuacuaccucccagaagacgacauggcugcccguauuacucggcagccuggggugcaagccgcuuaccauguuucugauugccgagaacaaaaucuggggaaggaagucguggccuuugaacgaagguauaauggccgugggcaucguuucaauucuccugucuagucuacugaaaaaugaugugccacuugcugggccccucaucgcaggaggcaugcugauugccuguuaugucaucuccgguagcucugcggacuugagcuuagagaaggcugccgagguguccugggaagaggaagcagagcacucaggggccagucauaacauacugguagaagugcaggaugacggaacuaugaaaauuaaggaugaggagcgagacgauacacucaccauccugcuuaaagcuacucuguuggcagucagcggcguuuacccucuaucuauccccgccacacuguucgugugguauuucuggcaaaagaagaaacagcgcuccggcgugcucugggacaccccaucaccucccaaggucgaacgggcggugcuggaugacgggauuuacagaauaaugcagaggggacuuuuaggucguagucagguuggcguagggguguuucaagagaaugucuuccacacgauguggcacgugacucgcggagcuguucugauguaucagggcaaacggcucgaaccaagcugggccuccgugaagaaagacuugaucucuuacggugggggauggagacugcagggcucguggaacaccggcgaggagguccaggugauugcaguagaaccggggaagaauccuaagaacguccaaacagcccccggaaccuuuaaaacaccagagggugaagugggcgcuaucgcccucgauuucaagcccgggacuagcggaucaccuauuguuaauagggagggcaaaaucgugggucuguacgggaacggagucgugaccacguccggcacauauguuagugcaauagcucaggccaaggcgucucaggaaggcccacuucccgagaucgaggacgaaguguuucgaaaacggaaucugacuauuauggauuugcauccugggagcggaaagacccgcagauaccuaccggccaucgucagggaggcaauuaagcggaaaaugcgaacacugauccucgcuccaaccagagugguagccuccgaaauggcugaggcauuaaaggguaugcccauacgcuaucaaacuaccgccgugaaaucagaacacacaggcaaggagauuguugaccugaugugccaugccacguucacuaugaggcuucugucuccuguccgugugccaaacuacaauaugaucaucauggaugaggcucacuuuaccgaccccagcaguauugcggcacggggguauaucuccacaagagugggaaugggcgaagccgcugccauauucaugaccgcaacuccuccggguagcgucgaggccuuuccccagucuaacgcuguaauucaggaugaagagagggacaucccagaacgcucauggaauuccggguacgaguggauuacagauuucccuggaaaaaccgugugguuuguucccaguaucaaggcgggcaacgacauagccaauugucuccgaaagaacggcaaaagagugauucaguugagccggaagacguucgauacugaguaucaaaaaacaaagaacaaugacugggacuacgucgugaccaccgauaucucggaaaugggggcaaacuucagggcugaccgcguuaucgauccacguagaugccugaaaccugugauucucaaggacggacccgagcgggucauccuggccgguccaaugccggugacuguagcaucugccgcucagaggcgcggccgaauugggagaaaucauaacaaggaaggagaucaguacauauauaugggccagccucuuaauaacgacgaggaucacgcccacuggacagaggcgaaaaugcuacuggacaauaucaacacccccgaagguauuaucccagcauuguuugagcccgaacgggagaaguccgccgcuaucgauggggaauacagguuacgcggcgaggccagaaaaacauucguggagcugaugaggcggggagaccucccuguuuggcugagcuauaaggucgcuucagaaggcuuucaauacagugaucgucgcuggugcuucgacggggagcgaaauaaccaggugcuugaagagaauauggauguggaaauuuggacuaaagagggagagagaaagaaacugaggccacgguggcucgacgcacgcacguauucugaccccuuggcccugagagaauuuaaggaguucgcugccgguaggcgguccgucagcggcgaucuaauacuggaaaucgggaagcucccucagcaucuuacccagcgagcacaaaacgcgcuggacaauuuaguuauguugcacaacucagagcagggaggcagagccuaccgccaugcuauggaagagcugccggauacaauugagacucucaugcugcuugcccugaucgcagugcucaccggugggguaacauuguuuuuccugaguggcaaaggauuaggcaagaccagcauugggcuacugugugugauggcuuccucugcccuccuuuggauggcaagcgucgaaccacacuggaucgccgcuuccauaauccuggaguuuuucuugauggugcugcucauucccgaaccugacaggcagcggacuccccaggauaaucaacuggcguauguugugaucggacuucucuuuaugauucugacggucgccgcaaacgagauggguuugcuggagaccacaaaaaaggacuuaggcaucgggcacguagcuguggaaaaccaucaccaugccgccaugcuagauguugaccugcacccagcaucagcuuggacucucuacgccguggcgaccacaauaauuaccccuaugaugcgucauacuaucgagaauacaacggcuaacauuucucuuaccgccaucgcaaaucaggccgcuauacugaugggauuggauaaaggcuggcccaucaguaagauggacauuggugucccacugcucgcacuggggugcuacucgcaggugaacccucuuacuuuaacagccgcgguccugaugcucguggcucacuaugccaucauuggcccgggauugcaagcaaaggccaccagagaagcucagaaaaggaccgccgcaggcaucaugaagaaucccacaauagaugggauuguugcuaucgaccuggauccagugguauacgacgccaaauucgagaagcagcuaggacagaucaugcugcucauucuuuguacuagccaaauccuguugaugcgcacgaccugggcgcugugcgaauccauaacacucgccacuggcccucugaccacauuaugggaggguucucccgggaaauuuuggaacaccacuauugcagugucaauggcuaauaucuuccggggaagcuaucuugccggcgcaggucuggcuuucucccucaugaagagucuaggcgggggacgaagaggcacgggggcccagggagagacacugggcgaaaaguggaaaaggcaguugaaccagcugucuaagagcgaguuuaauaccuacaaacgcucagguauuauggaagucgaccgguccgaggccaaggaagggcucaaaagaggagagacuaccaagcacgcgguuagucguggcacagcuaagcuuaggugguucguggagcggaaccuggucaaaccagaagguaaggugaucgauuugggcugugggcgcggaggcuggagcuauuacugcgcagggcugaaaaagguaacugaggugaaaggauauaccaagggcgguccugggcaugaagagcccauaccgauggccacauacggauggaaucucguuaaauuacacucuggcaaggacguguuuuucaucccaccugaaaagugugauacgcugcuuugcgacauuggcgaguccucacccaacccaaccaucgaggaagggcgaacucugagaguccuaaaaaugguggagcccuggcucaggggaaaucaauuuuguauuaagauccugaacccuuacaugccgagcgucguggaaacauuggagcagaugcagcggaaacaugguggcaugcugguucgcaauccccucucgagaaacucuacccacgagauguauuggguaaguugcgggacuggaaauauuguguccgcugucaacaugacaagcaggaugcuucugaaccgauucaccauggcccaccggaagccaacguacgaacgugauguggacuuaggcgcagguaccagacauguugccguggagccugaagucgcuaaucuggauaucauagggcagcgcauugagaacaucaaacacgaacauaagucaacauggcacuaugacgaggauaaucccuacaagacuugggcguaucauggauccuacgaggugaaaccuucuggcagcgccaguuccaugguaaacggcgugguuaaguugcucaccaaaccaugggacgucauccccauggugacacaaauugcaaugacugauaccacaccuuuugggcagcagaggguguucaaggaaaaagucgacacccggacuccaaaggcuaagagaggaacggcccaaauaauggagguuacagcacgcuggcuguggagcuuucuaucuaggaauaaaaagccccgaaucuguacccgggaagaguucacuagaaaagugaggucaaacgccgcuauuggugccguauuuguggacgaaaaucaguggaacagugcgaaggaggcagucgaggaugaccgcuucugggaucuugugcaccgugaacgggagcugcacaaacagggcaagugcgccaccugcguuuauaauaugauggggaagagagaaaaaaagcucggagaguuuggcaaagcuaaggguuccagggccaucugguacauguggcugggggcacgcuucuuggaauucgaggcucugggauuuaugaacgaggaccauugguucagccgagaaaauucucucucgggcguggagggcgaagggcuucacaaacugggauacauuuuacgggauaucucaaagauaccggguggcaacauguaugccgacgauacagcugggugggacacgagaaucaccgaggaugaccugcagaaugaggccaaaauuacugauaucauggaaccugagcaugcauugcucgcgaagagcauuuuuaagcugacauaccaaaacaaagucgugaggguacagcgcccagccaagaauggaaccguuauggacgugaucuccagacgggaucagaggggcaguggucaggucgggacuuauggacuaaacacauucaccaacauggaagcucaacuuauacgucagauggagucugaagagauuuuuagccccaaugagcuggaaacaccuaaccucgccgagcgagugcuggacugguuggaaaaauacggcguggagcgcuuaaagagaauggcaaucuccggcgacgauugugucguuaaaccaaucgacgaucgguucgcuacugcccugaccgcacucaaugacauggggaaggugaggaaggauauuccccagugggaaccgucaaaaggauggaacgacuggcagcaaguaccuuuuugcagucaccacuuccaucagcuuauaaugaaggauggucgcgagaucgugguccccuguagaaaucaggacgagcuggugggccgggccaggguuucucagggggcgggauggagccuacgagaaacggcuugccugggcaaauccuaugcccaaauguggcagcucauguacuuucaccguagagauuugcgccuggcagccaacgcuauuuguucagccgugccagucgacugggugccuaccagccggacaacuuggucuauccaugcacaccaucaguggaugaccacagaggauaugcuuuccguauggaauaggguuuggauugaagagaaccccuggauggaagacaagacuagagugaguagcugggaggacgucccauaucuggguaaacgcgaggaucaauggugcgggucgcucaucggauuaaccgcucgggccacgugggcgacaaauauacagguggcuaucaaccagguuaggcgacugauuggcaaugaaaacuacuccgacuacaugaccucuaugaagagauucaagaaugagucagaacccgagggcgccuugugguga

SEQ ID NO: 14119 - RNA, 9879 nt, Artificial Sequence
  derived and/or modified CDS sequence (opt3) from DENV-1__JN054256__SS-prME
agcgugaccaugcugcucaugcuuaugcccacagcccuggcuuuccacuugacuacgagagagggcgaaccucauaugaucgucuccaagcaggagagggggaaaucuuuacuguuuaagaccucagcaggaguuaacaugugcacacuaauugccauggaccucggugaacugugugaggauacuaugaccuacaaaugcccacggauaacagaagcggagccggacgauguggacuguuggugcaaugcuaccgauacuuggguaacauauggcaccuguagucaaacgggggagcaccgccgagacaagcguagcguggcccuugcaccccaugucggacugggcuuggaaacuagaaccgagacauggauguccucugaaggugccuggaaacagauccagaggguggagacuugggcucuccggcacccuggguucaccguuauugcacuguuucuggcccaugcuaucggaacaucgauuacccagaagggcaucauauucauccucuuaaugcuggugacgccaucaauggccaugcgcugcgucggcauugggagcagagauuuuguggagggacuuaguggugcgacuuggguagacguuguguuggaacacggcuccugugucacaaccauggcaaaggauaaacccacucuggacaucgagcuacucaagacagaagugaccaacccugccgugcugaggaaacuuugcauugaggcuaagaucucuaauacgaccacagauagccgguguccaacucaaggggaagccacccuggucgaggagcaggacgcaaacuucguuugccgccgaacauuuguggauagaggauggggcaaugguuguggguuguucggaaaaggcucccuccugacuugcgcuaaguuuaagugcguaaccaaauuagaaggcaagauagugcaguacgagaaccugaaauauucagucauugugacaguucacaccggggaccagcaucaagugggaaaugaaaguacugagcacgguacgacagccaccaucacuccccaggcgccuaccacagaaauucagcucaccgacuacggcgcccuuacucuggauuguagcccaaggacaggguuggacuucacggagaugguccuacugaccaugaaggagaaaucuuggcucgugcauaagcagugguuucuggaucuuccgcugcccuggacuuccggagcaucaacaagccaagaaaccuggaaccggcaggacuugcucguaacauucaaaacugcucacgccaagaagcaggagguugugguccugggcagucaagaaggugcuaugcacaccgccuuaacgggggcaaccgagauccagacaucuggcacuaccacaaucuuugccggacaucugaaaugccgucuaaagauggauaaacucacucugaagggcauguccuaugugauguguaccgggagcuucaaacuugaaaaggaggucgcugagacgcagcacggaacaguguugguucagauuaaguacgaagguaccgacgcgccuugcaaaauaccauucucgacucaagaugagaagggcgugacacagaaugggcgccugaucaccgcaaaccccauuguaacugacaaagaaaagccugucaauaucgaggccgagccacccuuuggagaaucuuauauagugauuggcgcuggugagaaagcccucaagcuguccugguucaagaaagggucaaguaucggcaagauguuugaagcaaccgccagaggagcuaggcggauggccauccuuggcgauacagcaugggacuucgggagcauuggagguguuuuuacguccgugggcaaacugguccaucagaucuucgggaccgcguacggaguguuguuuucuggcguaagcuggacuaugaagauugguauaggggugcuccugacaugguuaggccugaacucacgaaguaccucccuaagcaugacauguaucgcuguuggacucgucacucuguaccuuggcgugauggugcaggccgauucugggugcgucauuaauuggaaaggacgcgaguugaaguguggcucagguaucuucguuaccaacgaagugcacacguggacagagcaauauaaguuucaggcagacaguccgaaaagacugagcgccgcuaucgggaaggccugggaggaaggagugugcggcauuagguccgcaacccggcucgagaauauaauguggaaacagaucucuaacgaacugaaccauauuuuacuggagaaugacaugaagcuuacuguagucgugggugauguugcuggcaucuuggcccaggggaaaaagaugauucgcccucaacccauggaacacaaauacucguggaagaacuggggaaaggcgaaaaucauaggcgccgacgugcagaauagcaccuucaucauugaugggccaaacacaccugaguguuccgacgaucagagagcuuggaauaucugggaggucgaagacuauggauuuggcauuuucacuaccaacaucuggcucaagcugagggauucauacacacaggugugcgaccaccgucuaaugagugcagccauaaaagauucuaaggcuguucaugccgacauggguuauuggauugagagcgaaaaaaaugagacguggaagcuggcacgggcguccuuuaucgaagugaagaccuguauuuggcccaaaucacacacucucuggagcaacgggguacuggagucugagaugaucauaccaaagaucuacggaggccccauuucccaacauaauuaucgaccugguuacuucacacagaccgccggcccauggcaccuugggaaauuggaacuggauuucgacuuaugcgagggaacuacagucgugguggaugaacacugcggcaacagagggccgagucucaggaccacgacugucaccggaaagaucauucaugagugguguugccgcagcuguacacugcccccucuucgguuuagaggcgaggacgguugcugguacgggauggaaaucaggccaguuaaagagaaggaagagaaucuggugaagucuaugguauccgcuggaucaggcgaaguggacaguuucagcuugggucuccuguguauaucgauuaugaucgaggaggucaugcgcucccgauggucucggaaaaugcuaaugaccggcacucuggccguguuuuuccuccugaucauggggcagcuuacauggaacgauuugauucgucugugcaucaugguuggagcaaaugcuagcgacagaaugggcauggggaccacauauuuagcccucauggcaacuuuuaagaugaggcccauguucgccgugggacugcuuuuucgccggcugaccucaagagaaguccuacuccugacgauuggcuugagucugguggcuuccguugaguuaccuaacucucucgaagagcugggugaugggcuugcgaugggaauaaugauccugaaauugcucauugacuuccaaagccaccagcugugggccacacuacuguccaugaccuuuaucaagacuaccuucucacuucauuacgcauggaaaacaauggcuauggugcucagcauugucagucuguuuccauugugucugucuacuaccucccagaagacgacaugguuacccguacuccugggcagccuuggcugcaagccgcugaccauguucuugaucgccgaaaauaaaauaugggggaggaagucguggccucucaacgagggaaucauggccguggguauuguuucaauccugcuaucuagucugcuuaaaaacgaugugccacucgcuggcccccugauugcagggggaauguugaucgccuguuaugucauauccggcagcucugcggacuuaagccuggagaaggcugccgaaguguccugggaggaagaggcagaacacucaggugccagucauaauauucucguagaggugcaggaugacgggacuaugaaaaucaaggaugaggaacgagacgauacacugaccauccuucugaaagcuacuuugcuagcagucagcggaguuuacccucugucuauucccgccacacucuuugugugguauuucuggcaaaagaagaaacagcgcuccggcgugcugugggacaccccaucaccucccaaggucgagcgggcggugcuugaugacggcauauacagaaucaugcagaggggguuacugggacguagucagguugguguaggcguguuccaagaaaacgucuuucacacgauguggcacgugacucgcggggcuguucucauguaucagggaaaacgguuggagccaagcugggccuccgugaagaaagaccugauuucuuacggcgguggguggagacuccagggaucguggaauaccggcgaggaaguccaggugaucgcaguagagccgggcaagaacccuaagaauguccaaacagcccccgggaccuucaaaacaccagaaggagaggugggugcuauugcccuggauuuuaagcccggcacuagcgggucaccuaucguuaacagggaaggaaaaauagugggccuuuacgguaauggggucgugaccacguccggaacauauguuagugcaaucgcucaggccaaggcgucucaggagggcccacugcccgagauugaagacgagguguuccgaaaacggaacuugacuaucauggaucuacauccuggcagcgggaagacccgcagauaccugccggccauugucagggaagcaaucaagcggaaaaugcgaacacucauauuagcuccaaccagagugguagccuccgagauggcugaagcacugaagggaaugcccauucgcuaucaaacuaccgccgugaaaucagagcacacagguaaggagaucguugaccuuaugugccaugccacguuuacuaugaggcugcucucuccuguccgugugccaaauuacaacaugaucauuauggaugaagcucacuucaccgaccccagcaguaucgcggcacggggcuauauauccacaagaguggggaugggagaggccgcugccauuuuuaugaccgcaacuccuccgggcagcgucgaagccuucccccagucuaaugcuguaauccaggaugaggaaagggacauuccagagcgcucauggaacuccgguuacgaguggaucacagauuuuccugggaaaaccgugugguucguucccaguauaaaggcgggaaaugacauugccaacuguuugcgaaagaauggcaaaagagugauccagcugagccggaagacguuugauacugaauaucaaaaaacaaagaacaacgacugggacuacgucgugaccaccgauaucucggagaugggcgcaaauuucagggcugaccgcguuauugauccacguagaugccucaaaccugugauccugaaggacgggcccgaacgggucauucuugccggaccaaugccggugacuguagcaucugccgcucagaggcgcggucgaauaggcagaaaccauaauaaggagggggaucaguacaucuauaugggacagccucuaaacaaugacgaggaucacgcccacuggacagaagcgaaaaugcuguuggacaacauuaauacccccgagggcaucaucccagcauuauucgaacccgagcgggaaaaguccgccgcuauugauggugaguacaggcugcgcggggaggccagaaaaacauuuguggaacucaugaggcggggcgaccugccuguuuggcuuagcuauaaggucgcuucagagggauuccaauacagugaucgucgcuggugcuuugacggcgaacgaaacaaucaggugcuggaggaaaacauggauguggagauauggacuaaagagggggaaagaaagaaacucaggccacggugguuggacgcacgcacguauucugacccccuggcccuaagagaguucaaggaauuugcugccggaaggcgguccgucagcggugaucugauccucgagauuggcaagcuuccucagcaucugacccagcgagcacaaaaugcguuagacaacuugguuaugcugcacaauucagaacaggggggaagagccuaccgccaugcuauggaggagcucccggauacaaucgaaacucugaugcuucuggcccucauugcaguguugaccggcgguguaacacuguucuuuuuaagugggaaaggccuaggaaagaccagcaucggccugcucugugugauggcuuccucugcccuucuguggauggcaagcgucgagccacacuggauagccgcuuccaucauuuuggaauucuuucugauggugcuccugauccccgagccugacaggcagcggacuccccaggauaaccaacuugcguauguugugauugggcuccuguucaugaucuugacggucgccgcaaaugagaugggacuguuagaaaccacaaaaaaggaccuagguauaggccacguagcuguggagaaccaucaccaugccgccaugcuggauguugaccuccacccagcaucagcuuggacucuuuacgccguggcgaccacaauuaucaccccuaugaugcgucauacuauugaaaacacaacggcuaauaucucucugaccgccauagcaaaccaggccgcuaucuugauggggcuggauaaaggauggcccauuaguaagauggacaucggcgucccacuccuggcacuugguugcuacucgcaggugaauccuuuaacucugacagccgcgguccucauguugguggcucacuaugccauuaucgggccgggccugcaagcaaaggccaccagagaggcucagaaaaggaccgccgcaggaauaaugaagaaccccacaauugauggcaucguugcuaucgaccuagauccagugguauacgacgccaaauuugaaaagcagcuggggcagauuaugcuccuuauccuguguacuagccaaauauugcugaugcgcacgaccugggcgcucugcgaguccauuacacuggccacuggaccuuuaaccacacuuugggagggcucucccgguaaauucuggaauaccacuaucgcagugucaauggcuaacauuuuucgggggagcuaucuggccggagcaggccucgcuuucucccuaaugaagagucuggguggcgggcgaagaggaacgggcgcccagggggaaacauugggagagaaguggaaaaggcagcugaaucagcucucuaagagcgaauucaacaccuacaaacgcucaggcaucauggaggucgaccgguccgaagccaaggagggucuuaaaagaggggagacuaccaagcacgcgguuagucguggaacagcuaagcugaggugguuuguggaacggaauuuggucaaaccagagggcaaggugauagaucuggguuguggccgcgggggauggagcuauuacugcgcaggccucaaaaagguaacugaagugaaaggguauaccaagggaggcccuggucaugaggaacccaucccgauggccacauacggguggaacuuaguuaaacugcacucuggaaaggacguguucuuuauuccaccugagaagugugauacgcuucugugcgacaucggcgaguccucacccaauccaaccauugaagagggccgaacucuaagaguccucaaaaugguggaacccuggcugagggggaaccaauucuguaucaagauuuugaauccuuacaugccgagcgucguggagacacuggagcagaugcagcggaaacauggagguaugcucguucgcaacccccuuucgagaaauucuacccacgaaauguauuggguaaguugcggcacugggaacaucguguccgcugucaauaugacaagcaggaugcuguuaaaccgauuuaccauggcccaccggaagccaacguacgagcgugauguggaccugggagcaggcaccagacauguugccguggaaccugaggucgcuaacuuggauauaauuggucagcgcaucgaaaauaucaaacacgagcauaagucaacauggcacuaugacgaggauaaccccuacaagacuugggcguaucauggguccuacgaagugaaaccuucuggaagcgccaguuccaugguaaauggcgugguuaagcuccugaccaaaccaugggacgucauucccauggugacacaaauagcaaugacugauaccacaccuuucggccagcagaggguguuuaaggagaaagucgacacccggacuccaaaggcuaagagagggacggcccaaaucauggaaguuacagcacgcuggcuauggagcuuccuuucuaggaacaaaaagccccgaauuuguacccgggaggaauuuacuagaaaagugaggucaaaugccgcuaucggagccguauucguggacgagaaccaguggaauagugcgaaggaggcagucgaagaugaccgcuuuugggaucuggugcaccgugagcgggaacuccacaaacaggguaagugcgccaccugcguuuauaacaugaugggcaagagagagaaaaagcugggggaauucggaaaagcuaagggcuccagggccauuugguacaugugguugggugcacgcuuucuggaguucgaggcucucggguucaugaaugaagaccauugguuuagccgagagaacucucuuucgggaguggaaggcgagggccugcacaaauuaggguacauccugcgggauauaucaaagaucccgggagguaauauguaugccgacgauacagcuggcugggacacgagaauuaccgaggaugacuugcagaacgaagccaaaaucacugauauuauggagccugaacaugcacuccuggcgaagagcaucuucaagcuaacauaccaaaauaaagucgugaggguacagcgcccagccaagaacgggaccguuauggacgugauauccagacgggaucagaggggaaguggccaggucgguacuuaugggcuuaauacauuuaccaacauggaggcucaacugauucgucagauggaaucugaggagaucuucagccccaacgaacucgagacaccuaaucuggccgaacgaguguuggacugguuagagaaauacggaguggaacgccugaagagaauggcaaucuccggcgacgauugugucguuaaaccaauugacgaucgguuugcuacugcccucaccgcacuuaacgacaugggcaaggugaggaaggauauaccccagugggagccgucaaaaggguggaaugacuggcagcaaguaccuuucugcagucaccacuuucaucagcugaucaugaaggauggacgcgagauugugguccccuguagaaaccaggacgaacuagugggucgggccaggguuucucagggcgcgggguggagccugcgagagacggcuugccucggaaaauccuaugcccaaauguggcaguugauguacuuccaccguagagaucugcgccuugcagccaaugcuaucuguucagccgugccagucgacugggugccuaccagccggacaacuuggucuauucaugcacaccaucaguggaugaccacagaagauaugcuguccguauggaacaggguuuggaucgaggaaaaucccuggauggaggacaagacuagagugaguagcugggaggacgucccauaucucggcaaacgcgaagaucaauggugcgguucguuaauagggcugaccgcucgggccacgugggcgacaaacauccagguggcuauuaaucagguuaggcgauugaucggaaacgagaauuacuccgacuacaugaccucuaugaagagauuuaagaacgaaucagagcccgagggcgcccugugguga

SEQ ID NO: 14120 - RNA, 9879 nt, Artificial Sequence
  derived and/or modified CDS sequence (opt3) from DENV-1__JN054255__SS-prME
agcgugaccaugcugcucaugcuuaugcccaccgcacuggcuuuccacuugacuacgcgaggaggggagccucauaugaucgucuccaagcaggaaaggggaaaaucuuuacuguuuaagaccucagccgguguuaauaugugcacacucauugccauggaccucggagagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguugacguuguguuggagcacggguccugugucacaaccauggcaaaggauaaacccacucuggacaucgaacugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaugucuggaaccacaacuaucuuugccggccaucugaaaugccgucuaaagauggauaaacucacccugaaggggauguccuaugugauguguacaggcagcuucaaacuugagaaggaagucgcugagacucagcacgguaccguguugguucagauuaaguacgagggcacggacgcgccuugcaaaauaccauucucgacacaagaugaaaagggggugacccagaacggacgccugaucacugcaaaucccauuguaacagacaaagagaagccugucaacaucgaagccgagccacccuuuggcgagucuuauauagugauuggugcuggggaaaaagcccucaagcuguccugguucaagaaaggcucaaguaucggaaagauguuugaggcaaccgccagaggcgcuaggcggauggccauccuuggggauacugcaugggacuucggaagcauugguggcguuuuuaccuccguggggaaacugguccaucagaucuucggaacagcguacggcguguuguuuucugguguaagcuggacgaugaagauugggauaggcgugcuccugaccugguuaggacuaaauucacgaaguacuucccuaagcaugacauguaucgcuguuggccucgucacccuguaccuuggggugauggugcaggccgauucuggaugcgucauuaacuggaaaggccgcgaauugaagugugguucagggaucuucguuacaaaugaggugcacacuuggaccgaacaauauaaguuucaggcagacaguccgaaaagacugagcgccgcuaucggaaaggccugggaggagggcgugugcgguauuagguccgcaacgcggcucgaaaacauaauguggaaacagaucucuaacgagcugaaucauauuuuacuggaaaacgacaugaaguucacaguagucgugggcgauguugcugggauccuugcccagggcaaaaagaugauucgcccucaacccauggagcacaaauacucguggaagaauuggggcaaggcgaaaaucauaggggccgacgugcagaacagcaccuuuaucauugauggaccaaauacuccugaauguuccgacgaucagagagcuuggaacaucugggaggucgaggacuauggcuucgguauuuuuaccacaaauaucugguugaagcucagggauucauacacucaggugugcgaccaccgucugaugagugcagccauaaaagauucuaaggcuguucaugccgacaugggguauuggauugaaagcgagaaaaacgaaaccuggaagcuagcacgggcguccuucaucgaggugaagacauguauuuggcccaaaucacacacgcuguggagcaauggaguacucgaaucugagaugaucauaccaaagaucuacggcggucccauuucccaacauaacuaucgaccuggcuacuucacccagacugccgggccauggcaccugggaaaacuugaguuggauuuugaccugugcgaaggcacaaccgucgugguggaugagcacugcgggaauagaggaccgaguuuaaggacuacaaccgucacgggcaagaucauucaugaaugguguugccgcagcuguacucuacccccucugcgguucagaggugaggacgggugcugguacggaauggagaucaggccaguuaaagaaaaggaggaaaaccuugugaagucuaugguauccgcuggcucaggugagguggacaguuuuagccugggcuugcucuguauaucgauuaugaucgaagaggucaugcgcucccgauggucucggaaaaugcugaugaccgggacacuagccguguucuuucugcucaucaugggacagcugaccuggaaugaucuuauucguuugugcaucaugguuggcgcaaacgcuagcgacagaauggggaugggaacuacauaucuggccuuaauggcaaccuucaagaugaggcccauguuugccgugggccuccuguuccgccggcuuacaucaagagagguccugcuacucacuauuggucugaguuugguggcuuccguugaacugccuaauucuuuagaggaacucggggauggacuggcgaugggcauaaugauccuuaaacuguugaccgacuuucaaagccaccagcucugggccacgcugcuauccaugacauucauuaagaccacuuuuucacugcauuacgcauggaaaaccauggcuauggugcuuagcaucgucagucucuucccacuguguuugucuacaacuucccagaagaccacguggcugcccguauuacucggcagccuggggugcaagccgcuuacaauguuucugauugccgagaacaaaaucuggggaaggaagucguggccuuugaacgaagguauaauggccgugggcaucguuucaauucuccugucuagucuacugaaaaaugaugugccacuugcugggccccucaucgcaggaggcaugcugauugccuguuaugucaucuccgguagcucugcggacuugagcuuagagaaggcugccgagguguccugggaagaggaagcagagcacucaggggccagucauaacauacugguagaagugcaggaugacggaaccaugaaaauuaaggaugaggagcgagacgauacucucacaauccugcuuaaagcuacccuguuggcagucagcggcguuuacccucuaucuauccccgccacucuguucgugugguauuucuggcaaaagaagaaacagcgcuccggcgugcucugggacacaccaucaccucccaaggucgaaaaagcggugcuggaugacgggauuuaccggauaaugcagagaggacuuuuagguaggagucagguuggcguagggguguuucaagagaaugucuuccacaccauguggcacgugacgcguggagcuguucugauguaucagggcaagcgccucgaaccaagcugggccuccgugaaaaaggacuugaucucuuacggugggggauggcggcugcagggcucguggaacacuggcgaggagguccaggugauugcaguagaaccggggaagaauccuaaaaacguccaaaccgcccccggaacauuuaagaccccagagggugaagugggcgcuaucgcccucgauuucaaacccgggacaagcggaucaccuauuguuaauagagagggcaagaucgugggucuguacgggaacggagucgugacuaccuccggcacguauguuaguggcauagcacaggcuaaagccucucaggaagggccacuucccgagaucgaggacgaaguguuuaggaagcgaaaucugacaauuauggauuugcauccuggaagcgguaagacucggcgcuaccuaccggcgaucgucagagaggccauuaaaaggaagaugcggacccugauccucgcaccaacacgagugguagcuuccgaaauggccgaggcuuuaaaaggcaugcccauaagauaucaaaccacugcagugaagucagaacacaccgggaaagagauuguugaccugaugugccaugccacauucacgaugcgccuucugucuccugucagggugccaaacuacaauaugaucaucauggaugaggcccacuuuacugaccccagcaguauugcugcgcguggauauaucuccacccgggugggcaugggugaagcagccgcuauauucaugacagccaccccuccggggagcgucgaggcauuuccccagucuaacgccguaauucaggaugaagagagagacaucccagaaaggucauggaacuccggauacgaguggauuacugauuucccuggcaagacagugugguuuguucccaguaucaaggcuggcaacgacauagcgaauugucuccgcaaaaacgggaagcgagugauucaguugagcagaaaaaccuucgauacggaguaucaaaagacuaaaaacaaugacugggacuacgucgugacaaccgauaucucggaaaugggagccaacuuccgggcagacaggguuaucgauccacgccguugccugaagccugugauucucaaggacggucccgagagagucauccuggcuggcccaaugccggugaccguagccucugcagcccagcggagggggcgcauuggacgaaaucauaacaaagaaggcgaucaguacauauauaugggucagccucuuaauaacgacgagaaucacgcucacuggacugaggccaagaugcuacuggauaacaucaauacacccgaagggauuaucccagcguuguuugagcccgaaagagagaaauccgcagccaucgacggcgaauaccgguuaaggggagaggcucgcaagaccuucguggagcugaugagaaggggcgaucucccuguuuggcugagcuauaaagucgccucagaaggguuucaauacagugaccggcguuggugcuucgauggagagcgcaacaaucaggugcuugaagagaacauggacguggaaauuuggacaaaggagggugagaggaaaaagcugagaccaagauggcucgaugcucggacuuauucugaccccuuggcacugcgcgaauuuaaggaguucgccgcuggcagaagguccgucagcggggaccuaauacuggaaaucggaaaacucccucagcaucuuacgcagcgggcccaaaaugcacuggauaacuuaguuauguugcacaauucagagcagggcggucgagcguacagacaugccauggaggaacugccggacaccauugagacacucaugcugcuugcucugaucgccgugcucacugggggcguaaccuuguuuuuccugaguggaaagggcuuagggaaaacaagcauuggacuacugugugugauggcauccucugcucuccuuuggauggccagcgucgaaccacacuggaucgcagccuccauaauccuggaguuuuucuugauggugcugcucauucccgaaccugaucgccagaggacaccccaggacaaccaacuggcuuauguugugaucggucuucucuuuaugauucugacugucgcggccaacgagaugggcuugcuggagacgaccaagaaagauuuagggaucggacacguagcaguggaaaaucaucaccaugcugccaugcuagacauagaucugcacccagccucagcauggacacucuacgcuguugccacuaccauuaucacaccuaugaugcggcauaccauugagaacacuacagcgaauaucucucuuacggcuauagccaaccaggcagccauccugaugggcuuggacaaggguuggcccauuaguaagauggauaucggggugccacugcucgcucugggcugcuacucgcaggucaauccucuuaccuuaacugcagccgugcugaugcucgucgcgcacuaugcuauuaucggaccgggcuugcaagccaaagcaacacgugaagcccagaagagaaccgcugccgggauaaugaaaaaccccaccauugacggaaucguggcaaucgaucuggacccaguuguguacgaugcuaaguucgagaaacagcuaggccagauuaugcugcucauccuuuguacaagccaaauacuguugaugaggacuacgugggcccugugcgaauccauuacccucgcgacagguccucugacuaccuuaugggaggggucucccggaaaguuuuggaauacaaccaucgccguaucaauggcaaacauuuuccgcggcagcuaucuugcuggugccggccuggcauucucccucaugaagagucuagggggaggccggcgagggacuggagcucagggcgagacgcugggugaaaaauggaagagacaguugaaucagcugucuaaaagcgaguuuaacacauacaagaggucagggaucauggaaguggaccgcuccgaggccaaagaaggacucaagcggggcgagaccacuaagcacgccgucaguagagguaccgcgaaacuucguugguucguugagaggaaucuggugaagccagaaggcaaagucauagacuugggguguggacggggcggguggagcuauuacugcgcuggacugaagaaagugacagagguaaagggcuauacuaaaggugggccuggacaugaggaacccaucccgauggcaaccuacggcuggaaccucgugaaguuacacucuggcaaggauguauuuuucauuccaccugaaaaaugugacacacugcuuugcgauaucggggaguccucacccaauccaacgauugaggaaggacgcacccugcgagugcuaaagauggucgagcccuggcucagagguaaccaauuuuguaucaaaauucugaauccuuacaugccgagcguggucgaaacuuuggagcagaugcagaggaagcauggcgggaugcuggugcggaacccccucucgcgcaauucuacacacgagauguauuggguuaguugcggaaccggcaacaucguauccgccgugaacaugacuagcagaaugcuucugaauagguucacaauggcucaccgaaaaccaaccuacgaacgggacgucgauuuaggugccgggacgcgucauguggcaguugagccugaaguggccaaccuggacauaauuggacagagaaucgagaauaucaagcacgaacauaagucaaccuggcacuaugaugaggacaaccccuacaaaacaugggcuuaucauggcuccuacgaggucaagccuucuggcagcgcgaguuccauggugaaugggaugguaaaauugcucacuaagccaugggaugugauucccaugguuacccaaauagccaugacagacacuaccccuuuuggacagcagcgcgucuucaaagaaaagguggauacaaggaccccaaaggcaaaacgggguacugcucaaaucauggaggugacggccagauggcuguggagcuuucuaucucgcaacaagaaacccaggauuuguacacgagaagaguucacccggaaggucagaucaaaugcagccaucggcgcuguuuuuguggacgaaaaccaguggaauagugccaaagaggcgguagaggacgauagguucugggaccuugugcaccgcgaacgugagcugcacaagcaggggaagugcgcaacuugcgucuauaacaugaugggaaaacgggaaaagaaacucggcgaguuugguaaggccaaaggguccagagcuauuugguacauguggcugggagccagguucuuggaguucgaggcacugggcuuuaugaaugaggaucauugguucagccgcgaaaacucucucucgggcguggagggggaaggacuucacaagcuggguuacaucuuacgagacauaucaaaaaucccgggcgggaauauguaugcugaugacaccgccggaugggauacacggauuacggaggacgaucugcagaacgaggcuaagaucaccgacauuauggaaccugagcaugccuugcucgcaaagagcaucuuuaaacugacuuaccaaaauaagguugugagaguccagaggccauccaaaaacggcacagugauggauguaauaagucgcagagaccagcgggguucugggcagguuggaaccuauggccuaaacacuuucacaaauauggaagcgcaacuuauuaggcagauggagagcgaagagaucuuuucccccaacgagcuggaaaccccuaaucucgccaagcgugugcuggauugguuggagaaauacggcgucgaacgauuaaagcgcauggcuaucucaggggacgacuguguggugaagccaauugaugacagauucgccacagcacugacugcucucaacgauaugggaaaaguccggaaggacauaccccagugggagccgaguaaagguuggaaugauuggcagcaaguuccuuuuugcucucaccacuuccaucagcuuaucaugaaggacggcagggaaauugugguacccugucgcaaccaggaugagcugguggggagagcccgggucagccagggagcaggcuggucccuaagggagaccgccugccuggguaaaucauaugcgcaaauguggcagcucauguacuuucaccgacgugacuugagacuggcugccaaugcaaucuguagcgccgugccaguugauugggugccuacgucucgcaccacaugguccauucaugcucaccaucaguggaugacuaccgaagacaugcuuagugucuggaaccggguguggaucgaggaaaaucccuggauggaggauaagacaaggguaagcucgugggaagacguuccauaucuggggaagagagaggaccaauggugcggaucccucauaggcuuaacugcccgcgcaaccugggcuacgaacauccagguggccauuaaucagguccggaggcugaucggcaacgagaauuacucugauuacaugacaucaaugaaacgauucaagaacgaaagcgagcccgaaggggcguugugguga

SEQ ID NO: 14121 - RNA, 9879 nt, Artificial Sequence
  derived and/or modified CDS sequence (opt3) from DENV-1__KP406801__SS-prME
agcgugaccaugcugcucaugcuucugcccacagcauuggcuuuccacuuaacuacgagaggaggggaaccucauaugaucgucuccaagcaggaaaggggaaagucucuguuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccauacaaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccaaggagaggcuacauuggucgaagaacaggaugccaacuucguuugccgccgaacuuuuguggacagaggcugggguaauggguguggacucuucggcaaaggcagccuguuaaccugcgcaaaguuuaagugcguaacaaaacuggaggggaagauagugcaguacgaaaaccucaaauauuccgucauugugaccguucacacuggagaucagcaucaaguggguaaugagacgacagaacacggcaccaucgcuacuauuacaccccaggccccuacaucagagauccagcuuaccgacuacggggcgcugacuuuggacuguaguccaaggacaggacuagauuucaacgaaaugguccugcucacgaugaaggagaaaagcuggcuggugcauaagcagugguuucuugaccugccguugcccuggaccucuggcgccuccacuucacaagagacauggaaucggcaggaucuccugguaaccuucaaaacagcacacgcuaagaagcaggaaguuguggucuuagguagccaagagggggccaugcacacugcucuggccggcgcaaccgaaauccagaugaguggaacgaccacaauuuuugccggccaucuaaaaugccgucucaagauggacaaacugacucuuaagggggugucuuaugucauguguaccggauccuucaaauuggagaaggaaguggcugagacacagcacgguacuguucuggugcagguaaaguacgagggcaccgaugcgccuugcaaaauaccauucagcauccaagacgaaaagggggucacgcagaacggacgccucauuacagcaaaucccaucgccaccgauaaagagaagccugugaacauagaaacugagccacccuuuggcgagucguauauuguuaucggugcuggggaaaaagcccugaaacuuucuugguucaagaaaggcuccucaaucggaaagauguuugaggcaacagccagaggcgcuaggcggauggccauucugggggacaccgcaugggauuucggaaguaucgguggcguguuuacuagcgucgggaaauuggugcaucagguauucggaaccgcguacggcgugcucuuuuccgguguuucuuggacaaugaagauugggauaggcauccuguuaacguggcugggacuaaauagccgaucaaccagucucuccaugacuuguauugcugucggcauggugacacuguaccuuggggugaugguccaggccgacagcggaugcguuaucaacuggaaaggccgcgaauugaagugugguucugggaucuucgugaccaacgaggugcacacauggacugaacaauauaaguuucaggcagauucaccgaaaagacugagugccgcuauuggaaaggccugggaggagggcguaugcgguauaaggagcgcaacccggcucgaaaauaucauguggaaacagauuuccaacgagcugaaucauaucuuacuggaaaacgacaugaaguucacggucgugguuggcgacgcuaaugggauucuuacacagggcaagaaaaugauccgcccucaacccauggagcacaaauacucuuggaagucguggggcaaggccaaaauaaucggggcggauacccagaacacuaccuuuauuaucgacggaccagauacaccugaaugucccgacgaucagagagccuggaauauuugggagguggaggacuauggcuucgguaucuuuacuaccaacauaugguugaagcucagggauagcuacacacagaugugcgaccaccgucugauguccgcugcaauuaaagauucaaaggccguccaugcugacaugggguauuggaucgaaagugagaaaaaugaaacguggaagcuagcccgggcaucuuucauugaggugaagaccuguaucuggccacgaagccacacucugugguccaacggaguucucgaaucagagaugauaauccccaaaauuuacggcgguccuaucagccaacauaauuauagaccaggcuacuucacacagaccgcggggccguggcaccugggaaaacuugaguuggauuuugaccugugcgaaggcacuacagugguagucgaugagcacugcgggaacaggggacccucuuuacgcaccacgacugugaccggcaaaauuauccaugaaugguguugccgguccuguacacucccuccacugagauucaagggugaggacgggugcugguacggaauggagauaaggcccgugaaagaaaaggaggaaaaucuuguccgcaguaugguuagcgccggcucuggugagguggacuccuuuucacugggcuugcucuguguaaguauuaugaucgaagaggugaugcgaagccgguggucgcguaagaugcugaugaccgggacucuagcugucuucuuucugcucaucaugggacagcugacauggaacgaucuuauuagauugugcaucauggugggcgccaauguuuccgacaggauggggaugggaaccacauaucuggcauuaauggcuacuuucaaaaugcgcccuauguuugccgugggccuccuguuccggagacuuaccucuagggagguccugcuacucacgauuggucugagcuugguggcaucaguugaacugccaaacaguuuagaggaacucggggauggacuggccaugggcauaaugaugcuuaagcuguugacagacuuucaaucccaccagcucuggaccacucugcuaucucugaccuucaucaaaacaacucuuagccucgauuacgcuuggaagaccauugcgauggugcuguccaucgucucauuguuuccccuguguuuaagcacgacaagucagaaaaccacuuggcucccgguacugcuuggcucuuucgggugcaagccucugacaauguuuuugauuaccgagaacaagaucuggggacgacgcuccuggccacucaaugaagguauaauggccgugggcaucguuagcauucugcuaucgucacugcuuaaaaacgacgugccccucgcagggccucugaucgcuggaggcauguugauugccuguuaugucaucucugguaguuccgccgauuuaagccuggagaaggcugcagaggugucuugggaagaggaagccgagcauagcggggcgucccacaauauacucguagaagugcaggacgauggaacuaugaaaauuaaggacgaggagcgggaugacacacugaccauccuucugaaagcuacguugcuagccgucucaggcguuuaccccaugaguaucccagcaacucuguucgugugguauuucuggcaaaagaaaaagcagagaagcggcgugcucugggauaccccuucucccccagaagucgagagggccgugcuggacgacgggauuuaccguauacuucagcgcggauuacugggucggucccagguuggcguagggguguuucaagauggagucuuccauacaauguggcacgugaccagaggcgcuguucucauguaucaggguaagagguuggaaccgucaugggcaagugugaaaaaggaccugaucagcuacgggggaggcuggcgauuucagggcuccuggaacacaggggaggagguccaggugauugccguagaaccuggcaagaaucccaagaacguccaaacuaccccagguacguucaaaacacccgagggcgaagugggggcgaucgcucucgauuuuaagccuggaacuucuggcucgccaauuguuaaucgggaggguaagaucguggggcuguacggaaacggcgucgugaccacaagcggcaccuauguuucagccauagcacaggccaaggcuucccaggaagggccccuuccugagaucgaggacgaaguguucaagaaacgcaaucugacuauuauggauuugcacccgggaagugguaagaccagaagguaccuaccagccaucguccgggaggcaauuaaacgaaagcugagaacacucaucuuagcucccacgcgcgugguagccucugaaauggcggaggcccugaagggcaugccuauaagguaucaaacuaccgcagugaaaagcgaacauacagggcgugagauuguugaccuuaugugccacgcuaccuuuacuaugcggcugcucuccccagucagagugcccaacuacaauaugaucaucauggaugaggcccauuucacagacccugcuucaauugcagccaggggauauaucucuacccgcgugggcaugggugaagccgcugcgauauuuaugacggcaacuccgcccgggagcgucgaggccuucccacagaguaacgcuguaauucaggaugaagaacgagacaucccugaaagauccuggaauagcggauacgauuggauuacagacuuucccggcaagaccgugugguucguuccaucuaucaaaucaggcaacgacauagccaauuguuugcggaagaacgggaaaagggugauucagcugucccgcaagaccuucgauacugaguaucaaaagaccaagaacaaugacugggauuacgucgugaccacagacaucagugagaugggagcaaacuuucgugccgauagaguuaucgacccucggaggugccucaagcccgugauucugaaagaugguccagaacgcgucauccuugcuggcccgaugccugugacuguagcgagcgccgcacagcgaagagggcggauuggaaggaaucagaacaaggagggcgaccaguacauauauaugggucaaccccuaaauaacgaugaagaccacgcucauuggacggaggccaaaaugcuguuggauaauaucaacaccccagaggggauuauccccgcauuauucgaaccugagcgcgaaaagucggccgcuaucgacggcgaguacagacugaggggagaagcccggaagacauuuguggagcucaugcgucgcggcgaucugccaguuuggcuuucuuauaaagucgcguccgagggguuccaguacagcgaccgaagauggugcuuugacggagaaaggaauaaccaggugcuggaggaaaauauggauguggagauuuggacuaaggaaggugagcggaaaaagcuccgccccagaugguuggacgcaaggaccuauucagauccucuggcccuacgggaguucaaagaauuugcugccggccgaagaagugucucuggggaccugauacucgagaucggaaaacuuccgcagcaccugacauuacgcgcucaaaacgcauuggauaaucugguuaugcuccacaacuccgaacagggcgguaaagccuacaggcaugcuauggaggaacugccagacaccauugagacucuuaugcugcucgccuugaucgcagugcugaccgggggaguaacguuauucuuucuaagcggaaagggccuggggaagacaucaauuggacuccuuugugugauggcgaguagcguccuguuguggauggccuccguggagccccacuggaucgcugccucuauaauccuggaguucuuucucaugguucugcuuauuccugagcccgaucggcagcguacuccacaggacaaucaacucgcauauguggucaucggucuguuguucaugauucugaccguagcugccaacgaaaugggcuuacuagagacaaccaaaaaggaucuggggaucggacaugugguugcagagaaccaccaccaugccacuaugcucgacauagaucuucacccugcuagcgcguggacacuguacgccguggcaacgaccauuaucacucccaugaugagacauacaauugaaaauaccaccgcuaacaucuccuugacagccauagccaaucaggcagcuauccugaugggccucgacaaagguuggccaauuucaaagauggauaucggggucccucugcuugccuuaggcugcuacucucaggugaacccgcugacucucacggcggcugucuugaugcugguggcccacuaugcaauuaucggacccggccuacaagccaaagcuaccagggaggcacagaagcgcacagccgcggggauaaugaagaauccaacuguugacggaauuguggcuaucgaccuggauccuguaguguacgacgccaaauuugaaaagcagcucggccagaucaugcuucugauuuuguguaccagucaaauccugcucaugcggacaaccugggcacugugcgagucgauaacuuuagccacggguccccuuacaacccugugggaagggagcccaggaaaauucuggaacacuaccauugcugucuccauggccaauaucuuccgaggcucuuaucucgccggugcuggccuagccuuuucacugaugaaaagccuagggggaggcagaagggggacaggagcgcagggcgagacucugggugagaaauggaagcgccagcucaaccagcuuuccaagagugaguucaauaccuacaaacggucugggauuauggagguugauagaagcgaagccaaggagggacugaaacguggcgaaacaacgaagcaugcagugucaagggguaccgcuaaauugcggugguuugucgagcgcaaccuggugcgaccugagggcaagguaaucgaccucggguguggaagaggcgggugguccuauuacugcgccggauuaaagaaagugacugaaguuaagggcuauacaaaaggugggcccggacacgaggaaccgauaccaauggcaaccuacggcuggaaucuggugaaacuuuacaguggcaaagaugucuucuuuacuccucccgagaagugugacacacugcuaugcgauaucggggaaagcucuccaaaccccaccauugaggagggaaggacgcuccgggugcugaaaauggucgaaccuugguugcgcgguaaucaauucuguaucaagauucugaacccguauaugcccuccgugguugagacccucgaacagaugcagagaaagcacggcgggaugcuuguaaggaauccacugucacgaaacagcacacaugagauguacugggugucgugcggaacuggcaauaucgucucugcugugaacaugaccagucggauguuacugaaccguuuuacaauggcccacagaaaaccuacuuaugagcgcgacguugauuugggugccgggaccaggcauguggcggucgaacccgagauugcuaaucucgacaucauaggacagcggauugaaaacaucaagaaugagcacaaauccacauggcacuacgaugaagacaacccuuauaagaccugggcauaccauggcagcuaugaggugaaaccaucaggcuccgccucuagcaugguaaauggggugguuagacugcuaacuaagcccugggacgucaucccuauggugacgcaaauugcuaugacagauaccacuccauucggacagcagcgcguguuuaaggagaaagucgacaccaggacaccccgaccgaagcgggguacggcccaaauaauggaaguuaccgcaaaauggcuuuggggcuuccugaguagaaacaagaaaccuaggaucuguacucgcgaggaauuuacacguaaggugcgguccaaugccgcuauuggggcgguauucguggaugagaaccaguggaauagcgccaaggaagcagucgaggacgagaaauuuugggaucucgugcacagagaaagggagcugcauaagcagggaaaaugcgcuaccugcguuuacaacaugaugggcaagcgcgagaagaaguugggugaguucgggaaggccaaaggaucucgagcaaucugguacauguggcugggcgcccgguuccucgaauuugaggcucuuggcuucaugaaugaggaccacugguuuucaagagaaaacagucuguccgggguggagggagaagguuuacauaagcugggcuauauuuugagggauaucagcaaaauaccagggggaaauauguacgccgacgauacugcgggcugggacacacgcaucaccgaggaugaccuccagaacgaggcaaagauuacagauaucauggaacccgagcacgcccugcuagcuacuucuauuuucaaacuuaccuaucaaaauaaggucgugagaguacagcggccugccaaaucggguacgguuauggacgugaucucaaggcgugaccagcgagggagcggacaggucggcaccuacggccugaacacauuuacuaacauggaagugcaacucauacgccagauggaguccgaagggauuuucaguccaucugagcuggagaauagcaacuuggcagaaagaguguuagauuggcuggagaagcacggagucgaacggcucaagaggauggcuaucuccggugacgauuguguugugaaacccaccgacgaucgcuuugccacagcucuuacugcccugaaugacaugggcaagguaagaaaagauaucccgcagugggagccuucaaagggguggaacgacuggcagcaagugcccuucugcagucaucacuuucaucagcuaauuaugaaagauggacgggaaauagucgugccauguaggaaucaggacgagcugguuggccgagcacgugugucucagggugcgggguggagccucagagagaccgccugcuugggaaaguccuaugcucaaauguggcagcugauguacuuccaccgccgggaucuuaggcuggccgcaaacgcuaucuguucagccgucccuguggacuggguacccacgagcagaacaaccuggucuauucacgcacaucaccaguggaugacuacagaagacaugcucuccguuuggaaucgcguguggaucgaggaaaacccauggauggaggauaagacccaugucaguagcugggaagacgugcccuauuuaggcaaacgggaggaucaauggugcggcucgcugauuggguugacugccagggcgaccugggcuacaaauauccagguugccauaaaccaggugcgaagacugaucggaaaugagaacuaccucgacuacaugacguccaugaagcgguuuaaaaaugaaucugauccugagggugcacuuugguga

SEQ ID NO: 14122 - RNA, 9879 nt, Artificial Sequence
  derived and/or modified CDS sequence (opt3) from DENV-1__KP406802__SS-prME
agcgugacaaugcugcucaugcuuaugcccacagcccuggcuuuccacuugacuacgaggggaggggaaccucauaugaucgucuccaagcaggaaaggggaaaaucuuuacuguuuaagacaucagcagguauuaacaugugcacauuaauagccauggaccucggcgagcugugugaagauacucuuaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagagggucgaaacuugggcucugcggcacccuggauucaccgugaucgcacuguuucucgcccaugcuauuggcacaucgaucacccagaagggcauaaucuucauuuuacugaugcuuguuacgccaucaauggccaugcgcugcguggggaucggaagcagagauuuugucgaggguuugaguggcgcgacuuggguggacguaguucuggagcacggguccugugugacaaccauggcaaaggauaaacccacucuggacauugaacuccugaagacagaggucaccaacccugccgugcuuaggaaacugugcaucgaagcuaagauaucuaauacgaccacagauagccgguguccaacucaaggagaggccaccuugguggaagaacaggacgcaaacuucgucugccgccgaacauuuguugauagaggcugggguaauggguguggacucuucggcaaaggcucccugauuacuugcgcuaaguuuaagugcgugaccaaauuagaggggaagaucguacaguacgaaaaccugaaauauucagugauugucacagugcacaccggagaccagcaucaaguugguaaugagaguacugaacacggcacgacagccaccaucacuccccaggcgccuaccacagagauccagcucaccgacuacggggcccuuacucuggauuguagcccaaggacaggauuggacuucaacgaaauggugcuacugacgaugaaggagaaaucuuggcucguccauaagcagugguuucuggaucuuccgcugcccuggaccuccggcgcaucaacuagccaagagauuuggaaucggcaggacuugcucgugacauucaaaaccgcucacgccaagaagcaggaaguaguugugcuggguagucaagagggggcuaugcacacagccuuaacuggcgcaaccgaaauacagacgucuggaaccacaacuaucuuugccggccaucugaaaugccgucuaaagauggauaaacucacccugaaggggauguccuaugucauguguacagggagcuucaaacuugagaaggaaguggcugagacucagcacgguaccgucuuggugcagauuaaguacgagggcacggacgcgccuugcaaaaucccauucucgacacaagaugaaaaggggguuacccagaacggacgccugauaacugcaaaucccauugugacagacaaagagaagccuguaaacaucgaagccgagccacccuuuggcgagucuuauaucgucauuggugcuggggaaaaagcccucaagcuguccugguucaagaaaggcucaaguaucggaaagauguuugaggcaaccgccagaggcgcuaggcggauggccauucuuggggauacugcaugggacuucggaagcauagguggcguguuuaccuccguugggaaacuggugcaucagaucuucggaacagcguacggcgucuuguuuucuggugugagcuggacgaugaagauugggaucggcguacuccugaccugguuaggacuaaauucacgaaguacuucccuaagcaugacauguaucgcugugggccucguuacccuguaccuuggggucauggugcaggccgauucuggaugcgugauuaacuggaaaggccgcgaauugaagugugguucagggauauucgucacaaaugagguucacacuuggaccgaacaauauaaguuucaggcagacaguccgaaaagacugagcgccgcuaucggaaaggccugggaggagggcgugugcgguauuagguccgcaacgcggcucgaaaacaucauguggaaacagauuucuaacgagcugaaucauaucuuacuggaaaacgacaugaaguucacagugguagucggcgauguggcugggauacuugcccagggcaaaaagaugauccgcccucaacccauggagcacaaauacucguggaaaagcuggggcaaggcgaaaauuaucggggccgacguucagaauaccacuuuuauuaucgauggaccaaacaccccugaaugucccgacgaucagagagcuuggaauauaugggagguggaggacuauggcuucgguauuuuuacaacuaacaucugguugaagcucagggauuccuacacccaggucugcgaccaccgucugaugucagcagccauuaaagauaguaaggcugugcaugccgacaugggguauuggaucgaaucugagaaaaaugaaacauggaagcuagcacgggcgagcuucauagagguuaagacguguaucuggccaaaaucccacacccuguggucaaacggagugcucgaaagcgagaugauuauccccaagauuuacggcgguccuaucucucaacauaauuaucgaccaggcuacuucacucagacagccgggccguggcaccugggaaaacuugaguuggauuuugaccugugcgaaggcaccacuguagucguggaugagcacugcgggaacagaggacccuccuuaaggacaaccacggugacuggcaagauaauucaugaaugguguugccgcaguuguacccucccuccacugcgguucagaggugaggacgggugcugguacggaauggagaucaggcccgucaaagaaaaggaggaaaaucuuguuaagagcauggugucugcuggcuccggugagguagacucauuuagucugggcuugcucuguaucagcauuaugaucgaagaggugaugcgcucgcgauggucccggaaaaugcugaugacagggacccuagccgucuucuuucugcucauuaugggacagcugacuuggaacgaucuuauacguuugugcaucauggugggcgcaaaugcuucugacagaauggggaugggaacaaccuaucuggccuuaauggcaacauucaagaugaggccuauguuugccguuggccuccuguuccgccggcuuacuagcagagaggugcugcuacucaccauuggucugucauuggucgcuaguguggaacugccaaacuccuuagaggaacucggggauggacuggcgaugggcaucaugauucuuaaacuguugacggacuuucaaucucaccagcucugggccacacugcuaagccugaccuucaucaagacuaccuuuucccuucauuacgcauggaaaacaauggcuaugguucucucaauagugagccuguuccccuugugucugaguacuaccucucagaagacgacaugguuaccgguccuccugggcucccuugggugcaagccucugaccauguuuuugaucgccgagaauaaaauuuggggaagaaaguccuggccacucaacgaagguaucauggccguaggcauugugucgauccugcuaucaucucugcuuaaaaacgauguuccccucgcugggccucugauagcaggaggcauguugauugccuguuaugugaucagugguuccagcgcggacuuaucucuggagaaggcugccgaggucagcugggaagaggaagcagagcacuccggggccucacauaauauccucguggaaguacaggaugacggaacuaugaaaauuaaggaugaggagcgagacgauacacugaccauacuucugaaagcuacuuugcuagcagugaguggcgucuacccccugagcaucccagccacacucuucguuugguauuucuggcaaaagaagaaacagcgcucuggcgugcugugggacaccccuucacccccagaaguggagcgggcgguccuugaugacgggauuuacagaaucaugcagaggggauuacugggucguagccaggugggcguugggguauuucaagaaaacguguuccacacgauguggcacgucacucgcggagcugugcucauguaucagggcaagcgguuggagccgaguugggccagcguuaaaaaggaccugauuuccuacggugggggauggagacuccagggcucuuggaauaccggcgaggaagugcaggucaucgcaguggagccugggaaaaaccccaagaauguacaaacagccccaggaaccuuuaagacacccgaaggugaggucggcgcuauagcccuggauuucaaaccugggacuucgggaagcccaaucgugaacagggaaggcaagauuguuggucuuuacgggaauggaguggucaccacgucaggcacauauguguccgcaaucgcucaggccaaagcgagucaggagggcccccugccugagauugaagacgagguuuuucgaaagcggaacuugacuaucauggaucuacauccggggucuggaaaaacccgcagauaccugccagccauagugagggaagcaauuaagcggaagcuccgaacauuaauccuggcucccaccagagucguggccagcgagauggcugaagcacuuaaagguaugccuauccgcuaucaaacuaccgccguaaaguccgagcacacaggcaaagagauuguggaccugaugugccaugccacguucacuaugaggcucuugucaccaguucguguccccaauuacaacaugaucauaauggaugaagcucacuuuaccgacccuucuagcauugcggcacggggguauaucaguacaagagugggaaugggcgaggccgcugccauuuucaugaccgcaacuccgcccgguuccguggaagccuuuccacagagcaaugcugucauccaggaugaggaaagggacauaccugagcgcucuuggaacucaggguacgaguggauuacagauuuccccggaaagaccguaugguuugugccauccaucaaaaguggcaaugacaucgcgaacugucugcgaaagaauggcaagagaguuauucagcucagccggaaaacguucgauacugaauaucaaaagaccaaaaauaacgacugggacuacguggucaccaccgauaucucggagaugggggccaauuucagggcagaccgcgugauugauccucguagaugccugaagcccguuauacuuaaagacggaccagaacgggugauccuagcugguccgaugccugucacuguggccucugcagcccagaggcgcggccgaguagggagaaaccauaauaaggagggagaucaguacauuuauaugggccagccccugaacaaugacgaggaucacgcucacuggacagaagccaagauguuguuagacaacaucaauaccccagaggguaucauucccgcgcuguuugaaccugagcgggaaaaauccgcagccauagauggggaguacaggcuccgcggcgaggcuagaaagacauucguggaacugaugaggcggggagaccuuccaguuuggcugagcuauaaagucgccucagagggcuuucaauacagugaucgucgcuggugcuucgacggggaacgaaacaaucaggugcucgaggaaaacauggauguggagaucuggacuaaggagggagaaaggaaaaaguugaggccccgguggcuggacgcucgcacguauucugacccucuagcacugagagaguuuaaagaguucgccgcugguaggcgguccgucagcggcgaucucauucuugagaucgggaagcugccgcagcauuuaacccagcgagcccaaaaugcauuggacaaccugguuaugcuccacaauucagaacagggaggcagagcguaccgccaugccauggaggagcugccagauacaauugaaacucuuaugcugcucgcuuugaucgccgugcugaccggugggguaacauuauuuuuccuaaguggcaggggacugggcaagaccagcauagggcuccuuugugugauggcauccucuguccuguuguggauggcuagcguggagccccacuggaucgccgcauccauuauccuggaauuuuuccucaugguucugcuuauuccugagcccgaccggcagcguacuccacaggauaaccaacucgccuauguggucaucggacuguuguuuaugauacugacgguagcugcgaaugagauggguuuacuagaaaccaccaaaaaggaccugggcauugggcacguggccguugagaaccaucaccaugcagcuaugcucgauguggaccuucacccugccucagccuggacucuguacgcagucgcuaccacaaucauuacccccaugaugagacauacuaucgaaaacacaacggccaauauaucuuugaccgcgaucgcuaaccaggccgcaauucugaugggacucgauaaaggcuggccaaucaguaagauggacauuggugugccucugcuugccuuagggugcuacucgcaggucaauccgcugacucucacagcugcaguguugaugcugguugcccacuaugcgaucauaggccccggacuacaagcuaaagccaccagggaggcacagaagcgcaccgccgcuggcauuaugaagaacccaacaguggaugggaucguagccaucgaccuggauccuguggucuacgacgcaaaauucgaaaagcagcucggacagauuaugcuucugaucuuguguacuagccaaauacugcucaugcggacgaccugggcucugugcgaguccauuacauuagccacuggcccccuuaccacacugugggaggguucuccagggaaauuuuggaauaccacuaucgcgguuucaauggccaacauuuuccgaggaagcuaucucgcaggcgcuggucuagccuucucccugaugaagaguuugggcgggggaagaaggggcacgggggcacagggagaaacacugggcgagaaauggaagcgccagcucaaucagcuuucuaagagcgaauuuaacaccuacaaacggucagguaucauggagguggacagauccgaagcuaaggaggggcugaaacguggagagacuaccaagcacgccgucaguaggggcacagccaaauugcggugguucguggaacgcaaucugguaaagccugaggguaaggugauagaucucggcugugggcgaggaggcuggagcuauuacugcgcggggcuaaagaagguuacugaagugaaaggauauaccaagggcggucccgggcaugaggaaccgaucccaauggcuacauacggauggaaccuggucaaacuucacucuggcaaggacguguuuuucauuccucccgagaaaugugauacgcugcuaugcgacaucggcgaguccucaccaaaucccaccauugaagaggggagaacucucaggguccugaagaugguggaaccuugguugcggggaaaccaauuuuguaucaagauucugaauccguacaugcccagcguuguagagacacucgagcagaugcagcgcaaacaugguggcaugcuugugagaaacccacugucgagaaauucuacccacgaaauguauugggucaguugcgggacuggaaacaucguguccgcaguuaauaugacaagccgaauguuacugaaccgguucaccauggcccaccguaagccuacguacgagagagauguggacuugggcgcugguacccgccaugucgccguggaacccgagguagcaaaccucgauauaauugggcagaggaucgaaaauaucaaacacgagcauaagucaacauggcacuaugacgaggauaacccuuacaaaacuugggccuaucauggauccuacgaagugaagccaucuggcagcgcuaguuccaugguuaauggcgucgugaagcugcuaaccaaacccugggacgugauuccuauggucacacaaauagcgaugacugauaccacaccauuugggcagcagcggguuuucaaggagaaaguggacaccagaacucccaaggccaaacgcggaacgacacaaaucauggaaguaaccgcaagguggcuuugggguuuucugagccgaaacaagaagccgcggauuuguacuagagaggaguucaccaggaaagugcgcucuaaugcugccaucggcgcagucuuuguggacgagaaccaguggaacucagccaaggaggcuguugaagaugagcguuucugggaccucgugcaccgggaaagagagcugcacaaacaggggaagugcgccacaugcgucuauaacaugaugggaaaaagggaaaagaaguugggcgaguuugguaaagcgaaggggagucgcgcaauuugguacauguggcugggagcccgauuccucgaguucgaagcucuuggcuuuaugaaugaggaucauugguucucccgggaaaacagccugucuggcguggagggggagggauuacacaaacuggguuacaucuugagagacauaucgaagaucccuggcgggaauauguaugccgaugacacggcaggaugggauaccaggauuacugaagacgaucuccagaacgaggcuaaaaucacagacauuauggaaccagagcaugcccugcuagcuaaggccaucuuuaaacuuaccuaccaaaauaagguaguucgcgugcagagacccgcaaagaacggcacugucauggaugugauaucacggagggaccagcgugguagcggacaggugggaacauauggccugaauaccuucacaaacauggaagcgcaacucauucgacagauggaguccgagggcaucuuuaguccuucugaacuggagacuccaaacuuggccgaacgcgucuuagauuggcuggagaaauacgggguugaaagacucaagcggauggcuaucagcggagacgacugugugguaaaacccauugaugacagguucgccaccgcacuuacggcucugaaugauauggguaaggugcgcaaagacauaccgcagugggagccuuccaagggcuggaacgauuggcagcaaguccccuuuugcucacaccacuuccaucagcuaaucaugaaggacgggagagagauugugguuccaugucggaaucaggaugaacuggugggaagggcccgagucagucagggcgcagguuggucucuccgugagaccgccugcuuggggaaaagcuaugcgcaaauguggcagcugauguacuuucacagacgcgaccuucggcuggcugccaacgcaaucuguuccgccgugccuguagauuggguucccacaucaaggacuaccuggagcauucaugcucaccaucaguggaugacaacugaagacaugcucucuguguggaauagagucuggaucgaggaaaacccauggauggaggauaagacccacauauccaguugggaggacgugcccuauuuaggaaaacgcgaagaccaauggugcggcagccugaucggcuugacggcccgggcaacaugggcuaccaauauucagguugccaucaaccaggugaggcgacugauugggaaugagaacuaccucgauuacaugacuucgaugaagagauucaaaaaugaauccgacccugagggagcgcuuugguga

SEQ ID NO: 14123 - RNA, 9879 nt, Artificial Sequence
  derived and/or modified CDS sequence (opt3) from DENV-1__KP406803__SS-prME
uccgugaccaugcugcucaugcuucugcccacugccuuggcuuuccacuuaacuacgagaggaggggaaccucauaugaucguauccaagcaggaaaggggaaaaucucugcuauuuaagaccucagccgguguuaauaugugcacccucauugccauggaccugggcgagcuuugugaagauacuaugaccuacaaaugcccacggauaacagagaccgaaccggacgauguggacuguuggugcaaugcgacugagacauggguaaccuaugggacguguagucaaacuggagagcaccgccgagauaagcguagcguggcucuggcaccccaugucggcuugggucucgaaaccagaacagagacuuggauguccucugaaggggcauggaggcagauccagaaaguggagaccugggcccugcggcacccuggauucacaguuauugcucuguuucucgcacaugccaucggcaccucgauuacgcagaagggcaucauauucaucuuacugaugcuugugacuccaucaauggcuaugcgcugcgucgggauuggaaacagggacuuuguggaggguuugagcggcgccacauggguagauguugugcuggaacacgggaguugugucaccacuauggcgaaggacaaacccacacuagauaucgagcuccugaagaccgaagugacgaauccugcagugcuuaggaaacugugcauugaggccaagaucuccaacaccacaacugacucucgguguccaacccaaggagaagcuacauuggucgaggagcaggauacuaauuucguuugccgccgaaccuuuguggacagaggcugggguaacggguguggacucuucggcaaaggcagccugauaacaugcgccaaguuuaagugcguaaccaaauuagaagggaagauugugcaguacgagaaucugaaauauuccgucaucgugacuguucacacgggagaucagcaucaaguggguaacgaaacaaccgagcacggcacuaccgcaacaauuacaccccaggcuccuacuucagaaauccagcucacagacuacggggcccuuacgcuggacuguaguccaaggaccggauuggauuucaaugagaugguccuacugacuaugaaggagaaaagcuggcucgugcauaagcagugguuucuggaccuuccgcugcccuggacaucuggcgcguccaccucacaagaaacauggaaccggcaggauuugcucguaacuuucaaaaccgcccacgcaaagaagcaggagguugugguccuggguagccaagaaggggcuaugcacacggccuuaaccggcgcuacagagauccagacaaguggaaccacaacuauuuuugccggccaucugaaaugccgucuaaagauggacaaacucacccugaagggggugucuuaugucauguguacgggauccuucaaacuugaaaaggagguggcagagacacagcacgguaccguuuuggugcagguaaaguacgaaggcacugaugccccuugcaaaauaccauucagcucgcaagacgagaagggggucacacagaauggacgccugaucaccgcuaaccccauugugacugauaaagaaaagccuguuaauaucgaggcggagccacccuuuggcgaaucuuaucucguggucggugcaggggagaaagcccugaaacuuuccugguucaagaaaggcucaaguauaggaaagauguuugaagcuaccgccagaggcgcaaggcggauggccauucugggggacacagcuugggauuucggaagcaucgguggcguguuuacguccguagggaaauugauccaucagauuuucggaaccgccuacggcgugcucuuuucugguguuagcuggacuaugaagaucgggauuggcauacuguuaacauggcugggacuaaacucacgaaguaccucccucagcaugacauguaucgcagucggcauggugacucuguaccuuggggugaugguccaggcggacucuggaugcguuauuaauuggaaaggccgcgaguugaagugugguucagggaucuucgugaccaacgaagugcacacguggacagagcaauauaaguuucaggcugauaguccgaaaagacugagcgccgcaaucggaaaggccugggaggaaggcguaugcgguauuagguccgcuacccggcucgagaacauaauguggaaacagaucucuaaugaacugaaccauauuuuacuggagaaugacaugaaguucacugucgugguuggcgacgugaacgggauccuugcccagggcaagaagaugauucgcccucaacccauggaacacaaauacucguggaaaagcuggggcaaggcaaaggucaucggggcugaugugcagaauauaaccuuuaucauugacggaccaaacacaccugagugucccgaugaccagagagccuggaauaucugggagguugaagauuauggcuucgguauuuuuacuaccaacaucugguugaagcucagggacuccuacacacaggugugcgaucaccgucugaugucagcggccauaaaagacaguaaggcuguacaugcagauaugggguauuggauugagucugagaagaaugagacguggaagcuaacccgggccagcuucaucgaagucaagacuuguguguggccaaaaucccacacacuguggucaaacggagugcucgagagcgagaugauuauccccaagauauacggcgguccuaucucucaacauaauuaucgaccaggcuacuucacccagacugcugggccguggcaccugggaaaacuugaauuggacuuuggccugugcgaggggacaaccgucguuguggaugaacacugcggaaacagaggccccuccuuaaggacgacuaccguaacagguaagauuauccaugagugguguugccgcaguuguacccucccuccacugcgguucaaaggggaggacggaugcugguacggcauggaaauuagacccgugaaggagaaggaagagaaucuugucaaaagcauggugucugccgguuccggcgaaguugauucauuuagucugggguugcucuguaucagcauaaugauugaggaggugaugaggucgcgcuggucccgaaagaugcugaugacuggaacacuagcagucuuccugcuccugaucaugggccagcuuaccuggaacgacuugauccggcugugcauuauggugggggcgaaugccucugacaaaaugggaaugggcacaacuuauuuagcucucauggccaccuuucguaugagaccuauguucgcaguuggucugcuuuuuaggcgccugacgagccgggaagugcuacuccugacagucggguugucacugguagcuaguguggaguuaccaaacucccucgaagaacugggagauggccuugccaugggcaucaugaugcugaaguugcucaccgacuuccaaucucaccagcugugggcagcccuacugagccuuacuuuuguuaaaaccacauucucccuccauuacgcuuggaagacuauggcgaugauucugucaauagugagcuuguuuccccuguguuuaaguaccacgucucagaagacaaccuggcucccgguccugcuugggucccugggaugcaaaccuuugacuauguuccucaucacagaaaacaagauuugggguagaaaaagcuggccacugaaugagggcaucauggccguggggauuguaucgauccuacugucaucucuucucaagaacgaugugccccuggcaggaccuuugauagcuggcgguauguuaaucgccuguuaugucauuaguggguccagcgccgaccugucucucgagaaagcugcagaaguuagcugggaggaagaggccgaacacuccggagcgucacauaauauccugguggaggugcaggaugacggcaccaugaagauuaaagaugaggaaagggacgauacucuuacaauccuguugaaggcuacccuacuggccauaaguggcgucuaccccaugagcauuccagcaacgcucuuugugugguauuucuggcaaaagaaaaagcagcgaucugggguucugugggacacuccuucacccccagagguagaacgcgccgugcuugaugacggaaucuaccggaucuuacagagaggucugcucggcaaaagccaggucggggugggaguuuuccaagagggcguguuucacaccauguggcacgucacaaggggugcuguguugauguaucaggggaagcgucuggagccgaguugggcaagcgucaaaaaggaucucauuuccuacggaggcggcuggcgcuuccaggggucuuggaacaccggagaagagguccaggugauagccguugaaccugguaagaaucccaaaaacgugcaaacagcgccaggcacuuuuaagacccccgagggggaagucggagcuaucgcccuggacuucaaaccuggcacgucggguagcccaauugugaaucgggaggggaagaucguuggacuuuacggcaacggcguggucacaacuucagggaccuauguguccgcaauugcccaggcuaaagccagucaggagggaccccugccugaaaucgaggacgaaguauuuagaaagaggaauuugacaauaauggaucuacauccggguucuggcaagacccgacgguaccugccagcaaucgugcgcgaggcuauuaaaagaaagcucaggacuuuaguucuggcccccacccgggucguggcgagcgaaauggccgaggcacuuaaagggaucccuauucgauaucaaacaacggcugugaaguccgagcacacuggaaaagaaaucgucgaccugaugugccaugccaccuucacaaugagacucuugucaccaguacgcgugcccaacuacaauaugauaauuauggaugaggcucacuuuaccgacccugcaucuaucgccgccaggggcuauaucagcacucguguugguaugggggaagcugcggcaauuuucaugacagccaccccgcccggaaguauggaggcuuuuccacaguccaacgccgcaauccaggaugaagaacgggacauaccugagagaagcuggaacucuggcuacgauuggauuacggacuuccccggcaagacugugugguuugucccaucaaucaaguccgggaacgauauugccaauugucugaggaaaaacggaaagcgcgugguucagcucagucgaaaaacauucgacaccgaauaucaaaagaccaaaaacaaugauugggacuacguggucacuacagacaucagcgagaugggugcuaacuucagagcggaucgggugauagacccuaggcgcugccugaagcccguaauucuuaaggauggcccagaacgugugauccuagccgggccgaugccuguuaccgucgcaucggcugcccagagacggggaaggaucggccgcaaucagaacaaagagggugaccaguacauuuauauggggcaaccccugaauaacgaugaggaccaugcacacuggacagaagccaagauguuguuagauaauaucaacacuccagagggcauuauacccgcucuguuugaaccugagcgagaaaaaucugccgcgaucgacggagaguacagacuccggggcgaggcaaggaagacguucguggaacugaugcgcagaggggaucuuccaguguggcuguccuauaaagucgccagcgagggauuucaguacucagacaggcgguggugcuucgauggugaacguaauaaccagguucucgaggaaaauauggacguggagauuuggaccaaggagggcgaacgcaaaaaguugcgacccagauggcuggaugcuaggacauauagugacccucuagcccugcgggaguuuaaggaguucgcugcagggcgcagaucuguauccggagaccucauccuugagaucggcaaacugccgcagcacuuaacucaaagggcccagaacgcuuuggauaaucuggugaugcuccauaacagcgaacagggugggaaggccuaccggcacgcaauggaggagcugccagacaccauugaaacacuuaugcugcucgcguugauagccguccugaccggcggagugacuuuauuuuuccuaucaggccgagggcugggaaaaacgaguaucggucuccuuuguguuauggcuagcuccgcccuguuguggauggcaucuguggagccccauuggauugcugccagcaucauucuggaauuuuuccucaugguccugcuuaucccugagcccgauagacagcgcaccccacaagacaaucagcucgcauauguagugauaggccuguuguuuaugauccugacaguugccgcuaacgagaugggguuacuagaaacuaccaagaaagaucugggaauuggccacguggcggccgagucccaccaucacgcagcuaugcucgacgucgaucuucauccugccucagccuggacacuguacgcaguggcuaccacuaucauuacacccaugaugaggcacacgaucgaaaacaccacugccaauauaucuuugacagcgauugcuaaccaggccgcaauccugaugggucucgacaagggguggccaauuaguaagauggauaucggcgucccucugcuugccuuaggaugcuacucgcaagugaauccgcugacccucaccgcugcaguuuugaugcugguggcccauuaugcgauaaucggccccgggcuacaggcuaaagccacacgggaggcacagaagcguacugccgcuggaauuaugaaaaacccaacgguagacggcaucguggccauugaucuggacccugucguuuacgaugcaaaguucgaaaaacagcucggucaaaucaugcuucugauauuguguaccagccagauucugcucaugagaacaacuugggcucugugcgaguccaucaccuuagccacagggccccuuaccacucugugggagggaucuccaggcaaguuuuggaauacgacaaucgcggugucaauggccaacauuuucagggguagcuaucucgcaggcgcugggcuagccuucucccugaugaagaguuugggaggcgggcgccggggaaccggcgcacagggugaaacucugggggagaaauggaagcgacagcucaaucaacuuucuaaaagcgaauuuaacaccuacaagagaucaggaaucauagaggucgacagguccgaagcuaaagagggccugaagcgcggugagacaacuaagcacgccgugagucggggcaccgccaaauugagaugguucguagaacguaaucuggugaagccugaggggaaaguuauugaccucggauguggcagagggggauggagcuauuacugcgcgggcuuaaagaaagugacagaagucaaggguuauacgaaagggggacccggccacgaggaaccgaucccaauggcuaccuacggcuggaaccuggugaaacuuuacucugggaaggaugucuuuuucacuccucccgagaaaugugacacacugcuaugcgauauuggagaguccucaccaaaucccaccaucgaagagggucggacucuccgcgugcugcgaaugguugaaccuugguugagaggcaaccaguuuuguauaaagguacugaauccguauaugcccagcguggucgagacacucgagcagaugcagaggaaacaugggggaaugcuugugcggaacccacugucgcgcaauucuacccacgaaauguacuggguuaguugcggcacggguaacaucguguccgcagucaauaugaccagcagaauguuacugaacagguucacaauggcccaucgaaagccuacuuaugagcgggacguggauuugggggcuggaacccgucacguagccguggaacccgagguugcaaaccucgacauuaucggccaaagaauugaaaauaucaaaaacgagcacaagucaacauggcauuacgaugaggacaauccuuauaagacuugggccuaccacggcuccuaugaagucaaaccaucugggagcgcuaguuccauggugaacggagugguccgccugcuaaccaagcccugggauguuauuccuauggugacacagaucgcgaugaccgacacuacgccauuuggucagcaaaggguauucaaagagaagguggauacacggacccccaaagccaagagaggcacugcacagauaauggaagucaccgcucgcuggcuuuggggguuucugagcaggaauaagaaaccgcgaauuuguacacgggaggaguucacgagaaaggugaggucuaacgccgcaaucggagccguuuuuguggacgagaaucaguggaacucagcuaaagaggccgucgaagacgagcgcuucugggaucucgugcaucgugaacgggagcugcacaagcagggcaaaugcgcgaccugcguauacaauaugauggguaagagagaaaagaaauugggggaguuuggaaaggcaaaaggcaguagggccaucugguacauguggcugggcgcucgcuuccucgaguucgaagcccuuggguuuaugaacgaggaccauugguucucccgagaaaauagccugucuggaguugagggugagggcuuacacaagcugggguauauuuugcgggauauaucgaaaaucccuggaggcaacauguacgcagacgauacugcugguugggacacaagaauuaccgaagaugaccuccaaaaugaggccaagaucacugauauuauggaaccagagcacgcucugcuagccacaucaaucuuuaaacuuaccuaucagaacaagguggucagggugcagcgccccgcaaagaaugggacagugauggacgucauaagcagacgggaucagaggggauccggccaaguuggcacuuacgggcugaacaccuucacgaacauggaagcgcagcucauccgucagauggagagugagggaauuuuucugccuucugaauuggagaccccaaauuuagccgaacgagugcuggacuggcucgagaaauaugguaucgaacgccuuaagagaauggcuauuagcggcgaugacuguguagugaaacccaucgacgaucgguucgccacagcacugacugcucuaaacgacauggggaaggucaggaaagauauaccgcagugggagccuuccaagggauggaaugacuggcaacaggugcccuuuugcucacaucacuuccaucagcugauuaugaaggauggccgcgagaucguugugccauguagaaaccaggacgaacucgucggucgggccagggugagucaaggggcaggauggucuuugcgagagaccgccugccugggcaaaagcuacgcgcagauguggcagcuuauguauuuucaccguagagaucugcgccucgcugccaaugcaaucuguuccgccguaccuguugacugggugcccacaucacggacuaccuggagcauucacgcucaucaccaauggaugacgacagaagauauguuaucugucuggaacaggguguggauagaggaaaauccauggauggaggacaagacccauguuuccaguugggaggaugugcccuaccugggcaaaagagaagaccaguggugcgggagcuugaucggacugacugcccgcgcaacaugggcuaccaacauucaggucgccaucaaucaggugcggaggcucauugguaacgagaauuaccuugacuauaugacuucgaugaagcgauucaaaaacgaauccgauccugagggcgcgcugugguga

SEQ ID NO: 14124 - RNA, 9879 nt, Artificial Sequence
  derived and/or modified CDS sequence (opt3) from DENV-1__KJ438293__SS-prME
agcgugaccaugcugcuaaugcuuaugcccacagcacuggcuuuccacuugacuacgaggggaggggagccucauaugaucgucuccaagcaggaaaggggaaaaucuuuacuguuuaagaccucagccgguguuaacaugugcacacuuauugccauggaccucggagagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacugcucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucaugacuugcgcuaaguuuaagugcgugaccaaacuggaggggaagauuguacaguacgaaaacuuaaaauauucagugaucgucacagugcacaccggagaccagcaucaaguugguaaugagaguacugaacacggcacgacagccaccauuacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagaucuccugguucaagaaaggcucaaguauuggaaagauguuugaggcaacugccagaggcgcuaggcggauggccauccucggggauaccgcaugggacuucggaagcauugguggcguguuuacauccguugggaaacuggugcaucagauauucggaacggcguacggcguccuauuuucuggugugagcuggaccaugaagaucgggauuggcguacuguugacuuggcucggacuaaauucacgaaguacauccuuaagcaugaccuguaucgcugugggccugguuacacuauaccucggggucauggugcaggccgauucuggaugcgugaucaacuggaaaggccgcgaacugaagugugguucagggauuuucgucacuaaugagguucacaccuggacggaacaauauaaguuucaggcagacaguccgaaaagacuuagcgccgcuauaggaaaggccugggaggagggcgugugcgguaucagguccgcaacacgguuggaaaacauuauguggaaacagaucucuaacgagcugaaucauauucuccuggaaaacgacaugaaguucaccgugguagucggcgauguggcugggaucuuagcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcugaaacuuagggauuccuauacacaggucugcgaccaccguuugaugucagcagccaucaaagauaguaaggcugugcacgccgacaugggguacuggauugaaucugagaaaaaugaaacguggaagcucgcacgggcgagcuucaucgagguuaagaccuguauauggccaaaaucccauacucuguggucaaacggagugcuagaaagcgagaugaucauucccaagaucuauggcgguccuauuucucaacacaauuaccgaccaggcuacuucacacagaccgccgggccguggcaucugggaaaacucgagcuggauuuugaccuuugcgaaggcacuacaguagucguggaugagcacugcgggaacagaggacccuccuugaggaccacgacugugaccggcaagaucauacacgaaugguguugccgcaguuguacacugccuccauuacgguucagaggugaggacgggugcugguauggaauggagauuaggcccgucaaagaaaaggaggaaaaucucguuaagagcauggugucugcuggcuccggugagguagacucauuuagucugggccuucuguguaucagcaucaugauugaagaggugaugcgcucgcgauggucccggaaaauguugaugaccgggacucucgccgucuucuuucugcuaaucaugggacagcugacauggaacgaucucauucgucugugcauaauggugggcgcaaaugcuucugacagaauggggaugggaaccacauaccuugccuugauggcaacuuucaagaugaggccuauguuugccguuggccuguuauuccgccggcucaccagcagagaggugcugcuucugacgaucggucuaucacucgucgcuaguguggaacugccaaacuccuuggaggaacugggggauggauuagcgaugggcauuaugauccucaaacugcuuacaggcuuucaaucucaucagcugugggccaccuugcucagccugacuuucauuaagaccacauuuucccuacacuaugcauggaaaacuauggcuaugguucugucaaucgugagccuuuucccccucugucugaguaccacgucucagaagacaaccugguugccgguccuguuagggucccucggaugcaagccucugacuauguuucuuauaacagagaauaaaaucugggguagaaaguccuggccacugaacgaaggcauuauggccguagggaucgugucgauuuugcucucaucucugcucaaaaaugacguuccccuggccggaccucuuaucgcuggcgguaugcucauagcauguuacgugauuaguggguccagcgccgaucugucuuuggagaaggcggcugaggucagcugggaagaggaagccgagcauuccggagcaucacacaauaucuuaguggaaguacaggacgauggcaccaugaaaaucaaggacgaggagcgagaugacacucugacaauucuccugaaagccacccuucuggcugugaguggcgucuaucccuugagcauaccagcaacgcuauucguuugguacuucuggcaaaagaagaaacagcgcucuggggugcugugggauacuccuucacccccagaaguggagcgggccguccucgacgauggaaucuauagaauuaugcagaggggucugcuuggccguagccagguggggguuggaguauuucaagaaaacguguuccauaccauguggcacgucacacgcggcgcgguguuaauguaccaggguaagcggcuggagccgaguugggcuagcguuaaaaaggaccucaucuccuacgggggaggcuggagauugcagggcucuuggaauaccggggaggaagugcaggucauugccguggagccuggcaaaaaccccaagaauguacaaacagcaccagguacuuuuaagacccccgaaggcgaggucggggccaucgcucuggacuucaaaccuggaacgucgggcagcccaauagugaacagggaagguaagaucguugggcucuauggaaauggcguggucacaacuucaggcaccuacguguccgccauugcacaggcuaaagccagucaggaggggccccugccugagaucgaagaugagguuuuucgaaagcggaaccuuacaauuauggaccugcacccgggaucugguaaaacccgcagauauuugccagcgaucgugagggaagccauaaagcggaagcuacgaacucugauucucgcacccaccagagucguggcuagcgagauggccgaggcuuuaaaaggcaugccuauccgcuaccaaacaacggcaguaaaguccgagcauacugggaaagagaucguggaucugaugugccacgccaccuucacaaugaggcuucugucaccaguucguguccccaauuauaacaugauuaucauggacgaagcccauuuuaccgauccuucuagcauagcugcgcggggauacauuaguacuagagugggcaugggugaggcagccgcuaucuucaugacagccaccccgcccggguccguggaagcauuuccacagagcaaugccgucauucaggacgaggaaagggauaucccugagcgcucuuggaacucaggauaugacuggauaacggauuuccccggcaagacuguaugguuugugccauccauuaaaaguggcaaugacaucgcuaacugucuccgaaagaaugggaagagaguuauccaguugagccggaaaacauucgauaccgaguaccaaaagaccaaaaacaacgacugggacuacguggucacuacagauauuucggaaaugggagcgaauuucagggccgaccgcgugaucgauccucguagaugccugaagcccguuauucucaaagacgguccagagcgggugguccuggcaggcccgaugccugugaccguagcuucugccgcacagaggcgcgggcgaauaggaagaaaccacaauaaggaaggcgaucaguauaucuacaugggucagccccuuaacaaugacgaggaucaugcccacuggacagaggcuaagaugcuacuggacaacauuaauacuccagaagggaucauccccgccuuguuugagccugaacgggagaaauccgcggcaauugauggcgaauauagguuacgcggagaggccagaaagacguucguggagcugaugaggcggggcgaccucccaguuuggcugagcuacaaagucgcuucagaaggguuucaauauagugaucgucgcuggugcuucgacggagagcgaaacaaucaggugcuugaagagaacauggauguggaaauauggaccaaggagggugagaggaaaaagcugaggccccgguggcucgacgcccgcacauacucugacccuuuggcucugagagaauuuaaagaguucgcagccggcaggcgguccgucagcggggaucuaauccuggaaauuggaaagcucccgcagcaccuuacucagcgagcucaaaaugcccuggacaacuuaguuauguugcauaauucagagcagggcgguagagcauaucgccacgcgauggaggaacugccagauaccaucgagacacucaugcugcuugcccugauugcugugcucaccgggggcguaacuuuguuuuuccugaguggaaggggcuuagggaagacgagcaucggacuacugugugugauggccuccucuguccuccuuuggauagcaagcguggaaccccauuggaucgcugccuccauuauccuggaguuuuucuugaugguucugcucauuccugaacccgaccggcagcguaccccacaggauaaccaacuggcauacguggucaucggucuucucuuuaugauacugacaguagccgcuaaugagaugggcuugcuggagacuaccaaaaaggacuuagggauuggacacguggcgguugaaaaccaccaucacgccgcaauccuagauguggaccugcauccugcuucagccuggacacucuacgccgucgcaaccacuauuaucacacccaugaugagacacacgauagagaacaccacugcuaauaucucucuuacagccauugcgaaccaggcugccauccugaugggcuuggauaaagguuggccaauuaguaagauggacaucggggugccucugcucgcacugggcugcuauucgcaggucaauccgcuuaccuuaaccgccgcugugcugaugcucguugcacauuacgccauaauuggacccggcuugcaagcgaaagcuacaagggaagcccagaagcgcacugcagccgggaucaugaagaacccaacgguggauggaaucguagcuauugaccuggauccuguggucuaugacgccaaauucgagaagcagcuaggccagaucaugcugcucauacuuuguaccagccaaauucuguugaugcggacaacuugggcacugugcgaauccaucacccucgcuacagguccccugaccacuuuaugggaggggucuccaggaaaauuuuggaauacgacaauugccguuucaauggcgaacaucuuccgaggcagcuaccuugccggugcaggccuggcuuucucccucaugaagagucuagggggaggcagaagggggaccggagcccagggcgagacucugggugaaaaauggaagcgccaguugaaucagcugucuaagagcgaguuuaacaccuauaaacggucagggauaauggaaguggacagauccgaggcaaaggaaggacucaaacguggcgagacaacuaagcacgcugucaguagggguaccgccaaacuucggugguucguggagcgcaaucugguaaagccugaaggcaaggugaucgauuugggguguggacgaggcggguggagcuacuauugcgccggacugaaaaagguuacagaggugaaaggcuacacgaagggugggcccggacacgaggaaccgauuccaauggcgaccuacggcuggaaccucgucaaauuauauucuggcaaggacguguuuuucaucccucccgaaaaaugugauacucugcuuugcgacauuggggaguccucaccaaaucccacaaucgaggaaggaagaacccugaggguccuaaagaugguggagccuuggcuccgggguaaccaauuuuguauuaagauccugaauccguacaugcccagcguuguagaaacuuuggagcagaugcagcgcaaacauggcgggaugcuggugagaaacccacucucgagaaauucuacacacgagauguauuggauaaguugcggaaccggcaacauugucuccgcugugaauaugacgagccgaaugcuucugaaccgguucaccauggcacaucguaagccuacauacgaaagagauguugacuuaggugccgggacucgccacguggcugucgagcccgaaguggccaaccuggauaucaucggacagaggauugagaauauaaaacacgaacauaagucaaccuggcacuaugacgaggauaacccuuacaaaacaugggcauaucauggcuccuacgagguaaagccaucuggcagcgccaguuccauggugaaugggguugucaaguugcucacuaaacccugggacgugaucccuauggugacccaaauugcuaugacagauaccacuccauuuggacagcagcgggucuucaaggaaaaaguugacacgagaacacccaaggcgaaacgcgguaccgcccaaaucauggaggugacugcaagguggcuguggggcuuucuaagccgaaacaagaagccgcggauuuguaccagagaagaguucacaaggaaaguacgcucuaaugcugccaucggggcaguguuugucgacgaaaaccaguggaacucagccaaggaggcuguggaggaugaacguuucugggaccuuguucaccgggagagagaacugcauaaacagggaaagugcgccacgugcguguacaacaugaugggcaaaagggagaagaagcucggugaauuugggaaagcgaagggaagucgcgcaauaugguauauguggcugggcgcccgauucuuggaguucgaggcucugggcuuuaugaaugaagaucacugguucucccgggagaacagccucucuggggucgaaggagagggucuucacaaacugggcuacaucuuaagagacauuucgaagaucccugggggaaauauguaugccgaugacaccgcaggcugggauacuaggauuacagaggacgaucugcagaacgaagcuaaaaucaccgacauaauggagccagaacaugccuugcucgcuaaggccauuuuuaaacugacuuaccaaaauaaggugguacgcguucagagacccgcaaagaacgguacagugauggaugucaucucacggagggaccagcgugggagcggacaggugggcaccuauggccuaaauacauucacuaacauggaggcgcaacuuauccgacagauggaauccgaggggauuuuuaguccuucugagcuggaaaccccaaaccucgccgagcgcgugcuggauugguuggaaaaauacggagucgagagauuaaagcggauggcuauaagcggugacgacuguguugugaaacccaucgaugacagguucgccacggcacugaccgcucucaaugauaugggcaagguacgcaaagacauuccgcagugggaaccuuccaagggguggaacgauuggcagcaagugcccuuuugcucacaccauuuccaccagcuuaucaugaaggacggaagagagauugucgugccaugucggaaucaggaugagcugguuggcagggcccgagugagucagggugcaggguggucucuacgugaaacagccugccugggaaaaagcuaugcgcaaauguggcagcucauguacuuucacagacgcgacuugcggcuggcugccaacgcaaucuguuccgccgucccuguggauuggguacccacuucaaggaccacauggagcauacaugcucaccaucaguggaugacuaccgaggacaugcuuucuguuuggaauagaguguggaucgaagagaacccauggauggaagauaagacgcacauuuccaguugggaggacguccccuaccugggcaaacgcgaggaccaauggugcggcagccucaucggguuaacagcccgggcaaccugggcuacuaauauucagguggccaucaaccagguuaggcgacugauuggaaaugaaaacuauuuggauuacaugacaucgaugaagagauucaaaaaugaguccgacccugaaggugcgcugugguga

SEQ ID NO: 14125 - RNA, 9879 nt, Artificial Sequence
  derived and/or modified CDS sequence (opt3) from DENV-1__KJ438296__SS-prME
agcgugacaaugcugcucaugcuuaugcccacagcacuggcuuuccacuugacuacgagaggaggggaaccucauaugauggucuccaagcaggaaaggggaaaaucuuuacuguuuaagacaucagccgguguuaacaugugcacacuaaucgccauggaccucggcgaacugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauacagaggguggaaacuugggcucuccggcacccuggauucaccguuaucgcacuguuucuggcccaugcuauuggcacaucgaucacccagaagggcauuaucuucauacucuuaaugcuggugacgccaucaauggccaugcgcugcgucgggaucggaagcagagauuuuguggagggucuuaguggcgcgacuuggguagacguuguguuggagcacggguccugugucacaaccauggcaaaggauaaacccacucuggacauugaacuacucaagacagaggugaccaacccugccgugcugaggaaacuuugcaucgaagcuaagauuucuaauacgaccacagauagccgguguccaacucaaggagaggccacccuggucgaagaacaggacgcaaacuucguuugccgccgaacauuuguggauagaggcugggguaauggguguggauuguucggcaaaggcucccucaucacuugcgcuaaguuuaagugcguaaccaaacuggaggggaagauagugcaguacgaaaacuuaaaauauucagucauugugacaguucacaccggagaccagcaucaaguggguaaugagaguacugaacacggcacgacagccaccaucacuccccaggcgccuaccacagagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacuggaucguucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcuggggaaaaagcccugaagcucuccugguucaagaaaggcucaaguaucggaaagauguuugaggcaacugccagaggcgcuaggcggauggccauccugggggauaccgcaugggacuucggaagcauugguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguugcugggauccuggcccagggcaagaagaugauucgcccucaacccauggaguacaaauauucguggaaaagcuggggcaaggcgaagaucauaggggccgacgugcagaauacuaccuuuaucauugauggaccaaacacaccugaaugucccgacgaucagagagcuuggaauaucugggaggucgaggacuacggcuucgguauuuuuacuaccaacaucuggcuuaaguugagggauuccuauacacaggugugcgaccaccgucucaugucagcagccauaaaagauaguaaggcuguucacgccgacaugggguacuggauugaaucugagaaaaaugaaacguggaagcuggcacgggcgagcuucaucgaggugaagaccuguauuuggccaaaaucccauacucuauggucaaacggaguacuggaaagcgagaugaucauacccaagaucuauggcgguccuauuucucaacacaauuaccgaccaggcuacuucacacagaccgccgggccguggcaucucggaaaacuggagcuugauuuugacuugugcgaaggcacuacagucgugguggaugagcacugcgggaacagaggacccucccugaggaccacgacugucaccggcaagaucauucacgaaugguguugccgcaguuguacauuaccuccacuccgguucagaggugaggacgggugcugguauggaauggagaucaggcccguuaaagaaaaggaggaaaaucuggugaaguccaugguaucugcuggcuccggugagguggacucauuuagucuuggccuguuguguauaagcauuaugaucgaagaggucaugcgcucgcgauggucccggaaaaugcucaugaucgggacccuggccguguucuuucuacugauuaugggacagcucacuuggaacgaucugauccgucuuugcauuaugguuggcgcaaaugcuucugacagaauggggaugggaacaaccuacuuggcccugauggcaacauucaagaugaggccuauguuugccgugggcuuacucuuccgccggcugacuagcagagagguccuucugcuaaccauaggucucucacugguggcuagugcggaauugccaaacucccuggaggaauuaggggauggacucgccaugggcaucaugauucugaaacuucugacggacuuucaaucucaucaguugugggcaacacuccugagccuaaccuucaucaagacuaccuuuucccugcacuaugcuuggaaaacaauggccaugguucuuucaauugugagccucaucccccuguguuugaguacuaccucucagaagacgacauggcugccggucuuacucggcucccuggggugcaagccucuuaccauguuccugauagccgagaauaaaaucuggggaagaaagagcuggccauugaacgaagguauuauggcuguaggcaucgugucgauucuccugucaucucuacugaaaaacgauguuccccuugcagggccucucaucgccggaggcaugcugauagcguguuacgugauuagugguuccagcgcugacuugucuuuagagaaggccgcagaggucagcugggaagaggaagccgagcauuccggggcuucacacaauauccugguggaaguacaggaugacggaacuaugaaaaucaaggaugaggagcgagacgauacacucaccauucugcuuaaagcaacucuguuggccgugaguggcgucuuuccccuaagcauaccagcgacacuguucguuugguauuucuggcaaaagaagaaacagcgcucuggcgugcucugggacaccccuucacccccagaaguggagcgggcuguccuggaugacgggaucuacagaauuaugcagaggggacuuuuaggucguagccaggugggcguugggguauuucaagaaaacguguuccauacgauguggcacgucacucgcggagccgugcugauguaucagggcaagcggcucgagccgaguugggcaagcguuaaaaaggacuugaucuccuacggugggggauggagacugcagggcucuuggaauaccggcgaggaagugcaggucauugccguggagccugggaaaaaccccaagaauguacaaacagcuccaggaaccuuuaagacacccgaaggugaggucggcgccaucgcacucgauuucaaaccugggacuucgggaagcccaauagugaacagggaaggcaagaucguuggucuguacgggaauggaguggucaccacgucaggcacauauguguccgcuauugcccaggcgaaagccagucaggagggcccccuuccugagaucgaagacgagguuuuucgaaagcggaaccugacuauuauggauuugcacccggggucuggaaaaacccgcagauaccuaccagcaaucgugagggaagcuauaaagcggaagcugcgaacacucauuuuagcccccaccagagucguggcuagcgagauggcagaagcccugaaagguaugccuauccgcuaucaaacuaccgccguaaaguccgagcauacaggcaaagagaucguggaccuuaugugccacgcuacguucacuaugaggcugcucucaccaguucguguccccaauuacaacaugauuaucauggaugaagcgcauuuuaccgacccuucuagcauagcagcccggggguauauuaguacaagagugggaaugggcgaggcugccgcaaucuucaugaccgccacuccgcccgguuccguggaggcuuuuccacagagcaaugcggucauucaggaugaggaaagggacaucccugagcgcucuuggaacucaggguacgaguggauaacagauuuccccggaaagaccguaugguuugugccauccauuaaaaguggcaaugacaucgccaacuguuugcgaaagaauggcaagagaguuauccagcugagccggaaaacguucgauacugaauaucaaaagaccaaaaauaacgacugggacuacguggucaccaccgauauuucggagaugggggcaaauuucagggcugaccgcgugaucgauccucguagaugccucaagcccguuauucugaaagacggaccagaacgggugauacuugccgguccgaugccugucacuguggcaucugccgcucagaggcgcggccgaaucgggagaaaccacaauaaggagggagaucaguacauuuauaugggccagccccuaaacaaugacgaggaucaugcccacuggacagaagcgaagaugcuguuggacaacaucaauaccccagaggguaucauucccgcauuauuugaaccugagcgggaaaaauccgccgcuauagauggggaguacaggcugcgcggcgaggccagaaagacauucguagaacucaugaggcggggagaccugccaguguggcuuagcuauaaaguugcuucagagggcuuucaauacagugaucgucgcuggugcuucgacggggaacgaaacaaucagguccuggaggaaaacauggauguggagaucuggacuaaggagggagaaaggaaaaagcucaggccccggugguuggacgcacgcacguauucugacccucuggcccuaagagaguuuaaagaguucgcugccgguaggcgguccgugagcggcgaucugauucucgagaucgggaaacuuccgcagcaccugacccagcgagcacaaaaugcguuagacaacuuggucaugcugcauaauucagaacagggaggcagagccuaccgccacgcuauggaggagcucccagauacaauugaaacucugaugcuucuggcccucaucgcaguuuugaccgguggggugacacuguuuuucuuaaguggcaggggacuaggcaagaccagcauagggcugcucuguguaauggcuuccucugugcuucuguggauggccagcgucgagccccauuggaucgcagccuccauuaucuuggaauuuuuccugauggugcuccugauuccugagcccgaccggcagcguacuccacaggauaaccaacuugcuuauguugugaucggacuccuguuuaugauauugacggucgcggccaaugagaugggucuguuagaaaccaccaaaaaggaccuaggcauugggcacguagcaguggagaaccaccaucacgcugccaugcuggauguugaccuccauccugccucagcauggacucuuuacgcuguggccaccacaaucauuacccccaugaugagacacacuaucgaaaacacaacggcgaauauaucucugaccgcuaucgccaaccaggcagccauuuugaugggacuggauaaaggcuggccaaucaguaagauggacauuggugucccucuccuggcucuugggugcuacagccaggugaauccguuaacucugacagcagccguccucauguugguggcgcauuaugcuaucauaggccccggacugcaagccaaagcaaccagggaggcccagaagcgcaccgcugccggcauuaugaagaacccaacaguugaugggaucguggcaaucgaccuagauccuguaguguacgacgcuaaauucgaaaagcagcugggacagauuaugcuccuuauccuguguacuagccaaauauugcugaugcggacgaccugggcccucugcgaguccauuacacuggcgacuggccccuuaaccacacuuugggaggguucuccagggaaauuuuggaauaccacuaucgccgucucaauggcaaacauuuuccgaggaagcuaucuggcuggcgccggucucgcauucucccuaaugaagagucugggcgggggaagaaggggcacgggggcucagggagaaacauugggcgagaaauggaagcgccggcugaaucagcucucuaagagcgaauuuaacaccuacaaaagaucagguaucauggagguugaccguuccgaagccaaggaggggcuuaaaaggggagagacuaccaagcacgccgugagucggggcacagcgaaacugcgcugguucgucgaacgaaauuuggugaagccugaggguaagguaauagaucugggcugugggagaggaggcuggagcuauuacugcgcugggcucaaaaaggugacugaaguuaaaggauauaccaagggcggucccgggcacgaggaaccgaucccaauggcaacauacggauggaacuuagugaaacugcauucuggcaaggacgucuuuuucauuccucccgagaaaugugauacgcuucugugcgacaucggcgaguccucaccaaaucccaccauugaagaggggaggacucuacgggugcucaagauggucgaaccuuggcugcgcggaaaccaguuuuguaucaagauuuugaauccguacaugcccagcgugguugagacacuggagcaaaugcagagaaaacacgguggcaugcucguaaggaacccacuuucgcgaaauucuacccaugaaauguauugggugaguugcgggacuggaaacaucgucuccgccgugaauaugacaagccggaugcuguuaaaccguuucaccauggcucacagaaagccuacguacgagcgcgauguugaccugggcgccgguaccaggcacguggcagucgaacccgagguggccaacuuggauauaauugggcagcggaucgaaaauaucaaacaugagcacaagucaacauggcauuaugacgaggauaacccuuacaaaacuugggcuuaucacggauccuacgaaguaaagccaucuggcagcgcgaguuccauggugaauggcguugucaagcuccugaccaaacccugggacgugauuccuauggugacacagauagccaugacugauaccacaccauuugggcaacagagagucuucaaggagaaaguugacacccgcacucccaaggcaaaaaggggaacggcucagaucauggaagugacagcccgauggcuaugggguuuucuuagccggaacaagaagccgagaauuuguaccagggaggaguucacucgcaaaguacguucuaaugcagccaucggcgcuguguuuauugacgagaaccaauggaacucagccaaggaggcggucgaagaugagcgguucugggaccuggugcauagagaaagggagcuccacaaacaggggaagugcgcaaccugcguuuauaacaugaugggaaaacgcgaaaagaagcugggcgaguuugguaaagccaaggggagucgagcuaucugguacaugugguugggagcccgguuccuggaguucgaagcacucggcuuuaugaaugaggaucacugguucuccagagaaaacagccuuucuggcguggagggggagggacugcauaaauuagguuacauacugagggacaucucgaagauuccuggcgggaauauguaugcugaugacacagccggaugggauacgcgcaucaccgaagacgauuugcagaacgaggcuaaaauuacugacaucauggaaccagagcacgcccuccuggcaaaggcgauauuuaaacuaacauaccagaauaaggucgugagaguacaacggcccgccaagaacggcaccguuauggaugugauuucaaggcgugaccagcgagguagcgggcaggucggaacuuauggccuuaauacauucaccaacauggaagcucagcugauccgccaaauggaguccgagggcaucuuuaguccuucugaacucgagacaccaaaccuggccgaaagaguguuggauugguuagggaaauacggaguggagcggcugaagaggauggcaauuagcggugacgacugugucguuaaacccauagaugaccgcuucgcuacugcccucaccgcacuuaaugauaugggcaaggugagaaaagacaucccgcagugggaaccuuccaagggguggaacgauuggcagcagguacccuuuugcucacaucacuuccaccaacugauuaugaaggacggacgggagaucguggucccauguaggaaucaggaugagcuagugggccgagcccguguuagucagggugcgggguggucucugagagaaacggcuugccucggaaaaagcuaugcccagauguggcaauugauguacuuucaucgccgggaccugaggcuugcagccaacgcuauuuguuccgccgugccugucgauugggugcccaccucaagaacaacuuggagcauccacgcacaucaccaguggaugaccacagaggacaugcugucuguauggaaucgcguuuggauagaagagaacccauggauggaagauaagacucauaucuccaauugggaggacgugcccuaucucggcaaacgggaggaccaguggugcggcaguuuaauugggcugaccgcuagggccacgugggcgacaaacauccaagucgcuauuaaucaggugcgaagauugaucggaaacgaaaauuaccuggauuacaugaccagcaugaagcgguucaaaaacgagucggacccugaaggugcccucugguga

SEQ ID NO: 14126 - RNA, 9879 nt, Artificial Sequence
  derived and/or modified CDS sequence (opt3) from DENV-1__KC692495__SS-prME
agcgugaccaugcugcucaugcuucugcccaccgccuuggcuuuccacuuaacuacgaggggcggggagccucauaugaucgucuccaagcaggaaaggggaaaaucucugcuauuuaagaccucagcugguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauucagaggggaagacggaugcugguacggcauggaaauccgccccguuaaggagaaagaagagaaucuggugcgaaguaugguaagcgccgguucuggcgaaguggauuccuuuucacuugggauucugugugucaguaucaugauagaggaggugaugcggagccguuggucgagaaagauguugaugacuggaacacucgcuguuuuccugcuacugauuaugggccagcucaccuggaacgaccugaucaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaauugggcucagccugguugccucaguggaguugccaaacagucuggaagaguuaggagauggccucgcuaugggcaucaugaugcugaaacuucugaccgaguuccaaccccaccaguuguggacuacccuccugucccuaacauuugucaagacuacccugucucuugacuaugcguggaaaacgacagccaugguacucagcauugugucccuguucccguugugucugucaaccacuagccagaagacaaccugguuaccuguucuccuggggaguuuuggaugcaaaccacuuacuauguuccugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuacgugauuucagggucuagugcugacuuguccuuagaaaaggcagccgagguaagcugggaacaggaggcggaacauucuggagcuagccacaauauccugguggagguccaagaugacggcaccaugaaaauuaaggaugaggaacgggacgauacgcucacuauccugcuuaaagccacccuguuggcaguuuccggcguguauccaaugucaauaccugccacacuauucgugugguacuuuuggcagaagaaaaagcagagaagugggguccugugggacacccccagcccaccggagguggaaagggcuguucucgaugacggaauuuaucguauccugcagcgcggucuuuuaggccggucucaaguaggggugggagucuuccaggauggcguguuucauacaauguggcacguuacuagaggugcagugcugauguaccaggggaagaggcucgagccuuccugggccucagucaaaaaggacuugaucaguuauggaggcggcuggcgauuccaggggagcuggaacaccggagaggaagugcaaguaauugcggucgagcccgguaaaaauccaaagaacgugcagacgacacccggcacuuuuaaaaccccugaaggggagguuggagcuauagcccuggacuucaagccaggcacauccgguucucccaucgugaaucgggaagggaagauugucggacucuacggcaacggcgugguuaccacuucggggaccuacgugagcgcaaucgcccaggcuaaagccucacaagagggaccucugccggagauugaagaugaggucuuuaagaaacgcaaucuuacaaucauggaccugcacccagguuccggcaagacgagaagguauuugcccgcaauagugcgggaagcuaucaaacgaaagcuaagaacucugauucucgccccuacccgcguaguggcgagugagauggccgaagcauuaaaggggaugccaaucagguaccagacaaccgcuguuaaaucugagcauacuggacgugagauugucgaucugaugugccacgccacauucaccaugcggcuucugagccccgugagagugccuaacuauaauaugaucauaauggacgaagcucauuuuacggauccggcauccauugccgccaggggcuacaucucaacucgcgucgguaugggggaggcugcggcaaucuucaugacagccacacccccaggaucuguagaggcuuuuccucagagcaacgccgugauucaggacgaggaacgagauauccccgagagaaguuggaacuccggcuaugacuggauaaccgauuucccaggcaagacuguuugguucgugccuagcauuaaaucugggaacgacaucgcaaauugucuccggaagaacggaaaaagggucauucaauugucacgcaagacauuugauaccgaguaccagaagaccaaaaauaaugacugggacuaugugguuacuacggauaucuccgaaaugggugccaacuuccgugcugacagagugauagauccccggaggugccugaagccagucauucucaaagacggcccggagcgcgugauccuggcggggccuaugcccguaaccguggccagugcagcucagcgaagaggacggaucggcaggaaucagaacaaggaaggugaucaauacguuuacauggggcagccacuuaauaacgacgaggaucacgcccauuggacagaggcaaaaaugcuacuggacaauauuaacacucccgaaggcaucauuccugccuuguuugagccagaacgcgagaaaagcgcugccauagauggagaauauagauuaaggggcgaagcgcggaagaccuucgucgagcugaugcgucgcggggaccuccccguguggcugucguacaaaguggcaucugaaggauuucaguauuccgaucgaagauggugcuucgacggugagaggaauaaccagguccuugaagagaauauggauguugaaaucuggacaaaggagggcgagcggaaaaagcugcgcccuagauggcucgacgccaggaccuacagcgacccguuggcucugcgggaauuuaaagaguucgccgcugggcgaagaucagugaguggagaucuaauucuggaaaucggcaagcucccacaacaccuuacucugcgcgcacagaacgccuuagacaauuugguaaugcugcacaacucugagcagggugggaaggcuuauaggcaugccauggaagaacuccccgauacgaucgagacccugaugcuucuggcacucauugcgguguugacaggcggagucacucuguuuuucuuauccggcaaggggcuaggaaagaccagcauaggucugcucugugugacagccucaagugcacuucuguggauggccagcguugaaccucacuggaucgcagcuuccauuaucuuggaguuuuuccugauggugcuccugauucccgaaccagaccggcagcguaccccucaagauaaucagcuugccuacgucguaaucggccuccuguuuaugauauugacuguggcagccaacgagauggggcuguuagagacaacgaaaaaggaccuaggaaucggcuauguugcugcggaaaaccaucagcacgccaccaugcuggauguggaccuccaccccgcaucugcuuggacucuuuacgccgucgccacaaccgugauuaccccaaugaugagacauacaaucgagaauacuacggcaaacauuagccugaccgcuaucgccaaucaagcggcuauauugaugggucuggauaaaggguggccuauuuccaagauggacaucggcgucccgcuccuggcccuuggaugcuacucacaggugaaccccuuaacacugacugcagccguucucauguugguggcucacuaugcaauuaucggcccagggcugcaggccaaagcgaccagggaagcucagaagcgcacagccgcaggaauaaugaagaauccuaccguagauggcaucguggccauugaccuagaucccgucguuuacgacgcuaaauucgagaagcaacugggucagaucaugcuccuuauucuguguacuucucagaucuugcugaugcggacgacaugggcccucugcgaaaguauaacccuggcaacugggccauuaaccacacuuugggagggaucgccuggcaaauucuggaacacuaccauugcugugagcauggccaauaucuuucgagguuccuaucuggcgggcgccgggcucgcauucucucuaaugaagucacugggaggcgggagaaggggaacaggcgcucagggugagacguugggggaaaaauggaagcgccaacugaaccagcucagcaaguccgaguuuaauaccuacaaacggaguggaaucauggaagucgacagaucugaggccaaggaaggccuuaaacguggugagacuacaaagcaugcagugagcaggggcaccgcuaaacugcggugguucguagagcgcaacuuggugaagcccgaagggaagguuauugaucugggauguggccgagggggauggucauauuacugcgccggccucaaaaaggugacugaggucaaagguuauacaaaagggggaccgggccacgaggaaccaaucccuauggccaccuacggcuggaauuuagugaaacugcauuccgggaaggacgucuuuuucaugcccccagaaaaaugugauacgcuucugugcgacauaggagagaguagccccaacccuaccauugaggaagguagaacacuaagggugcucaagaugguugagccguggcugcggggcaaucaguuuuguaucaagauuuugaaccccuacaugccaucuguaguggaaacucuggagcagaugcaacgcaaacacgggggaaugcucgucagaaauccucuuuccaggaacucaacccacgagauguauugggugagcugcggcacagguaauaucguuucggcggugaacaugacuucucgaaugcuguuaaaccgguucaccauggcucaucguaagcccacauacgaaagagaugucgaccugggggcaggaacccgccacguggccguagagccugaaguggcuaauuuggauauaaucggccagaggauugagaacaucaaaaaugaacauaagaguacuuggcacuaugacgaggauaacccauacaaaacgugggccuaucacggcuccuacgagguuaagcccagcgggucagcauccucuauggucaauggaguggugcggcuccugacaaagccuugggacgucauuccaaugguuacccagaucgccaugacugauaccacacccuuuggucaacagagaguguucaaagaaaagguagacacgcgcaccccgagggcuaaacgaggcacuacacagauuauggaggugaccgcgaaguggcuauggggguuucuuagccggaacaaaaagccuagaaucuguacuagggaagaguucacacgcaagguccguaguaaugccgcaauaggagcuguguuuguugacgaaaaccaguggaacuccgccaaagaggcaguggaggaugaacgguucugggaccugguccauagagagagggaacuccacaagcaaggcaaaugcgcaaccugcguguauaacaugauggguaagcgcgagaaaaagcugggggaguucggaaaggcuaaaggcagccgagccauuugguacaugugguugggcgcgcgguuucuggaguucgaggcacucggguuuaugaaugaagaucauugguucucuagagagaacucacuuaguggaguagaaggugagggccugcacaaguuaggguacauccugagggacaucuccaaaauuccaggaggcaauauguaugccgaugacacagcugguugggauacucgcauaaccgaggacgauuugcagaacgaagccaagaucacggacauuauggagcccgaacaugcacuccuggcuaccagcaucuuuaaacuaacauaccagaauaagguugugagaguccagcggccugccaaaaacgggacugugauggaugugauuucuaggcgugaccaacgaggaucgggccaggucggcaccuaugggcuuaacacauucacuaauauggagguucagcugauccgccagauggaaucagagggaauauuucucccaagcgagcuggaaacccccaacuuggcugagagagccuuagauuggcuggaaaagcacggugcagagcggcucaagaggauggcgaucuccggcgacgacugugugguaaaaccgauugaugaccgcuucgccacggcucuuacagcccugaaugauauggggaaggugagaaaagacaucccucaaugggaacccaguaagggauggaacgauuggcagcaggucccauuuugcucucaccauuuccaccagcuaauuaugaaagacggccgggagaucgugguuccuuguaggaaucaagaugagcuggugggucgagcacgugucagccagggggcuggauggucccucagagaaaccgccugcuugggcaagucauacgcacagauguggcaacugauguauuuucaucgccgggaccuuaggcuggccgcgaacgcuauauguagugccgugcccguagauuggguuccagcaucuagaacuacauggagcauucacgcccaccaucaguggaugaccacugaggacaugcucuccguguggaaucgcgucuggaucgaagagaaccccuggauggaagauaagacccacgugucaagcugggaggagguuccuuacuuaggcaaacgggaagaccaguggugcgggucucugaucggauugacagcuagggccacgugggcaaccaauauucagguggcuauaaaccaaguccgaagacugaucgguaaugagaacuaucucgacuacaugacuuccaugaagcgguucaaaaaugaaagugauccagagggcgcccuuugguga

SEQ ID NO: 14127 - RNA, 9879 nt, Artificial Sequence
  derived and/or modified CDS sequence (opt3) from DENV-1__KC692496__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaagcuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagagaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaagcuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggaaaaaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugaaaaaaaugagacguggaagcuggccagagcaucuuucauugaagugaaaaccuguacuuggccaaagagccacacacuaugguccaacggcguacuggagucagagaugaucauucccaagaucuuugguggcccuauaagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagaucauucaugagugguguugcagauccuguaccuuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugacuggaacacucgcuguuuuccugcuacugauuaugggccagcucaccuggaacgaccugauccgccuuugcaucauggugggggccaaugcauccgaccggaugggaaugggcacaacuuacuuggcucugauggccaccuuuaagaugagaccuauguucgcagucgguuuacucuuuaggcgacugacgucucgcgaagugcuucugcuaacaauugggcucagccugguugccucaguggaguugccaaacagucuggaagaguuaggagauggccucgcuaugggcaucaugaugcugaagcuucugaccgaauuccaaccccaccaguuguggacuacccuccugucccuaacauuugucaaaacuacccugucucuugacuaugcguggaagacgacagccaugguacucagcauugugucccuguucccguugugucugucaaccacuagccagaaaacaaccugguuaccuguucuccuggggaguuuuggaugcaagccacuuacuauguuccugauaacagagaacaaaaucuggggucggaagucuuggcccuugaaugagggcauuauggcaaucgggauuguguccauccuccugagcucgcuacugaagaacgaugucccucuugcuggaccccuccuggccggcgguauguugauagccuguuacgugaucucagggucuagugcugacuuaucccuggaaaaagcagccgagguaagcugggaacaggaggcggaacauucuggagcuagccacaauauucucguggagguccaagaugacggcaccaugaagaucaaagaugaggaaagagacgauacgcugacuauucuucugaaggccaccuugcuagcaguuuccggcguguauccaaugucaaucccugccacacuguucgugugguacuuuuggcagaaaaagaaacagaggagugggguccucugggacacccccagcccaccggagguggaacgugcuguucuggaugacggaauauaucgcauucuucagcgggguuuacugggcagaucucaaguaggggugggagucuuccaggauggcguguuucauacaauguggcacguuacuaggggugcagugcucauguaccaggggaagcgauuggagccuuccugggccucagucaagaaagaccugaucaguuauggaggcggcuggcgguuccaggggagcuggaacaccggagaggaagugcaaguaaucgcggucgagcccgguaagaauccaaaaaacgugcagacgacacccggcacuuuuaagaccccugaaggggagguuggagcuauugcccucgacuucaaaccaggcacauccgguucucccauagugaaucgcgaagggaagaucgucggacuguacggcaacggcgugguuaccacuucggggaccuacgugagcgcaauugcccaggcuaaggccucacaagagggaccucuuccggagaucgaagaugaggucuuuaaaaagagaaaucugacaauuauggacuugcacccagguuccggcaaaacgaggcgguaucuacccgcaaucgugcgagaagcuauaaagagaaaacugcgcacucucaucuuagccccuaccaggguaguggcgagugagauggccgaagcacugaaggggaugccaauucguuaccagacaaccgcuguuaagucugagcauacuggacgggagaucgucgaucuuaugugccacgccacauucaccaugagacugcucagccccgugagggugccuaacuauaauaugauuaucauggacgaagcucauuuuacggauccggcauccauagccgcccgcggcuacauuucaacucgagucgguaugggggaggcugcggcaaucuucaugacagccacccccccaggaucuguagaagcuuuuccucagagcaacgccgugauccaggacgaggaaagagauauucccgagcggaguuggaauuccggcuaugacuggaucaccgauuucccaggcaaaacuguuugguucgugccuagcauaaagucugggaacgacauugcaaauuguuugaggaaaaacggaaagcgcgucauccaacugucacguaaaacauuugauaccgaguaccagaagacaaagaacaaugacugggacuaugugguuacuacggauauuuccgaaaugggugccaacuucagagcugaccgggugaucgaucccaggcgcugccucaaaccagucauacugaaggacggcccggagcgagugauucuugcggggccuaugcccguaaccguggccagugcagcucagagacggggaaggaucggccgcaaucagaacaaagaaggugaucaauacguuuacauggggcagccacuaaauaacgacgaggaucacgcccauuggacagaggcaaagaugcuguuggacaauaucaacacucccgaaggcauuaucccugccuuauuugagccagaaagagagaaaagcgcugccauugauggagaauauaggcugcggggcgaggcgcguaagaccuucgucgagcucaugcgccgaggggaccugcccguguggcuuucguacaagguggcaucugaaggauuucaguauuccgauagaagguggugcuucgacggugagcggaauaaccagguccuggaagagaauauggauguugaaauauggacaaaagagggcgagcgcaagaaacucagaccuaggugguuggacgcccggaccuacagcgacccgcuggcucuacgagaauuuaaggaguucgccgcugggagacgcucagugaguggagaucugauccucgaaauuggcaaacuuccacaacaccugacuuuaagggcacagaacgccuuggacaaucugguaaugcuccacaacucugagcagggugggaaggcuuaucggcaugccauggaagagcugcccgauacgaucgagacccuuaugcugcucgcauugaucgcggugcugacaggcggagucacuuuauuuuuccuauccggcaaagggcugggaaagaccagcauuggucuccuuugugugacagccucaagugcucuguuguggauggccagcguugaaccucacuggauagcagcuuccaucauucuggaguuuuuccucauggugcugcuuauccccgaaccagaccgucagagaaccccucaagauaaucagcucgccuacgucguaauuggccuguuguuuaugauccugacuguggcagccaacgagaugggguuacuagagacaacgaagaaagaccugggaauaggcuauguugcugcggaaaaccaucagcacgccaccaugcucgauguggaccuucaccccgcaucugcuuggacucuguacgccgucgccacaaccgugaucaccccaaugaugaggcauacaauugagaauacuacggcaaacaucagcuugaccgcuauugccaaucaagcggcuauccugaugggucucgauaagggguggccuauauccaaaauggacauuggcgucccgcugcuugccuuaggaugcuacucacaggugaacccccugacacucacugcagccguuuugaugcugguggcucacuaugcaaucauuggcccagggcuacaggccaaggcgacccgcgaagcucagaaacggacagccgcaggaaucaugaagaauccuaccguagauggcauaguggccaucgaccuggaucccgucguuuacgacgcuaaguucgagaaacaacucggucagauuaugcuucugaucuuguguacuucucagauucugcucaugcgaacgacaugggcccugugcgaaaguaucaccuuagcaacugggccacuuaccacacugugggagggaucgccuggcaaguucuggaacacuaccauagcugugagcauggccaauauuuuuagagguuccuaucucgcgggcgccgggcuagcauucucucugaugaaaucauugggaggcgggaggcgcggaacaggcgcucagggugagacgcugggggaaaaguggaaacggcaacucaaccagcuuagcaaguccgaguuuaauaccuacaagagaaguggaaucauggaagucgaccguucugaggccaaagaaggccugaagaggggugagacuacaaaacaugcagugagccggggcaccgcuaaguugcgcugguucguagagcgaaaccuggugaaacccgaagggaagguuaucgaucucggauguggcagagggggauggucauauuacugcgccggcuuaaagaaagugacugaggucaaggguuauacaaaagggggaccgggccacgaagagccaauuccuauggccaccuacggcuggaaucuggugaagcuucauuccgggaaagacgucuuuuucaugcccccagaaaagugugauacgcugcuaugcgacaucggagagaguagccccaacccuaccauagaggaagguaggacacuccgggugcugaaaaugguugagccgugguugcgcggcaaucaguuuuguauuaagauccugaaccccuacaugccaucuguaguggaaacucucgagcagaugcaaagaaagcacgggggaaugcuugucaggaauccucugucccgaaacucaacccacgagauguauugggugagcugcggcacagguaauauuguuucggcggugaacaugacuucucggauguuacugaaccguuucaccauggcucauagaaaacccacauacgaacgcgaugucgacuugggggcaggaaccaggcacguggccguagagccugaaguggcuaaucucgauaucauaggccagcggaucgagaacauuaagaaugaacauaaaaguacuuggcacuaugacgaggauaacccauacaagacgugggccuaucacggcuccuacgagguuaaacccagcgggucagcauccucuauggucaauggaguggugagacugcuaacaaagccuugggacgucaucccaaugguuacccagauugccaugacugauaccacacccuuuggucaacagcgcguguucaaggaaaaaguagacacgaggaccccgcgagcuaagcggggcacuacacagaucauggaggugaccgcgaaauggcuuuggggguuucugagcagaaacaagaaaccuaggauuuguacucgcgaagaguucacacguaagguccggaguaaugccgcaaucggagcuguguuuguugacgaaaaccaguggaauuccgccaaggaggcaguggaggaugaaagauucugggaccucguccauagggagcgcgaacugcacaaacaaggcaagugcgccaccugcguguauaacaugauggguaaacgagagaagaaauugggggaauucggaaaggcuaagggcagccgggccauaugguacauguggcugggcgcgagauuucucgaguucgaggcacuuggguuuaugaaugaagaucauugguucucuagggagaacucacugaguggaguagaaggugagggcuuacacaaacugggguacauuuugcgcgacaucuccaagaucccaggaggcaauauguaugccgaugacacagcugguugggauacuagaauuaccgaggacgaucuccagaacgaagccaaaauaacggacaucauggagcccgaacaugcacugcuagcuaccagcauuuuuaagcuuacauaccagaauaaaguugugcggguccagaggccugccaagaacgggacugugauggaugugaucucucgucgagaccaacgcggaucgggccaggucggcaccuaugggcugaacacauucacuaauauggagguucagcucauuagacagauggaaucagagggaaucuuucugccaagcgaguuggaaacccccaacuuagcugagcgggcccuggauuggcucgaaaaacacggugcagagaggcuuaagcgcauggcgauauccggcgacgacugugugguaaagccgaucgaugacagauucgccacggcucugacagcccuaaaugauauggggaaagugcggaaggacauuccucaaugggaacccaguaaaggauggaacgauuggcagcaggucccauuuugcucucaccauuuccaccagcugaucaugaaggacggcagggagauugugguuccuugucgaaaucaagaugagcucgugggucgugcaagagucagccagggggcuggaugguccuugcgcgaaaccgccugccugggcaaaucauacgcacagauguggcaacuuauguauuuucaucggagggaccugagacucgccgcgaacgcuaucuguagugccgugcccguagauuggguuccagcaucucgcacuacauggagcauacacgcccaccaucaguggaugaccacugaggacauguuauccguguggaaucgggucuggauugaagagaaccccuggauggaagauaagacccacgugucaagcugggaggagguuccuuaccugggcaagagggaagaccaguggugcgggucuuugaucggacugacagcucgagccacgugggcaaccaauauccagguggcuauuaaccaagucagacggcucauagguaaugagaacuaucuugacuacaugacuuccaugaaaagguucaagaaugaaagugauccagagggcgcccugugguga

SEQ ID NO: 14128 - RNA, 9879 nt, Artificial Sequence
  derived and/or modified CDS sequence (opt3) from DENV-1__KC692497__SS-prME
agcgugaccaugcugcucaugcuucugcccacagcauuggcuuuccacuuaacuacgaggggcggggagccucauaugaucgucuccaagcaggaaaggggaaagucucuguuauuuaagaccucagccgguguuaauaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaauagagacuuuguggaggguuugagcggcgcgacuuggguagauguugugcuggaacacgggaguugugucacaaccauggcaaagaauaaacccacucuagacaucgagcuccugaagacagaagugaccaacccugccgugcuuaggaaacugugcauugaggcuaagaucuccaauacgaccacagauucucgguguccaacucaaggagaagccaccuuggucgaggagcaggacgcaaacuucguuugccgccgaacauuuguggauagaggcugggguaauggguguggacucuucggcaaaggcagccuguuaacuugcgcuaaguuuaagugcguaaccaaacuggaagggaagauagugcaguacgagaaccucaaauauuccgucauugugacaguucacaccggagaccagcaucaaguggguaaugaaacuacggagcacggcacaaucgccaccauuacuccccaggcgccuaccucagaaauccagcuuacagauuacggggcccugaccuuggacuguaguccaaggacuggacuagacuucaacgagaugguccugcucacaaugaaggagaaaagcuggcuggugcauaagcagugguuucuugaucugccguugcccuggacgucuggcgcauccaccucacaagaaacuuggaaucggcaggaccuccugguaacauucaaaaccgcucacgccaagaagcaggagguuguggucuuagguagccaagaaggggcuaugcacacagcccugacuggcgcaaccgagauccagacgaguggaaccacaacuauuuuugccggccaucuaaaaugccgucucaagauggauaaacugacccuuaaggggaugucuuaugugauguguacaggauccuucaaauuggaaaaggaggucgcugagacucagcacgguaccgugcugguucaggugaaguacgaaggcacggacgcgccuugcaaaauaccauucagcacacaagaugagaaggggguaacccagaacggacgccucaucacugcaaaucccauugucacagacaaagaaaagccugugaacaucgagaccgagccacccuuuggcgaaucguauauaguugugggugccggggagaaagcucugaaacuuucuugguucaagagaggcuccucaauuggaaaaauguuugaagccacugcaaggggcgcccggcgaauggcuauccugggggauaccgccugggacuucggaaguaucgguggcgucuuuacaagcguggggaaguugguacaucagguguucggaacggcauacggcguucucuuuuccggugucucuuggaccaugaaaauugggaucggcauucuguuaacuuggcugggacuaaauagccgcucaacaagucucuccaugaccuguauagcggugggcauggugacacuguaccuuggggucaugguucaggcugauagcggaugcgugaucaacuggaagggcagagaguugaaaugugguucugggauuuucgugacuaacgaaguacacaccuggacggagcaauauaaguuucaggccgacucaccgaagaggcugagugcagccaucggaaaggcuugggaggaaggcgucugcgguauccggagcgccacacgccucgagaauauuauguggaagcagauauccaacgaacugaaucauaucuuacuggagaacgauaugaaauucaccgugguugugggcgacgcaaaugggauucuugcucagggaaagaaaaugaucagaccucaacccauggaacacaaguacucuuggaaaucguggggcaaggccaagauuaucggggcggacauacagaacacuaccuuuaucauugauggaccagacacaccugagugucccgauggccagagggccuggaauaucugggaggucgaagacuaugguuucgggguguuuacuaccaacauuugguugaaacuccgugauagcuacacacagaugugcgaccaccggcugauguccgcugcaaucaaggauucaaaagccguucaugcugacaugggauauuggauagagagugaaaagaaugagacguggaaacuagcccgagcaucuuucauugaagugaagaccuguacuuggccaaagagccacacacugugguccaacggcguacucgagucagagaugaucauucccaaaaucuucgguggcccuauaagccaacauaauuacagaccaggguauuuuacccagacugcgggaccguggcaccugggcaaacuugaauuggauuucgaccugugcgaggggacaaccgucgugguggaugaacacugcggaaacaggggccccucuuuacgcacgacuaccgucacagguaaaaucauucaugagugguguugccgguccuguacccucccuccacugagauuuagaggggaagacggaugcugguacggcauggaaauccgccccguuaaggagaaagaagagaaucuugugcgaaguaugguaagcgccgguucuggcgaaguggauuccuucucacuggggauuuugugugucaguaucaugauagaggaggugaugcggagccguuggucgagaaagaugcucaugacuggaacacuggcuguuuuucuacugcucauuaugggccagcugaccuggaacgaccuuaucagguugugcaucauggugggggccaaugcauccgaccgcaugggaacaggcacuaccuaccuggcuuuaauggccacguucaagaugcggccuauguuugcagucggucuccuguucagaaggcuuacaucucgagaagugcugcuacucaccauugggcugagcuugguugccucaguggagcugccaaacaguuuagaggaacucggagauggccuggcuaugggcaucaugaugcuuaaacuguugacugaauuucaaccccaccagcucuggaccacacugcuaucccugacuuucgucaagaccacgcuuucucucgacuaugcguggaaaacaaccgccaugguacugagcauuguguccuuguuuccgcuguguuuaucaacuacaagccagaagaccacuuggcucccuguucugcuugggaguuucggaugcaaaccacugacaauguuuuugauaaccgagaacaagaucuggggucgcaagucuuggccccucaaugagggcauuauggcaaucgggauuguguccauccugcuaagcucgcugcuuaaaaacgaugucccucucgcuggaccccugauagccggcgguauguugaucgccuguuacgugauuucagggucuagugcugacuuaucccuggaaaaggcagccgagguaagcugggaacaggaggcggaacauucuggagcuagccacaauauccucguggagguccaagaugacggcacgaugaaaauuaaggaugaggaacgggacgauacucugaccauccuucugaaagccacauugcuagcaguuuccggcguguauccaaugucaauaccugccacccuguucgugugguacuucuggcagaagaaaaagcagagaagugggguccucugggacacacccagcccaccggagguggaaagggcuguucuggaugacggaauuuaucguauccuucagcgcgguuuacugggccggucucaaguaggggugggagucuuucaggauggcguguuccauacuauguggcacguuaccagaggugcagugcucauguaccaggggaagagguuggagccuuccugggccucagucaaaaaggaccugaucaguuauggaggcggcuggcgauuucaggggagcuggaacacgggagaggaagugcaaguaauugcggucgagcccgguaaaaauccaaagaacgugcagacaacucccggcaccuucaaaacaccugaaggggagguuggagcuauagcccucgacuuuaagccaggcaccuccgguucucccaucgugaaucgggaagggaagauugucggacuguacggcaacggcgugguuacuaccucggggacauacgugagcgcaaucgcccaggcuaaagccucacaagagggaccucuuccggagauugaagaugaggucuucaagaaacgcaaucugacgaucauggacuugcacccagguuccggcaagacuagaagguaucuacccgcaauagugcgggaagcuaucaaacgaaagcugagaacccucauuuuagccccuacacgcguaguggcgagugagauggccgaagcacugaaggggaugccaaucagguaccagaccacugcuguuaaaucugagcauacaggacgugagauugucgaucuuaugugccacgccaccuuuacgaugcggcugcucagccccgugagagugccuaacuauaauaugaucauaauggacgaagcucauuucacugauccggcauccauugccgccaggggcuacaucucaacacgcgucgguaugggggaggcugcggcaaucuuuaugaccgccacacccccaggaucuguagaggcuuucccucagagcaacgccgugauucaggacgaagaacgagauauccccgagagaaguuggaacuccggcuaugacuggauaacugauuuuccaggcaagacaguuugguucgugccuagcauuaaaucugggaacgacaucgcaaauuguuugcggaagaacggaaaaagggucauucaacugucacgcaagaccuucgauacagaguaccagaagacuaaaaacaaugacugggacuaugugguuacgaccgauaucuccgaaaugggugccaacuuucgugcugacagagugauagauccccggaggugccucaagccagucauucugaaagacggcccggagcgcgugauccuugcggggccuaugcccguaacaguggccagugcagcucagcgaagaggacggaucggcaggaaucagaacaaggaaggugaucaauacguuuacauggggcagccacuaaauaacgacgaggaucacgcccauuggacugaggcaaaaaugcuguuggacaauauuaacacccccgaaggcaucauuccugccuuauucgagccagaacgcgaaaagagcgcugccauagauggagaauauagacugaggggcgaggcgcggaagacauuugucgagcucaugcgucgcggggaccugcccguguggcuuucguacaaaguggcaucugaaggauuccaguauuccgaucgaagauggugcuuugacggugagaggaauaaccagguccuggaagagaauauggauguugaaaucuggaccaaggagggcgagcggaaaaagcuccgcccuagaugguuggacgccaggacuuacagcgacccgcuggcucuacgggaguucaaagaguuugccgcugggcgaagaucagugaguggagaucugauucucgaaaucggcaaacuuccacaacaccugacguuacgcgcacagaacgccuuggacaaucugguaaugcuccacaacucugagcagggugggaaggcuuauaggcaugccauggaggaacugcccgauaccaucgagacacuuaugcugcucgcauugauugcggugcugacuggcggagucaccuuauucuuucuauccggcaaggggcugggaaagacaagcauaggucuccuuugugugaccgccucaagugcucuguuguggauggccagcguugaaccucacuggaucgcagcuuccauuauccuggaguucuuucucauggugcugcuuauucccgaaccagaccggcagcguacuccucaagauaaucagcucgccuacgucguaaucggccuguuguucaugauacugacaguggcagccaacgagaugggguuacuagagacgaccaaaaaggaccugggaaucggcuauguugcugcggaaaaccaucagcacgccacuaugcucgauguggaccuucaccccgcaucugcuuggacacuguacgccgucgccaccaccgugauuacaccaaugaugagacauacuaucgagaauacgaccgcaaacauuagcuugacagcuaucgccaaucaagcggcuauacugaugggucucgauaaaggguggccuauuuccaagauggacaucggcgucccgcugcuugccuuaggaugcuacucacaggugaacccccugacucucaccgcagccguuuugaugcugguggcucacuaugcaauuaucggcccagggcuacaggccaaagcgacaagggaagcucagaagcgcaccgccgcaggaauaaugaagaauccuacuguagauggcaucguggccauugaccuggaucccgucguuuacgacgcuaaauuugagaagcaacucggucagaucaugcuucugauuuuguguacgucucagauccugcucaugcggacaaccugggcccugugcgaaaguauaacuuuagcaaccgggccacuuacaacucugugggagggaucgccuggcaaauucuggaacaccacaauugcugugagcauggccaauaucuuccgagguuccuaucucgcgggcgccgggcuagcauuuucucugaugaagucauugggaggcgggagaaggggaacgggcgcucagggugagacccugggggaaaaauggaagcgccaacucaaccagcuuagcaaguccgaguucaauacuuacaaacggaguggaaucauggaagucgacagaucugaggccaaggaaggccugaaacguggugagacaaccaagcaugcagugagcaggggcacugcuaaauugcggugguuuguagagcgcaaccuggugaagcccgaagggaagguuauugaucucggauguggccgagggggauggucauauuacugcgccggccuaaagaaggugacagaggucaaagguuauaccaaagggggaccgggccacgaggaaccaaucccuauggccacguacggcuggaaucuggugaaacuucauuccgggaaggacgucuucuuuaugcccccagaaaaaugugauacccugcuaugcgacauaggagagaguagccccaacccuacaauugaggaagguagaacucucagggugcugaagaugguugagccgugguugcggggcaaucaguucuguaucaagauucugaaccccuacaugccaucuguaguggaaacccucgagcagaugcaacgcaaacacgggggaaugcuugucagaaauccucuguccaggaacucaacacacgagauguauugggugagcugcggcacugguaauaucguuucggcggugaacaugaccucucgaauguuacugaaccgguuuacaauggcucaucguaagcccaccuacgaaagagaugucgacuugggggcaggaacucgccacguggccguagagccugaaguggcuaaucucgauguuauaggccagaggaucgagaacauuaaaaaugaacauaagaguacguggcacuaugacgaggauaacccauacaaaacaugggccuaucacggcuccuacgaggucaagcccagcgggucagcauccucuauggugaauggagugguccggcugcuaaccaagccuugggacguuaucccaauggugacucagauugccaugaccgauacaacgcccuucggucaacagagaguauuuaaagaaaagguggacacccgcacuccgagggcuaaacgaggcacaacccagaucauggaggucacugcgaaguggcuuuggggguuccugagccggaacaaaaagccuagaauuuguacaagggaagaguuuacccgcaaggugcguaguaaugccgcaaucggagcuguuuucguggacgaaaaccaguggaacuccgccaaagaggcagucgaggaugaacgguuuugggaccucgugcauagagagagggaacugcacaagcaaggcaaaugcgccacaugcguauauaacaugauggguaagcgcgagaaaaaguugggggaguucggaaaggcuaaaggcagccgagccauaugguacauguggcugggcgcgcgguuccucgaguuugaggcacuuggguucaugaaugaagaucauugguuuucuagagagaacucacugaguggaguugaaggugagggcuuacacaagcugggguacauuuugagggacaucuccaaaaucccaggaggcaauauguaugccgaugacacugcugguugggauacccgcauuacggaggacgaucuccagaacgaagccaagauaaccgacaucauggagcccgaacaugcacugcuagcuacaagcauuuucaaacuuacuuaccagaauaagguggucagagugcagcggccugccaaaaacgggaccgugauggaugucaucucuaggcgugaccaacgaggaucgggccagguuggcacauaugggcugaacacuuuuaccaauauggaggugcagcucauucgccagauggaaucagagggaaucuuccugccaagcgaguuggaaacgcccaacuuagcugagagagcccuggauuggcucgaaaagcacggugcagagcggcuuaagaggauggcgauauccggcgacgacuguguagugaaaccgaucgaugaccgcuuugccacagcucugaccgcccuaaaugauauggggaaggucagaaaagacauuccucaaugggaacccaguaagggauggaacgauuggcaacaggugccauucugcucucaccauuuucaccagcugaucaugaaagacggccgggagauuguugugccuuguaggaaucaagaugagcucgucggucgagcacgugugagccagggggcuggaugguccuugagagaaacugccugccugggcaagucauacgcacagauguggcaacuuauguauuuccaucgccgggaccugaggcucgccgcgaacgcuaucuguagugccguacccguugauugggugccagcaucuagaacaaccuggagcauacacgcccaccaucaguggaugacuaccgaggacauguuauccgucuggaaucgcguguggauugaagagaaccccuggauggaagauaagacacacguuucaagcugggaggaggugccuuaccugggcaaacgggaagaccaguggugcgggucuuugaucggacugacggcuagggccaccugggcaacuaauauccaggucgcuauuaaccaagugcgaagacucauagguaaugagaacuaucuugacuacaugacauccaugaagcgguuuaaaaaugaaagugauccagagggcgcccugugguga

SEQ ID NO: 14129 - RNA, 9879 nt, Artificial Sequence
  derived and/or modified CDS sequence (opt3) from DENV-1__KC692498__SS-prME
agcgugaccaugcugcucaugcuucugcccacagcauuggcuuuccacuuaacuacgaggggcggggagccucauaugaucgucuccaagcaggaaaggggaaagucucuguuauuuaagaccucagccgguguuaauaugugcacccucauugccauggaccugggcgagcuuugugaagauacuaugaccuacaagugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagacuuuguggaggguuugagcggcgcgacuuggguagauguugugcuggaacacgggaguugugucacaaccauggcaaagaauaaacccacucuagacaucgagcuccugaagacagaagugaccaacccugccgugcuuaggaaacugugcauugaggcuaagaucuccaauacgaccacagauucucgguguccaacucaaggagaagccaccuuggucgaggagcaggacgcaaacuucguuugccgccgaacauuuguggauagaggcugggguaauggguguggacucuucggcaaaggcagccuguuaacuugcgcuaaguuuaagugcguaaccaaacuggaagggaagauagugcaguacgagaaccucaaauauuccgucauugugacaguucacaccggagaccagcaucaaguggguaaugaaacuacggagcacggcacaaucgccaccauuacuccccaggcgccuaccucagaaauccagcuuacagauuacggggcccugaccuuggacuguaguccaaggacuggacuagacuucaacgagaugguccugcucacaaugaaggagaaaagcuggcuggugcauaagcagugguuucuugaucugccguugcccuggacgucuggcgcauccaccucacaagaaacuuggaaucggcaggaccuccugguaacauucaaaaccgcucacgccaagaagcaggagguuguggucuuagguagccaagaaggggcuaugcacacagcccugacuggcgcaaccgagauccagacgaguggaaccacaacuauuuuugccggccaucuaaaaugccgucucaagauggauaaacugacccuuaaggggaugucuuaugugauguguacaggauccuucaaauuggaaaaggaggucgcugagacucagcacgguaccgugcugguucaggugaaguacgaaggcacggacgcgccuugcaaaauaccauucagcacacaagaugagaaggggguaacccagaacggacgccucaucacugcaaaucccauugucacagacaaagaaaagccugugaacaucgagaccgagccacccuuuggcgaaucguauauaguugugggugccggggagaaagcucugaaacuuucuugguucaagagaggcuccucaauuggaaaaauguuugaagccacugcaaggggcgcccggcgaauggcuauccugggggauaccgccugggacuucggaaguaucgguggcgucuuuacaagcguggggaaguugguacaucagguguucggaacggcauacggcguucucuuuuccggugucucuuggaccaugaaaauugggaucggcauucuguuaacuuggcugggacuaaauagccgcucaacaagucucuccaugaccuguauagcggugggcauggugacacuguaccuuggggucaugguucaggcugauagcggaugcgugaucaacuggaagggcagagaguugaaaugugguucugggauuuucgugacuaacgaaguacacaccuggacggagcaauauaaguuucaggccgacucaccgaagaggcugagugcagccaucggaaaggcuugggaggaaggcgucugcgguauccggagcgccacacgccucgagaauauuauguggaagcagauauccaacgaacugaaucauaucuuacuggagaacgauaugaaauucaccgugguugugggcgacgcaaaugggauucuugcucagggaaagaaaaugaucagaccucaacccauggaacacaaguacucuuggaaaucguggggcaaggccaagauuaucggggcggacauacagaacacuaccuuuaucauugauggaccagacacaccugagugucccgauggccagagggccuggaauaucugggaggucgaagacuaugguuucgggguguuuacuaccaacauuugguugaaacuccgugauagcuacacacagaugugcgaccaccggcugauguccgcugcaaucaaggauucaaaagccguucaugcugacaugggauauuggauagagagugaaaagaaugagacguggaaacuagcccgagcaucuuucauugaagugaagaccuguacuuggccaaagagccacacacugugguccaacggcguacucgagucagagaugaucauucccaaaaucuucgguggcccuauaagccaacauaauuacagaccaggguauuuuacccagacugcgggaccguggcaccugggcaaacuugaauuggauuucgaccugugcgaggggacaaccgucgugguggaugaacacugcggaaacaggggccccucuuuacgcacgacuaccgucacagguaaaaucauucaugagugguguugccgguccuguacccucccuccacugagauuuagaggggaagacggaugcugguacggcauggaaauccgccccguuaaggagaaagaagagaaucuugugcgaaguaugguaagcgccgguucuggcgaaguggauuccuucucacuggggauuuugugugucaguaucaugauagaggaggugaugcggagccguuggucgagaaagaugcucaugacuggaacacuggcuguuuuucuacugcucauuaugggccagcugaccuggaacgaccuuaucagguugugcaucauggugggggccaaugcauccgaccgcaugggaacaggcacuaccuaccuggcuuuaauggccacguucaagaugcggccuauguuugcagucggucuccuguucagaaggcuuacaucucgagaagugcugcuacucaccauugggcugagcuugguugccucaguggagcugccaaacaguuuagaagaacucggagauggccuggcuaugggcaucaugaugcuuaaacuguugacugaauuucaaccccaccagcucuggaccacacugcuaucccugacuuucgucaagaccacgcuuucucucgacuaugcguggaaaacaaccgccaugguacugagcauuguguccuuguuuccgcuguguuuaucaacuacaagccagaagaccacuuggcucccuguucugcuugggaguuucggaugcaaaccacugacaauguuuuugauaaccgagaacaagaucuggggucgcaagucuuggccccucaaugagggcauuauggcaaucgggauuguguccauccugcuaagcucgcugcuuaaaaacgaugucccucucgcuggaccccugauagccggcgguauguugaucgccuguuacgugauuucagggucuagugcugacuuaucccuggaaaaggcagccgagguaagcugggaacaggaggcggaacauucuggagcuagccacaauauccucguggagguccaagaugacggcacgaugaaaauuaaggaugaggaacgggacgauacucugaccauccuucugaaagccacauugcuagcaguuuccggcguguauccaaugucaauaccugccacccuguucgugugguacuucuggcagaagaaaaagcagagaagugggguccucugggacacacccagcccaccggagguggaaagggcuguucuggaugacggaauuuaucguauccuucagcgcgguuuacugggccggucucaaguaggggugggagucuuucaggauggcguguuccauacuauguggcacguuaccagaggugcagugcucauguaccaggggaagagguuggagccuuccugggccucagucaaaaaggaccugaucaguuauggaggcggcuggcgauuucaggggagcuggaacacgggagaggaagugcaaguaauugcggucgagcccgguaaaaauccaaagaacgugcagacaacucccggcaccuucaaaacaccugaaggggagguuggagcuauagcccucgacuuuaagccaggcaccuccgguucucccaucgugaaucgggaagggaagauugucggacuguacggcaacggcgugguuacuaccucggggacauacgugagcgcaaucgcccaggcuaaagccucacaagagggaccucuuccggagauugaagaugaggucuucaagaaacgcaaucugacgaucauggacuugcacccagguuccggcaagacuagaagguaucuacccgcaauagugcgggaagcuaucaaacgaaagcugagaacccucauuuuagccccuacacgcguaguggcgagugagauggccgaagcacugaaggggaugccaaucagguaccagaccacugcuguuaaaucugagcauacaggacgugagauugucgaucuuaugugccacgccaccuuuacgaugcggcugcucagccccgugagagugccuaacuauaauaugaucauaauggacgaagcucauuucacugauccggcauccauugccgccaggggcuacaucucaacacgcgucgguaugggggaggcugcggcaaucuuuaugaccgccacacccccaggaucuguagaggcuuucccucagagcaacgccgugauucaggacgaagaacgagauauccccgagagaaguuggaacuccggcuaugacuggauaacugauuuuagcggcaagacaguuugguucgugccaucuauuaaaucagggaacgacaucgcaaauuguuugcggaagaacggaaaaagggucauucaacugucccgcaagaccuucgauacagaguaccagaagacuaaaaacaaugacugggacuaugugguuacgaccgauaucagugaaaugggugccaacuuucgugcugacagagugauagauccucggaggugccucaagcccgucauucugaaagacggcccagagcgcgugauccuugcggggccgaugccuguaacaguggccagcgcagcucagcgaagaggacggaucggcaggaaucagaacaaggaaggugaucaauacguuuacauggggcagccccuaaauaacgacgaggaucacgcccauuggacugaggcaaaaaugcuguuggacaauauuaacaccccagaaggcaucauucccgccuuauucgagccugaacgcgagaagucggcugccauagauggagaauauagacugaggggcgaggcgcggaagacauuugucgagcucaugcgucgcggggaccugccaguguggcuuucuuacaaaguggcauccgaaggauuccaguauagcgaucgaagauggugcuuugacggugagaggaauaaccagguccuggaagagaauauggauguugaaaucuggaccaaggagggcgagcggaaaaagcuccgccccagaugguuggacgccaggacuuacucagacccucuggcucuacgggaguucaaagaguuugccgcugggcgaagaagugugucuggagaucugauucucgaaaucggcaaacuuccgcaacaccugacguuacgcgcacagaacgccuuggacaaucugguaaugcuccacaacuccgagcagggugggaaggcuuauaggcaugccauggaggaacugccagauaccaucgagacacuuaugcugcucgcauugauugcggugcugacuggcggagucaccuuauucuuucuaagcggcaaggggcugggaaagacaucaauaggucuccuuugugugaccgccaguagcgcucuguuguggauggccuccguugaaccccacuggaucgcagcuucuauuauccuggaguucuuucucauggugcugcuuauuccugaacccgaccggcagcguacuccacaagauaaucagcucgccuacgucguaaucggccuguuguucaugauacugacaguggcagccaacgagaugggguuacuagagacgaccaaaaaggaccugggaaucggcuauguugcugcggaaaaccaucagcacgccacuaugcucgauguggaccuucacccugcaagcgcuuggacacuguacgccgucgccaccaccgugauuacacccaugaugagacauacuaucgagaauacgaccgcaaacauuuccuugacagcuaucgccaaucaagcggcuauacugaugggucucgauaaaggguggccaauuucaaagauggacaucggcgucccucugcuugccuuaggaugcuacucucaggugaacccgcugacucucaccgcagccguuuugaugcugguggcucacuaugcaauuaucggccccgggcuacaggccaaagcgacaagggaagcucagaagcgcaccgccgcaggaauaaugaagaauccaacuguagauggcaucguggccauugaccuggauccugucguuuacgacgcuaaauuugagaagcaacucggucagaucaugcuucugauuuuguguacgagucagauccugcucaugcggacaaccugggcccugugcgaaucgauaacuuuagcaaccgggccccuuacaacucugugggagggaagcccaggcaaauucuggaacaccacaauugcuguguccauggccaauaucuuccgagguucuuaucucgcgggcgccgggcuagcauuuucacugaugaaauccuugggaggcgggagaaggggaacgggcgcucagggugagacccugggggaaaaauggaagcgccaacucaaccagcuuagcaagagugaguucaauacuuacaaacggucuggaaucauggaagucgacagaagcgaggccaaggaaggccugaaacguggugagacaaccaagcaugcagugucaaggggcacugcuaaauugcggugguuuguagagcgcaaccuggugaagccugaagggaagguuauugaucucggauguggccgagggggaugguccuauuacugcgccggccuaaagaaggugacagaggucaaagguuauaccaaagggggacccggccacgaggaaccgaucccaauggccacguacggcuggaaucuggugaaacuucauagugggaaggacgucuucuuuaugccucccgaaaaaugugauacccugcuaugcgacauaggagagagcucuccaaaccccacaauugaggaagguagaacucucagggugcugaagaugguugagccuugguugcggggcaaucaguucuguaucaagauucugaacccguacaugcccuccguaguggaaacccucgagcagaugcaacgcaaacacgggggaaugcuugucagaaauccacugucaaggaacagcacacacgagauguauugggugucgugcggcacugguaauaucguuucugcggugaacaugaccagucgaauguuacugaaccgguuuacaauggcucaucguaagccuaccuacgaaagagaugucgacuugggggcaggaacucgccacguggccguagagcccgaaguggcuaaucucgauguuauaggccagaggaucgagaacauuaaaaaugaacauaaguccacguggcacuaugacgaggauaacccuuacaaaacaugggccuaucacggcagcuacgaggucaagccaucaggguccgcaucuagcauggugaauggagugguccggcugcuaaccaagcccugggacguuaucccuauggugacucagauugccaugaccgauacaacgccauucggucaacagagaguauuuaaagaaaagguggacacccgcacucccagggcuaaacgaggcacaacccagaucauggaggucacugcgaaguggcuuuggggguuccugagucggaacaaaaagccgagaauuuguacaagggaagaguuuacccgcaaggugcguuccaaugccgcaaucggagcuguuuucguggacgaaaaccaguggaauagcgccaaagaggcagucgaggaugaacgguuuugggaccucgugcauagagagagggaacugcacaagcaaggcaaaugcgccacaugcguauauaacaugauggguaagcgcgagaaaaaguugggggaguucggaaaggcuaaaggcucucgagccauaugguacauguggcugggcgcgcgguuccucgaguuugaggcacuuggguucaugaaugaagaucauugguuuucaagagagaacagucuguccggaguugaaggugagggcuuacacaagcugggguacauuuugagggacaucagcaaaaucccuggaggcaauauguaugccgaugacacugcugguugggauacccgcauuacggaggacgaucuccagaacgaagccaagauaaccgacaucauggagccagaacaugcacugcuagcuacaucuauuuucaaacuuacuuaccagaauaagguggucagagugcagcggcccgccaaaaacgggaccgugauggaugucaucucgaggcgugaccaacgaggaucaggccagguuggcacauaugggcugaacacuuuuaccaauauggaggugcagcucauucgccagauggaaagcgagggaaucuuccugccuuccgaguuggaaacgccaaacuuagcugagagagcccuggauuggcucgaaaagcacggugcagagcggcuuaagaggauggcgauaaguggcgacgacuguguagugaaacccaucgaugaccgcuuugccacagcucugaccgcccuaaaugauauggggaaggucagaaaagacauuccgcaaugggaaccuucuaagggauggaacgauuggcaacaggugcccuucugcagccaccauuuucaccagcugaucaugaaagacggccgggagauuguugugccauguaggaaucaagaugagcucgucggucgagcacgugugucccagggggcuggauggucauugagagaaacugccugccugggcaagaguuacgcacagauguggcaacuuauguauuuccaucgccgggaccugaggcucgccgcgaacgcuaucuguucugccguaccuguugauugggugcccgcaagcagaacaaccugguccauacacgcccaccaucaguggaugacuaccgaggacauguuaucagucuggaaucgcguguggauugaagagaacccauggauggaagauaagacacacguuagcucuugggaggaggugcccuaccugggcaaacgggaagaccaguggugcggguccuugaucggacugacggcuagggccaccugggcaacuaauauccaggucgcuauuaaccaagugcgaagacucauagguaaugagaacuaucuugacuacaugacaaguaugaagcgguuuaaaaaugaaagcgauccugagggcgcccugugguga

SEQ ID NO: 14130 - RNA, 9879 nt, Artificial Sequence
  derived and/or modified CDS sequence (opt3) from DENV-1__KC692499__SS-prME
agcgugaccaugcugcucaugcuucugcccaccgccuuggcuuuccacuuaacuacgaggggcggggagccucauaugaucgucuccaagcaggaaaggggaaaaucucugcuauuuaagaccucagcugguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaauagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacguuaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgucuggcgccuccaccucacaagaaacuuggaaucggcaggacuugcucguuacauuuaaaaccgcacacgcuaagaagcaggagguggucgugcuggguagccaagaaggggccaugcacacagcuuuaacuggcgccaccgagauccagacgaguggaaccacaacuauuuucgcaggccaucugaaaugccgucuaaagauggauaaacucacccugaaggggaugucuuaugucauguguacaggauccuucaaacuugaaaaggagguggccgagacucagcacgguaccguuuuggugcagguaaaguacgaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguauauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaucagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaccuggggguuauggugcaggcggauagcggaugcgugaucaacuggaagggcagagagcuuaaaugugguucugggauuuuuguaacuaacgaaguccacaccuggacggagcaauauaaguuccaggcugacucaccgaagagguugagugccgcaaucggaaaagccugggaggaaggcgugugcgguauccggagcgcuacacgccuggagaauauuauguggaagcagauauccaacgaacucaaucauauccuguuagagaacgauaugaaauuuaccguuguggucggcgacgccaaugggauucuggcacagggaaagaaaaugaucagaccucaacccauggaauacaaguauucuuggaaaucguggggcaaggcuaagauuaucggggccgacauacagaacacuaccuucaucauugauggaccagacacaccugagugucccgauggccagagggcguggaauaucugggagguggaagacuacgguuuugggguuuucacuaccaacauuuggcuuaaauugcgugauagcuauacacagaugugcgaccaccggcucauguccgccgcuaucaaggauucaaaagcagugcacgccgacaugggauacuggauagagagugaaaagaaugagacguggaaacuggcucgagccucuuucauugaaguaaagaccuguacuuggccaaagagccauacacuaugguccaacggcguccuggagucagagaugaucauucccaaaaucuuugguggcccuauaagccaacacaauuauagaccaggguacuucacccagacugcaggaccguggcaucucggcaagcuggaacuugauuuugacuugugcgaggggacaaccgugguggucgaugaacacugcggaaacaggggccccucucugcgcacgacuaccguuacagguaaaaucauucacgagugguguugccgguccuguaccuuaccuccacucagauucagaggggaagacggaugcugguacggcauggaaauccgccccgugaaggagaaagaagagaaucugguacgaaguauggugagcgcggguucuggcgaagucgauuccuuuucacuugggauucugugugugaguaucaugauagaggagguuaugcggagccguuggucgagaaagauguugaugacuggaacacucgccguguuccugcuacugauuaugggccagcucaccuggaacgaccugaucaggcuuugcaucauggucggggcuaaugccuccgaccgcaugggaaugggcacaacuuauuuggcacugauggcuaccuuuaagaugcggccuauguucgccguggguuuacucuuuagaaggcugacgucucgagaaguucuucugcuaacaauugggcucagccugguggcaucagucgaguugccaaacagucuggaagaguuaggagauggccucgccaugggcaucaugaugcugaaacuucugaccgaguuccaaccccaucaguuguggacuacccuccugucccuaacauuuguaaagacuacccugucucuugacuacgcuuggaaaacgacagcgauggugcucagcauuguuucccuguucccguugugucugucaaccacuagccagaagacaaccugguuaccugugcuccuggggaguuuuggaugcaaaccacuuacuauguuccugauaacagagaacaagaucuggggucgcaagucuuggcccuugaaugagggcauuauggccaucgggauugucuccauccuccugagcucgcuacugaaaaacgaugugccucuugcaggaccccucauagcuggcgguaugcugaucgccuguuauguaauuucagggucuagugccgacuuguccuuagaaaaggcugcagaggugagcugggaacaggaggccgaacacucuggagcgagccauaauauccuggucgagguucaagaugacggcaccaugaaaauuaaggaugaggaacgggacgauacgcucacuauccugcuuaaagcuacccuguuggccguguccggcguguacccaaugucaauaccugcaacacuauucgucugguauuuuuggcagaagaaaaagcagagaaguggggugcugugggacacccccagcccaccggagguugaaagggccguacucgaugacggaauuuaccguauccugcagcgcggucuuuuaggccggucucaagugggggucggaguguuccaggauggcguuuuucacacaauguggcaugugacuagaggugcuguccugauguaucaggggaagaggcucgagccuuccugggcaucagugaaaaaggacuugaucaguuacggaggcggcuggcgauuccaggggagcuggaacaccggagaggaaguacaagucauugccguggagcccgguaaaaauccaaagaacguucagacgacacccggcacuuuuaaaaccccugaaggggaggugggagcgauagcucuggacuucaagccaggcacauccgguucucccaucgucaaucgggaagggaagauugugggacucuacggcaacggcguugugaccacuucggggaccuaugucagcgccaucgcacaggccaaggcuucacaagagggaccucugccggagauugaagaugagguguuuaagaaacgcaaucuuacaaucauggaccugcacccagguuccggcaagacgagaagguacuugcccgccauaguacgggaagcaaucaaacgaaagcuaagaacucugauucucgcuccuacccgcgugguugccagugagauggcggaagccuuaaaggggaugccaaucagguaucagacaaccgcagucaaaucugagcacacuggacgugagauuguggaucugaugugccaugcuacauucaccaugcggcuucugagccccgugagagucccuaacuacaauaugaucauaauggacgaagcccacuuuacggauccggcuuccauugcagccaggggcuauaucucaacucgcguagguaugggggaggccgcugcgaucuucaugacagcaacacccccaggaucuguggaagccuuuccucagagcaacgcuguuauucaggacgaggaacgagauauccccgagagaaguuggaacuccggcuacgacuggauagccgauuucccaggcaagaccgugugguucgucccuagcauuaaaucugggaacgacaucgcaaauugucuccggaagaacggaaaaagggugauucaauugucacgcaagacuuuugauacagaguaucagaagaccaaaaacaaugacugggacuacguugugacaacugauaucuccgaaaugggugccaacuuccgugcugacagagucauagauccccggaggugccugaagccagugauucucaaagacggcccggagcgcguaauccuggcggggccuaugcccgugacgguugccagugcagcucagcgaagaggacggaucggcaggaaucagaacaaggaaggugaucaauacgucuauauggggcagccacuuaauaacgacgaggaucaugcccacuggaccgaggcaaaaaugcuacuggacaauauuaacacacccgaaggcaucauuccugccuuguuugagccagaacgcgagaaaagcgcugccauagauggagaauacagauuaaggggcgaagcgcggaagacuuucguggagcugaugcgucgcggggaccuccccguguggcugucguauaaagucgcaucugaaggauuucaguacuccgaucgaagauggugcuucgacggugagaggaauaaccagguucuugaagagaauauggauguggaaaucuggaccaaggagggcgagcggaaaaagcugcgcccuagauggcucgacgccaggacauauagcgacccguuggcucugcgggaauuuaaagaguucgccgcugggcgaagaucaguaaguggagaucuaauucuggaaaucggcaagcucccacaacaucuuacccugcgcgcacagaacgccuuagacaauuuggugaugcugcacaacucugagcagggugggaaggcuuacaggcacgccauggaggaacuccccgauacuaucgagacgcugaugcuucuggcacucauugcggucuugaccggcggagugacacuguuuuucuuauccggcaaggggcuaggaaagacuagcauaggucugcucuguguuaccgccucaagugcacuucuguggauggccagcguggaaccucauuggaucgcagcuuccauuaucuuggaguuuuuccugaugguccuccugauucccgaaccagaccggcagcguacaccucaagauaaucagcuugccuauguagugaucggccuccuguuuaugauauugaccguugcagccaacgagauggggcuguuagagacuaccaaaaaggaccuaggaaucggcuacguggcugcggaaaaccaccagcaugccacgaugcuggaugucgaccuccaccccgcaucugcuuggacccuuuacgccguggccacuacagucauuaccccaaugaugagacacaccaucgagaauacaacugcaaacauuagccugacggcuaucgccaaucaagcggcuauauugaugggucuggauaaaggguggccuauuuccaagauggacaucggcgugccgcuccuggcccuuggaugcuauucacagguuaaccccuuaacccugacagcagccgugcucauguugguagcucauuacgcaauuaucggcccagggcugcaggccaaagcgacuagggaagcucagaagcgcaccgccgcaggaauaaugaagaauccuacaguggauggcaucgucgccauugaccuagaucccguuguguaugacgcuaaauucgagaagcaacugggucagaucaugcuccuuauucuguguaccucucagaucuugcugaugcggacuacgugggcccucugcgaaaguauaacacuggcaaccgggccauuaacuacccuuugggagggaucgccuggcaaauucuggaacacaacuauugcugucagcauggccaauaucuuucgagguuccuaccuggcgggcgccgggcucgcauucucucuaaugaagucacugggaggcgggagaaggggaaccggcgcucagggugagacauugggggaaaaauggaagcgccaacugaaccagcucagcaaguccgaguuuaauacguauaaacggaguggaaucauggaaguggacagaucugaggccaaggaaggccuuaaacguggugagaccacuaagcacgcaguaagcaggggcacagcuaaacugcggugguucguggagcgcaacuugguuaagcccgaagggaaggugauugaucugggauguggccgagggggauggucauacuauugcgccggccucaaaaaggucaccgaggugaaagguuacacuaaagggggaccgggccaugaggaaccaaucccuauggccacauacggcuggaauuuagucaaacugcacuccgggaaggacguguuuuucaugcccccagaaaaaugugauacccuucugugcgacauaggagagaguagccccaacccuacgauugaggaagguagaacccuaaggguucucaagaugguagagccguggcugcggggcaaucaguuuuguaucaagauuuugaaccccuauaugccaucuguggucgaaacacuggagcagaugcaacgcaaacaugggggaaugcucgugagaaauccucuuuccaggaacucaacucacgagauguacuggguuagcugcggcaccgguaauaucgugucggcggucaacaugacaucucgaaugcuguuaaaccgguucacuauggcucaccguaagcccaccuaugaaagagauguggaccugggggcaggaacacgccauguagccguggagccugaaguugcuaauuuggauauaaucggccagaggauugagaacaucaaaaaugaacacaagaguaccuggcauuacgacgaggauaacccauauaaaacuugggccuaccacggcuccuaugaggucaagcccagcgggucagcauccucuauggugaauggagugguccggcuccugacgaagccuugggacguuauuccaauggugacacagaucgccaugaccgauacuacccccuuuggucaacagagaguauucaaagaaaagguggacacacgcacgccgagggcuaaacgaggcaccacucagauuauggaggucacagcgaaguggcuauggggguuucuuagccggaacaaaaagccuagaaucuguaccagggaagaguucacucgcaaggugcguaguaaugccgcaauaggagcuguuuuuguggacgaaaaccaguggaacuccgccaaagaggcagucgaggaugaacgguucugggaccuggugcacagagagagggaacuccauaagcaaggcaaaugcgccacaugcguauacaacaugauggguaagcgcgagaaaaagcugggggaguucggaaaggcuaaaggcagccgagccauuugguacaugugguugggcgcgcgguuucuggaguucgaggcacucggguuuaugaaugaagaucacugguucucuagagagaacucacuuaguggaguugaaggugagggccugcauaaguuaggguauauccugagggacaucuccaaaauuccaggaggcaauauguacgccgaugacaccgcugguugggauacacgcauaacugaggacgauuugcagaacgaagccaagaucaccgacauuauggagcccgaacacgcacuccuggcuacgagcaucuuuaaacuaaccuaucagaauaagguggucagagugcagcggccugccaaaaacgggacagugauggaugucauuucuaggcgugaccaacgaggaucgggccagguuggcacuuacgggcuuaacaccuucacaaauauggaggugcagcugauccgccagauggaaucagagggaauauuucucccaagcgagcuggaaacucccaacuuggcugagagagccuuagauuggcuggaaaagcauggugcagagcggcucaagaggauggcgaucuccggcgacgacuguguagugaaaccgauugaugaccgcuucgccaccgcucuuacggcccugaaugauauggggaaggucagaaaagacaucccucaaugggaacccaguaagggauggaacgauuggcaacaggugccauuuugcucucaccacuuccaucagcuaauuaugaaagacggccgggagaucguugugccuuguaggaaucaagaugagcuggucggucgagcacgugugagccagggggcuggauggucccucagagaaacagccugcuugggcaagucauaugcacagauguggcaacugauguacuuucaccgccgggaccuuaggcuggccgcgaacgcuauauguagugccguacccguugauugggugccagcaucuagaaccacuuggagcauucaugcccaccaccaguggaugacaaccgaggacaugcucuccgucuggaaucgcguguggaucgaagagaaccccuggauggaagauaagacucauguuucaagcugggaggaggugccuuauuuaggcaaacgggaagaccaguggugcgggucucugaucggauugaccgcuagggccacaugggcaacgaauauucaggucgcuauaaaccaagugcgaagacugaucgguaaugagaacuaccucgacuacaugaccuccaugaagcgguucaaaaaugaaagugauccagagggcgcccuuugguga

SEQ ID NO: 14131 - RNA, 9879 nt, Artificial Sequence
  derived and/or modified CDS sequence (opt3) from DENV-1__KC692500__SS-prME
agcgugaccaugcugcucaugcuucugcccacagccuuggcuuuccacuuaacuacgaggggaggggaaccucauaugaucgucuccaaacaggaaaggggaaaaucucugcuauuuaagaccucagcugguguuaauaugugcacacucauugccauggaccugggagaacuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaagggcaaaagcuggcucgugcauaagcagugguuccuggaucuuccgcugcccuggacgucuggugcauccaccucacaagagacuuggaaucggcaggacuugcucguaacauuuaaaaccgcucacgccaagaagcaggaaguugugguccuggggagccaagagggcgcuaugcacacagccuuaacuggagcaaccgaaauccagacgaguggcaccacaacuauuuucgccgggcaucugaaaugccgucuaaagauggauaaacucacccugaagggaaugucuuaugugauguguacagguuccuucaaacuugagaaggaagucgcugagacucagcacggcaccguguugguucaggugaaguacgaggggacggacgcgccuugcaaaauaccauuuagcacacaagaugaaaagggaguaacccagaacggccgccugaucacugcaaaucccauugucacagacaaagagaagccugugaacaucgaaaccgagccacccuucggugagucguauauaguugugggggccggcgaaaaagcucucaagcugucuugguuuaagagaggauccucaauuggcaaaauguucgaggccacugcaagaggggcccggcgaauggcuauccuuggagauaccgccugggacuuugguaguaucggcggggucuucacaagcgugggaaagcugguacaucagguguuuggcacggcauacgguguuuuguucuccggggucucuuggaccaugaaaauuggcaucggcauucuccugacuugguuaggccugaauagccgcucaacaagucuauccaugaccuguauagcgguggggauggugacacucuaccugggagucaugguucaggcugauagcggcugcgugaucaacuggaaggguagagaacuuaaaugugggucuggaauuuuugugacuaacgagguacacaccuggacggaacaauauaaguuccaggccgacucaccgaagagguugagugcagccaucggcaaggcuugggaggagggugucugcggcauccggagcgccacacgccuggaaaauauuauguggaagcagauauccaacgagcucaaucauauccuguuagaaaacgauaugaaauuuaccgugguugugggggacgcaaauggcauucuggcucagggcaagaaaaugaucagaccucaacccauggagcacaaguacucuuggaaaucgugggggaaggccaagauuaucggagcggacauacagaacacuaccuucaucauugauggcccagacacaccugaaugucccgauggucagagggccuggaauaucugggaggucgaggacuauggguuuggaguguucacuaccaacauuuggcuuaaauugcgugauagcuacacacagaugugcgaccaccggcucauguccgcugcaaucaaggauucaaaagccguucaugcugacaugggcuauuggauagaaagugagaagaaugaaacguggaaacuggcccgagcaucuuucauugaggugaagaccuguacuuggccaaagagccacacacuaugguccaacgguguacuggaaucagagaugaucauucccaaaaucuuuggcgggccuauaagccaacauaauuacagaccaggauauuucacccagacugcgggcccguggcaccucgggaagcuggagcuugauuuugacuugugcgaaggaacaaccgucgugguggaugagcacugcggcaacaggggucccucucugcgcacgacuaccgucacagggaaaaucauucaugaaugguguugccgguccuguaccuuaccuccacucagauucaggggagaggacggcugcugguacgguauggagauccgccccguuaaggaaaaagaggaaaaucuggugcgaaguaugguaagcgccggcucuggggagguggauuccuuuucacuuggcauucugugugucaguaucaugauagaagaggugaugcggagccguuggucgagaaagauguugaugacuggcacacucgcuguuuuccugcuacugauuauggggcagcucaccuggaacgaccugaucaggcuuugcaucauggugggagccaaugcauccgaccgcaugggcauggguacaacuuacuuggcucugauggccaccuuuaagaugcggccuauguucgcagucggguuacucuuuagaaggcugacgucucgagaggugcuucugcuaacaauuggacucagccugguugccucaguggaauugccaaacagucuggaggaauuaggcgauggccucgcuauggggaucaugaugcugaaacuucugaccgaguuccaaccccaccaguuguggacuacccuccugucccuaacauuugucaagacuacccugucucuugacuaugcguggaaaacgacagccaugguacucagcauugugucccuguucccguugugucugucaaccacuagccagaagacaaccugguuaccuguucuccugggaaguuuugguugcaaaccacuuacuauguuccugauaacagaaaacaagaucuggggccgcaagucuuggcccuugaaugaggggauuauggcaaucggaauuguguccauccuccugagcucgcuacugaaaaacgaugucccucuugcuggcccccucauagccggugggaugcugaucgccuguuacgugauuucaggaucuagugcugacuuguccuuagagaaggcagccgaaguaagcugggagcaggaagcggagcauucuggcgcuagccacaauauccugguggaaguccaagaugacggcaccaugaaaauuaaggaugaggagcgggacgauacgcucacuauccugcuuaaagccacccuguuggcaguuuccgggguguauccaaugucaauaccugccacacuauucgugugguacuuuuggcagaagaaaaagcagagaaguggaguccugugggacacccccagcccaccggaaguggagagggcuguucucgaugacgguauuuaucguauccugcagcgcggccuuuuagggcggucucaaguaggagugggcgucuuccaggaugguguguuucauacaauguggcacguuacuagaggggcagugcugauguaccagggaaagaggcucgaaccuuccugggccucagucaaaaaggacuugaucaguuauggcggcggguggcgauucaaaggaagcuggaacaccggugaggaggugcagguaauugcggucgaacccggcaagaaucccaaaaaugugcaaacgacacccgggacuuuuaagaccccugagggagaaguuggcgcuauagcccuggacuucaagccagguacauccgggucucccaucgugaaucgggagggaaaaauugucggccucuacggcaacggggugguuaccacuucgggaaccuacgugagcgcaaucgcccaggcuaaggccucacaggaagguccucugccggagauugaggaugaagucuuuaaaaagcgcaaucuuacaaucauggaccugcacccaggcuccgggaaaacgagaagguauuugcccgcaauagugcgggaggcuaucaagcgaaagcuaagaacucugauucucgccccuacccgcguaguggcgagugaaauggccgaggcauuaaaaggaaugccaaucagguaccaaacaaccgcuguuaagucugaacauacuggccgugagauugucgaucugaugugccacgccacauucaccaugcggcuucugagccccgugagagugccuaacuauaauaugaucauaauggacgaggcucauuuuacggauccggcauccauugccgccagggguuacaucucaacucgcgucgggaugggagaagcugcggcaaucuucaugacagccacaccaccaggcucuguagaggcuuuuccucagagcaacgccgugauucaggacgaagaacgagauauccccgaaagaaguuggaacuccggcuaugacuggauaaccgauuucccagggaaaacuguuugguucgugccuagcauuaagucuggaaacgacaucgcaaauugucuccggaaaaacgguaagagggucauucaguugucacgcaagacauuugauaccgaguaccagaaaaccaagaacaaugacugggacuaugugguuacuacggauaucuccgagaugggcgccaacuuccgugcugacagagugauagauccccggaggugccugaaaccagucauucucaaggacgggccggaacgcgugauccuggcgggaccuaugcccguaaccguggccagugcagcucagcgaagaggccggaucgguaggaaucagaacaaagagggggaucaguacguuuacaugggccaaccacuuaauaacgacgaagaucacgcccauuggacagaggcaaagaugcuacuggacaauauuaacacucccgagggaaucauuccugccuuguuugaaccagagcgcgaaaagagcgcugccauagauggcgaguauagauuaagaggggaagcgcggaaaaccuucgucgagcugaugcgucgcggagaccuccccguguggcugucguacaagguggcaucugaggguuuucaguauuccgaucgaagauggugcuucgacggcgaaaggaauaaccagguccuugaggaaaauauggauguugagaucuggacaaaagaaggggagcggaagaaacugcgcccuagauggcucgacgccaggaccuacagcgacccguuggcucugcgggaguuuaaggaguucgccgcuggacgaagaucagugaguggcgaucuaauucuggagaucgguaaacucccacagcaccuuacucugcgcgcacaaaacgccuuagacaauuugguaaugcugcacaacucugaacaagggggaaaggcuuauaggcaugccauggaggaacuccccgauacgaucgagacccugaugcuucuggcacucauugcgguguugacaggaggcgucacucuguuuuucuuauccgggaagggacuagguaaaaccagcauaggccugcucugugugacagccucaagugcacuucuguggauggccagcguugagccucacuggaucgcagcuuccauuaucuuggaauuuuuccugauggugcuccugauucccgagccagaccggcagcguaccccucaggauaaucaacuugccuacgucguaaucgggcuccuguuuaugauauugacuguggcagccaacgaaaugggacuguuagagacaacgaagaaagaccuaggcaucgguuauguugcugcggagaaccaucagcacgccaccaugcuggauguggaccuccaccccgcaucugcuuggacucuuuacgccgucgccacaaccgugauuaccccaaugaugagacauacaaucgaaaauacuacggcaaacauuagccugaccgcuaucgccaaucaggcggcuauauugauggggcuggauaagggcuggccuauuuccaaaauggacaucggagucccgcuccuggcccuuggcugcuacucacaagugaaccccuuaacacugacugcagccguucucauguugguggcucacuaugcaauuaucgggccaggacugcaggccaaggcgaccagggaggcucagaagcgcacagccgcaggcauaaugaaaaauccuaccguagaugguaucguggccauugaccuagaucccgucguuuacgacgcuaaguucgaaaaacagcuggggcaaaucaugcuccuuauucuguguacuucucagaucuugcugaugcggacgacaugggcccucugcgagaguauaacccuggcaacuggaccauuaaccacacuuugggaaggcucgccugguaaguucuggaacacuaccauugcugugagcauggccaauaucuuucgaggcuccuaucuggcgggggccggacucgcauucucucuaaugaaaucacugggcgggggaagaaggggcacaggugcucagggggagacguugggagagaaguggaagcgccagcugaaccaacucagcaaauccgaauuuaauaccuacaagcggaguggcaucauggaggucgacagaucugaagccaaagagggucuuaagcguggcgaaacuacaaaacaugcagugagcagggggaccgcuaagcugcggugguucguagagcgcaacuuggugaagcccgagggaaaaguuauugaucugggcugugggcgaggaggcuggucauauuacugcgccggucucaagaaagugacugaagucaagggguauacaaaaggaggcccgggccacgaggaaccaaucccuauggccaccuacggguggaauuuagugaagcugcauuccggaaaagacgucuuuuucaugcccccagagaagugugauacgcuucugugcgacauaggugaaaguagccccaacccuaccauugaggagggcagaacacuaagggugcucaagaugguugaaccguggcugcgggggaaucaguuuuguaucaaaauuuugaaccccuacaugccaucuguaguggagacucuggaacagaugcagcgcaagcacggaggcaugcucgucagaaauccucuuuccaggaacucaacccacgagauguauugggugagcugcgguacagggaauaucguuucggcggugaacaugacuucucgaaugcuguuaaaccgguucaccauggcucaucguaaacccacauacgagagagaugucgaccugggagcaggcacccgccacguggccguagaaccugagguggcuaauuuggauauaaucggccaaaggauugaaaacaucaagaaugagcauaaaaguacuuggcacuaugacgaagauaacccauacaagacgugggccuaucacggguccuacgagguuaagcccagcggaucagcauccucuauggucaaugguguggugcggcuccugacaaaaccuugggacgucauuccaaugguuacccagaucgccaugacugauaccacacccuuuggccagcaaagaguguucaaggagaaaguagacacgcgcaccccgagggcuaagcgagggacuacacagauuauggaagugaccgcgaaauggcuauggggauuucuuagccggaacaagaagccuagaaucuguacuagggaggaguucacacgcaaaguccguaguaaugccgcaauaggcgcuguguuuguugacgagaaccaguggaacuccgccaaggaagcaguggaggaugagcgguucugggaccugguccauagagaaagggagcuccacaaacaggguaagugcgcaaccugcguguauaacaugauggggaaacgcgaaaagaagcugggagaguucggcaaagcuaagggcagccgagccauuugguacaugugguugggggcgcgguuucuggaguucgaggcacucggauuuaugaaugaggaucauugguucucuagagaaaacucacuuagugguguagagggcgaagggcugcacaaauuaggauacauccugagggacaucuccaagauuccaggcgguaauauguaugccgaugacacagcugggugggauacucgcauaaccgaggacgauuugcaaaacgaggccaaaaucacggacauuauggaacccgagcaugcacuccuggcuaccagcaucuuuaagcuaacauaccagaauaaaguugugagaguccagcggccugccaagaacggaacugugauggaugugauuucuaggcgugaccagcgaggcucgggccaagucgggaccuauggacuuaacacauucacuaauauggaaguucagcugauccgccagauggagucagaagguauauuucucccaagcgagcuggagacccccaacuuggcugaaagagccuuagauuggcuggagaagcacggcgcagaacggcucaaaaggauggcgaucuccggggacgacugugugguaaagccgauugaugaccgcuucgccacggcucuuacagcccugaaugauaugggaaaagugagaaaggacaucccucagugggagcccaguaaaggcuggaacgauuggcaacaggucccauuuugcucucaccauuuccaccagcuaauuaugaaggacggucgggaaaucgugguuccuuguaggaaucaggaugagcugguggggcgagcacgugucagccaaggagcuggcuggucccucagagagaccgccugcuugggcaagucauacgcacagauguggcagcugauguauuuucaucgccgggaccuuaggcuggccgcgaacgcuauauguagugccgugcccguagauuggguuccagcaucuagaacuacauggagcauucacgcccaccaucaauggaugaccacugaagacaugcucuccguguggaaucgcgucuggaucgaggaaaaccccuggauggaggauaaaacccacgugucaagcugggaagagguuccuuacuuagggaagcgggaggaccaguggugcggaucucugaucgguuugacagcuagggccacgugggcaaccaauauucagguggcuauaaaccagguccgaagacugaucggcaaugaaaacuaucucgacuacaugacuuccaugaaacgguucaagaaugagagugauccagaaggggcccuuugguga

SEQ ID NO: 14132 - RNA, 9879 nt, Artificial Sequence
  derived and/or modified CDS sequence (opt3) from DENV-1__KC692501__SS-prME
agcgugaccaugcugcucaugcuucugcccaccgccuuggcuuuccacuuaacuacgagaggcggggaaccucauaugaucgucuccaaacaggaaaggggaaaaucucugcuguuuaagaccucagcugguguuaauaugugcacacucauugccauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauuccgcggggaagacggaugcugguacggcauggaaaucaggcccguuaaggagaaagaagagaaucuggugcgaaguaugguaagcgccgguucuggcgaaguggauuccuuuucacuugggauucugugugucaguaucaugauagaggaggugaugcggagccguuggucgagaaagauguugaugacuggaacacucgcuguuuuccugcuacugauuaugggccagcucaccuggaacgaccugaucaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaauugggcucagccugguugccucaguggaguugccaaacagucuggaagaguuaggagauggccucgcuaugggcaucaugaugcugaaacuucugaccgaguuccaaccccaccaguuguggacuacccuccugucccuaacauuugucaagacuacccugucucuugacuaugcguggaaaacgacagccaugguacucagcauugugucccuguucccguugugucugucaaccacuagccagaagacaaccugguuaccuguucuccuggggaguuuuggaugcaaaccacuuacuauguuccugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuacgugauuucagggucuagugcugacuuguccuuagaaaaggcagccgagguaagcugggaacaggaggcggaacauucuggagcuagccacaauauccugguggagguccaagaugacggcaccaugaaaauuaaggaugaggaacgggacgauacgcucacuauccugcuuaaagccacccuguuggcaguuuccggcguguauccaaugucaauaccugccacacuauucgugugguacuuuuggcagaagaaaaagcagagaagugggguccugugggacacccccagcccaccggagguggaaagggcuguucucgaugacggaauuuaucguauccugcagcgcggucuuuuaggccggucucaaguaggggugggagucuuccaggauggcguguuucauacaauguggcacguuacuagaggugcagugcugauguaccaggggaagaggcucgagccuuccugggccucagucaaaaaggacuugaucaguuauggaggcggcuggcgauuccaggggagcuggaacaccggagaggaagugcaaguaauugcggucgagcccgguaaaaauccaaagaacgugcagacgacacccggcacuuuuaaaaccccugaaggggagguuggagcuauagcccuggacuucaagccaggcacauccgguucucccaucgugaaucgggaagagaagauugucgggcucuacggaaacggcgugguuaccacuucgggcaccuacgugagcgcaaucgcccaggcuaaagccucacaagaggggccucugccggaaauugaggaugaagucuuuaagaaacgcaaucuuacaaucauggaccugcacccaggauccgguaagacgagaagguauuugcccgcaauagugcgggaggcuaucaaacgaaagcuaagaacucugauucucgccccuacccgcguaguggcgagugaaauggccgaggcauuaaagggcaugccaaucagguaccagacaaccgcuguuaaaucugagcauacugggcgugaaauugucgaucugaugugccacgccacauucaccaugcggcuucugagccccgugagagugccuaacuauaauaugaucauaauggacgaggcucauuuuacggauccggcauccauugccgccaggggauacaucucaacucgcgucggcaugggugaagcugcggcaaucuucaugacagccacacccccagggucuguagaggcuuuuccucagagcaacgccgugauucaggacgaagaacgagauauccccgagagaaguuggaacuccggauaugacuggauaaccgauuucccaggcaagacuguuugguucgugccuagcauuaaaucuggcaacgacaucgcaaauugucuccggaagaacgggaaaagggucauucaauugucacgcaagacauuugauaccgaauaccagaagaccaaaaauaaugacugggacuaugugguuacuacggauaucuccgagaugggagccaacuuccgugcugacagagugauagauccccggaggugccugaagccagucauucucaaagacgguccggaacgcgugauccuggcgggcccuaugcccguaaccguggccagugcagcucagcgaagagggcggaucggaaggaaucagaacaaggagggcgaucaauacguuuacaugggucagccacuuaauaacgacgaggaucacgcccauuggacagaagcaaaaaugcuacuggacaauauuaacacucccgaggggaucauuccugccuuguuugaaccagagcgcgaaaagagcgcugccauagauggcgaguauagauuaaggggagaggcgcggaagaccuucgucgaacugaugcgucgcggcgaccuccccguguggcugucguacaaaguggcaucugagggguuucaguauuccgaucgaagauggugcuucgacggagaaaggaauaaccagguccuugaggaaaauauggauguugagaucuggacaaaggagggugaacggaaaaagcugcgcccuagauggcucgacgccaggaccuacagcgacccguuggcucugcgggaguuuaaagaguucgccgcuggccgaagaucagugaguggggaucuaauucuggagaucggaaagcucccacaacaccuuacucugcgcgcacagaacgccuuagacaauuugguaaugcugcacaacucugaacagggcgguaaggcuuauaggcaugccauggaggagcuccccgauacgaucgaaacccugaugcuucuggcacucauugcgguguugacagggggcgucacucuguuuuucuuauccggaaagggccuagggaagaccagcauaggacugcucugugugacagccucaagugcacuucuguggauggccagcguugagccucacuggaucgcagcuuccauuaucuuggaauuuuuccugauggugcuccugauucccgagccagaccggcagcguaccccucaagauaaucagcuugccuacgucguaaucggucuccuguuuaugauauugacuguggcagccaacgagaugggccuguuagaaacaacgaaaaaggaccuagggaucggauauguugcugcggagaaccaucagcacgccaccaugcuggauguggaccuccaccccgcaucugcuuggacucuuuacgccgucgccacaaccgugauuaccccaaugaugagacauacaaucgaaaauacuacggcaaacauuagccugaccgcuaucgccaaucaagcggcuauauugaugggccuggauaaagguuggccuauuuccaagauggacaucggggucccgcuccuggcccuuggcugcuacucacaggugaaccccuuaacacugacugcagccguucucauguugguggcucacuaugcaauuaucggaccaggccugcaggccaaagcgaccagggaggcucagaagcgcacagccgcagggauaaugaagaauccuaccguagauggaaucguggccauugaccuagaucccgucguuuacgacgcuaaauucgaaaagcaacugggccagaucaugcuccuuauucuguguacuucucagaucuugcugaugcggacgacaugggcccucugcgagaguauaacccuggcaacugguccauuaaccacacuuugggaggggucgccuggaaaauucuggaacacuaccauugcugugagcauggccaauaucuuucgaggcuccuaucuggcgggugccggccucgcauucucucuaaugaagucacuagggggaggcagaagggggacaggagcucagggcgaaacguugggugagaaauggaagcgccaacugaaccagcucagcaaguccgaauuuaauaccuacaaacggagugggaucauggaggucgacagaucugaagccaaggagggacuuaaacguggcgagacuacaaagcaugcagugagcagggguaccgcuaaacugcggugguucguagaacgcaacuuggugaagcccgagggcaagguuauugaucugggguguggacgaggcggguggucauauuacugcgccggacucaaaaaggugacugaagucaaaggcuauacaaagggugggccgggacacgaggaaccaaucccuauggccaccuacggcuggaauuuagugaaacugcauuccggcaaggacgucuuuuucaugcccccagagaaaugugauacgcuucugugcgacauaggggagaguagccccaacccuaccauugaagagggaagaacacuaagggugcucaagaugguugaaccguggcugcgggguaaucaguuuuguaucaagauuuugaaccccuacaugccaucuguaguggagacucuggagcagaugcaacgcaaacacggcgggaugcucgucagaaauccucuuuccaggaacucaacccacgaaauguauugggugagcugcggaacaggcaauaucguuucggcggugaacaugacuucucgaaugcuguuaaaccgguucaccauggcucaucguaagcccacauacgagagagaugucgaccugggugcagggacccgccacguggccguagaaccugagguggcuaauuuggauauaaucggacagaggauugaaaacaucaaaaaugagcauaagaguacuuggcacuaugacgaggauaacccauacaaaacgugggccuaucacggcuccuacgaaguuaagcccagcggcucagcauccucuauggucaaugggguggugcggcuccugacaaagccuugggacgucauuccaaugguuacccagaucgccaugacugauaccacacccuuuggacaacagagaguguucaaagagaagguagacacgcgcaccccgagggcuaaacgagguacuacacagauuauggaagugaccgcgaaguggcuauggggcuuucuuagccggaacaaaaagccuagaaucuguacuagggaggaguucacacgcaagguccguaguaaugccgcaauaggggcuguguuuguugacgagaaccaguggaacuccgccaaagaggcaguggaagaugagcgguucugggaccugguccauagagaaagggagcuccacaagcaaggaaaaugcgcaaccugcguguauaacaugaugggcaagcgcgagaagaaacugggugaguucgggaaagcuaaaggaagccgagccauuugguacaugugguugggcgcgcgguuucuggaguucgaagcacucggcuuuaugaaugaggaucauugguucucuagagaaaacucacuuagugggguagagggagagggucugcacaaguuaggcuacauccugagggacaucuccaaaauuccagggggaaauauguaugccgaugacacagcuggcugggauacucgcauaaccgaagacgauuugcagaacgaggccaagaucacggacauuauggaacccgagcaugcacuccuggcuaccagcaucuuuaaacuaacauaccagaauaagguugugagaguccagcggccugccaaaaacgguacugugauggaugugauuucuaggcgugaccaacgagggucgggacaggucggcaccuauggccuuaacacauucacuaauauggaaguucagcugauccgccagauggagucagaggggauauuucucccaagcgaacuggagacccccaacuuggcugaaagagccuuagauuggcuggagaagcacggagcagaacggcucaagaggauggcgaucuccggugacgacugugugguaaaaccgauugaugaccgcuucgccacggcucuuacagcccugaaugauaugggcaaggugagaaaagacaucccucaaugggagcccaguaagggguggaacgauuggcagcaggucccauuuugcucucaccauuuccaccagcuaauuaugaaagacggacgggagaucgugguuccuuguaggaaucaagaugaacuggugggccgagcacgugucagccagggugcuggguggucccucagagagaccgccugcuugggaaagucauacgcacagauguggcaacugauguauuuucaucgccgggaccuuaggcuggccgcgaacgcuauauguagugccgugcccguagauuggguuccagcaucuagaacuacauggagcauucacgcccaccaucaguggaugaccacugaagacaugcucuccguguggaaucgcgucuggaucgaggaaaaccccuggauggaggauaagacccacgugucaagcugggaggaaguuccuuacuuaggcaaacgggaggaccaguggugcggcucucugaucggguugacagcuagggccacgugggcaaccaauauucagguggcuauaaaccaaguccgaagacugaucggaaaugaaaacuaucucgacuacaugacuuccaugaagcgguucaaaaaugagagugauccagagggugcccuuugguga

SEQ ID NO: 14133 - RNA, 9879 nt, Artificial Sequence
  derived and/or modified CDS sequence (opt3) from DENV-1__KC692502__SS-prME
agcgugaccaugcugcucaugcuucugcccaccgccuuggcuuuccacuuaacuacgaggggcggggagccucauaugaucgucuccaaacaggaaaggggaaaaucucugcuauuuaagaccucagcugguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaagggggugucuuaugucauguguacaggauccuucaaacuugaaaaggagguggcugagacucagcacgguaccguuuuggugcagguaaaguacgaaggcacggacgcgccuugcaaaauaccauuuagcacacaagaugagaagggggucacccagaacggacgccugaucacugcaaaucccauugugacagacaaagaaaagccuguuaacaucgagaccgagccacccuucggcgaaucguauauaguggucggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcguguucacaagcguagggaagcuggugcaucagguuuuuggaacggcauacggcgucuuguucuccggugugucuuggaccaugaaaauugggaucggcauucuccugacuugguuaggacugaauagccgcucaacaagucuauccaugaccuguauagcggugggcauggucacacucuaccuggggguuauggugcaggcugauagcggaugcgugaucaacuggaagggcagagagcuuaaaugugguucugggauuuuuguaacuaacgaaguccacaccuggacggagcaauauaaguuccaggccgacucaccgaagagguugagugcagccaucggaaaggcuugggaggaaggcgugugcgguauccggagcgccacacgccuggagaauauuauguggaagcagauauccaacgaacucaaucauauccuguuagagaacgauaugaaauuuaccguuguggucggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggagguggaagacuaugguuuugggguuuucacuaccaacauuuggcuuaaauugcgugauagcuacacacagaugugcgaccaccggcucauguccgcugcaaucaaggauucaaaagccgugcaugcugacaugggauauuggauagagagugaaaagaaugagacguggaaacuggcccgagcaucuuucauugaaguaaagaccuguacuuggccaaagagccacacacuaugguccaacggcguccuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgugguggucgaugaacacugcggaaacaggggccccucucugcgcacgacuaccguuacagguaaaaucauucaugagugguguugccgguccuguaccuuaccuccacucagauucagaggggaagacggaugcugguacggcauggaaauccgccccgugaaggagaaagaagagaaucugguacgaaguauggugagcgccgguucuggcgaagucgauuccuuuucacuugggauucugugugugaguaucaugauagaggagguuaugcggagccguuggucgagaaagauguugaugacuggaacacucgcuguguuccugcuacugauuaugggccagcucaccuggaacgaccugaucaggcuuugcaucauggucggggccaaugcauccgaccgcaugggaaugggcacaacuuacuuggcucugauggccaccuuuaagaugcggccuauguucgcaguggguuuacucuuuagaaggcugacgucucgagaaguucuucugcuaacaauugggcucagccugguggccucagucgaguugccaaacagucuggaagaguuaggagauggccucgcuaugggcaucaugaugcugaaacuucugaccgaguuccaaccccaccaguuguggacuacccuccugucccuaacauuuguacgcacuacccugucucuugacuaugcguggaagacgacagccauggugcucagcauuguuucccuguucccguugugucugucaaccacuagccagaaaacaaccugguuaccugugcuccuggggaguuuuggaugcaagccacuuacuauguuccugauaacagagaacaaaaucuggggucggaagucuuggcccuugaaugagggcauuauggcaaucgggauugucuccauccuccugagcucgcuacugaagaacgaugugccucuugcuggaccccucauagccggcgguaugcugaucgccuguuacguaauuucagggucuagugcugacuuguccuuagaaaaagcagccgaggugagcugggaacaggaggcggaacauucuggagcuagccacaauauccuggucgagguucaagaugacggcaccaugaagauuaaagaugaggaaagagacgauacgcucacuauccugcuuaaggccacccuguuggcaguguccggcguguauccaaugucaauaccugccacacuauucgucugguacuuuuggcagaaaaagaaacagaggaguggggugcugugggacacccccagcccaccggagauggaacgugcuguucucgaugacggaauuuaucgcauccugcagcggggucuuuuaggcagaucucaaguaggggugggagucuuccaggauggcguguuucauacaauguggcacguuacuaggggugcagugcugauguaccaggggaagcgacucgagccuuccugggccucagucaagaaagacuugaucaguuauggaggcggcuggcgguuccaggggagcuggaacaccggagaggaagugcaaguaauugcggucgagcccgguaagaaucccaaaaaugugcagacgacacccggcacuuuuaagaccccugaaggggagguuggagcuauagcccuggacuucaaaccaggcacauccgguucucccaucgugaaucgcgaagggaagauugucggacucuacggcaacggcgugguuaccacuucggggaccuacgugagcgcaaucgcccaggcuaaggccucacaagagggaccucugccggagauugaagaugaggucuuuaaaaagagaaaucuuacaaucauggaccugcacccagguuccggcaaaacgaggcgguauuugcccgcaauagugcgagaagcuaucaagagaaaacuacgcacucugauucucgccccuaccaggguaguggcgagugagauggccgaagcauuaaaggggaugccaauccguuaccagacaaccgcuguuaagucugagcauacuggacgggagauugucgaucugaugugccacgccacauucaccaugagacuucugagccccgugagggugccuaacuauaauaugaucauaauggacgaagcucauuuuacggauccggcauccauugccgcccgcggcuacaucucaacucgagucgguaugggggaggcugcggcaaucuucaugacagccacaccaccaggaucuguagaggcuuuuccucagagcaacgccgugauucaggacgaggaaagagauauccccgagcggaguuggaacuccggcuaugacuggauaaccgauuucccaggcaaaacuguuugguucgugccuagcauuaagucugggaacgacaucgcaaauugucucaggaaaaacggaaagcgcgucauucaauugucacguaaaacauuugauaccgaguaccagaagacaaagaacaaugacugggacuaugugguuacuacggauaucuccgaaaugggugccaacuucagagcugaccgggugauagaucccaggcgcugccugaaaccagucauucucaaggacggcccggagcgagugauccuggcggggccuaugcccguaaccguggccagugcagcucagagacggggaaggaucggccgcaaucagaacaaagaaggugaucaauacguuuacauggggcagccacuuaauaacgacgaggaucacgcccauuggacagaggcaaagaugcuacuggacaauauuaacacucccgaaggcaucauuccugccuuguuugagccagaaagagagaaaagcgcugccauagauggagaauauagguuacggggcgaggcgcguaagaccuucgucgagcugaugcgccgaggggaccuccccguguggcugucguacaagguggcaucugaaggauuucaguauuccgauagaagguggugcuucgacggugagcggaauaaccagguccuugaagagaauauggauguugaaaucuggacaaaagagggcgagcgcaagaaacugagaccuagguggcucgacgcccggaccuacagcgacccguuggcucugcgagaauuuaaggaguucgccgcugggagacgcucagugaguggagaucuaauucuggaaaucggcaaacucccacaacaccuuacucugagggcacagaacgccuuagacaauuugguaaugcugcacaacucugagcagggugggaaggcuuaucggcaugccauggaagaacuccccgauacgaucgagacccugaugcuucuggcacucauugcgguguugacaggcggagucacucuguuuuucuuauccggcaaagggcuaggaaagaccagcauaggucugcucugugugacagccucaagugcacuucuguggauggccagcguugaaccucacuggaucgcagcuuccauuaucuuggaguuuuuccugauggugcuccugauucccgaaccagaccgucagagaaccccucaagauaaucagcuugccuacgucguaaucggccuccuguuuaugauauugacuguggcagccaacgagauggggcuguuagagacaacgaagaaagaccuaggaaucggcuauguugcugcggaaaaccaucagcacgccaccaugcuggauguggaccuccaccccgcaucugcuuggacucuuuacgccgucgccacaaccgugauuaccccaaugaugaggcauacaaucgagaauacuacggcaaacauuagccugaccgcuaucgccaaucaagcggcuauauugaugggucuggauaagggguggccuauuuccaaaauggacaucggcgucccgcuccuggcccuuggaugcuacucacaggugaaccccuuaacacugacugcagccguucucauguugguggcucacuaugcaauuaucggcccagggcugcaggccaaggcgacccgcgaagcucagaaacggacagccgcaggaauaaugaagaauccuaccguagauggcaucguggccauugaccuagaucccgucguuuacgacgcuaaguucgagaaacaacugggucagaucaugcuccuuauucuguguacuucucagaucuugcugaugcgaacgacaugggcccucugcgaaaguauaacccuggcaacugggccauuaaccacacuuugggagggaucgccuggcaaguucuggaacacuaccauugcugugagcauggccaauaucuuuagagguuccuaucuggcgggcgccgggcucgcauucucucuaaugaaaucacugggaggcgggaggcgcggaacaggcgcucagggugagacguugggggaaaaguggaaacggcaacugaaccagcucagcaaguccgaguuuaauaccuacaagagaaguggaaucauggaagucgaccguucugaggccaaagaaggccuuaagaggggugagacuacaaaacaugcagugagccggggcaccgcuaagcugcgcugguucguagagcgaaacuuggugaaacccgaagggaagguuauugaucugggauguggcagagggggauggucauauuacugcgccggccucaagaaagugacugaggucaaggguuauacaaaagggggaccgggccacgaagaaccaaucccuauggccaccuacggcuggaauuuagugaagcugcauuccgggaaagacgucuuuuucaugcccccagaaaagugugauacgcuucugugcgacauaggagagaguagccccaacccuaccauugaggaagguaggacacuacgggugcucaaaaugguugagccguggcugcgcggcaaucaguuuuguaucaagauuuugaaccccuacaugccaucuguaguggaaacucuggagcagaugcaaagaaagcacgggggaaugcucgucaggaauccucuuucccgaaacucaacccacgagauguauugggugagcugcggcacagguaauaucguuucggcggugaacaugacuucucggaugcuguuaaaccguuucaccauggcucauagaaaacccacauacgaacgcgaugucgaccugggggcaggaaccaggcacguggccguagagccugaaguggcuaauuuggauauaaucggccagcggauugagaacaucaagaaugaacauaaaaguacuuggcacuaugacgaggauaacccauacaagacgugggccuaucacggcuccuacgagguuaaacccagcgggucagcauccucuauggucaauggaguggugagacuccugacaaagccuugggacgucauuccaaugguuacccagaucgccaugacugauaccacacccuuuggucaacagcgcguguucaaggaaaaaguagacacgaggaccccgcgagcuaagcggggcacuacacagauuauggaggugaccgcgaaauggcuauggggguuucuuagcagaaacaagaaaccuaggaucuguacucgcgaagaguucacacguaagguccggaguaaugccgcaauaggagcuguguuuguugacgaaaaccaguggaacuccgccaaggaggcaguggaggaugaaagauucugggaccugguccauagggagcgcgaacuccacaaacaaggcaagugcgcaaccugcguguauaacaugauggguaaacgagagaagaaacugggggaguucggaaaggcuaagggcagccgggccauuugguacaugugguugggcgcgagauuucuggaguucgaggcacucggguuuaugaaugaagaucauugguucucuagggagaacucacuuaguggaguagaaggugagggccugcacaaauuaggguacauccugcgcgacaucuccaagauuccaggaggcaauauguaugccgaugacacagcugguugggauacuagaauaaccgaggacgauuugcagaacgaagccaaaaucacggacauuauggagcccgaacaugcacuccuggcuaugagcaucuuuaagcuaaccuaccagaauaaaguugugcggguccagaggccugccaagaacgggacagugauggaugugauuucucgucgagaccaacgcggaucgggccaggucggcacuuaugggcuuaacaccuucacaaauauggagguucagcugaucagacagauggaaucagagggaauauuucucccaagcgagcuggaaacucccaacuuggcugagcgggccuuagauuggcuggaaaaacacggugcagagaggcucaagcgcauggcgaucuccggcgacgacugugugguaaagccgauugaugacagauucgccaccgcucuuacggcccugaaugauauggggaaagugcggaaggacaucccucaaugggaacccaguaaaggauggaacgauuggcagcaggucccauuuugcucucaccauuuccaccagcuaauuaugaaggacggcagggagaucgugguuccuugucgaaaucaagaugagcuggugggucgugcaagagucagccagggggcuggauggucccuccgcgaaacagccugcuugggcaaaucauacgcacagauguggcaacugauguauuuucaucggagggaccuuagacuggccgcgaacgcuauauguagugccgugcccguagauuggguuccagcaucucgcaccacuuggagcauucacgcccaccaucaguggaugacaaccgaggacaugcucuccguguggaaucgggucuggaucgaagagaaccccuggauggaagauaagacucacgugucaagcugggaggagguuccuuacuuaggcaagagggaagaccaguggugcgggucucugaucggauugaccgcucgagccacaugggcaacgaauauucagguggcuauaucccaagucagacggcugaucgguaacgagaauuaucucgacuacaugaccaguaugaaaagguucaagaacgaaagcgauccagagggcgcccuuugguga

SEQ ID NO: 14134 - RNA, 9879 nt, Artificial Sequence
  derived and/or modified CDS sequence (opt3) from DENV-1__KC692503__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggaucgccucacccugaaagggaugucuuaugugauguguacaggauccuucaagcuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggaaaaaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaucugcgaccaccgacucauguccgcugcaauaaaagauucaaaggccguucaugcugacaugggauauuggauugagagugaaaaaaaugagacguggaagcuggccagagcaucuuucaucgaagugaaaaccuguacuuggccaaagagccacacacuaugguccaacggcguacuggagucagagaugauuauccccaagauauuugguggcccuaucagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagauuauccaugagugguguugcagauccuguaccuuaccuccacucagguuccgcggggaggacggaugcugguacggcauggaaauucgacccguuaaagagaaggaagagaaucuggugcggaguaugguaagcgccgguucuggcgaaguggauuccuuuucacuugggauccugugugucaguauaaugauugaggaggugaugcguagcagauggucgaggaaaauguugaugaucggaacucucgcuguuuuccugcuacugaucaugggccagcucacauggaacgaccugauucgccuuugcaucauggugggggccaaugcauccgaccggaugggaaugggcaccacauacuuggcucugauggccacuuuuaagaugagaccuauguucgcagucgguuuacucuuuaggcgacugaccucucgcgaagugcuucugcuaacgauugggcucagccugguugccucaguggaguugccaaacagucuggaagaguuaggagauggccucgcuaugggcauaaugaugcugaagcuucugacagaauuccaaccccaccaguuguggaccacucuccugucccuaaccuuugucaaaacaacucugucucuugacuaugcguggaagaccacggccaugguacucagcaucgugucccuguucccguugugucugucaacaaccagccagaaaacuacaugguuaccuguucuccuggggaguuuuggaugcaagccacuuaccauguuccugauuacugagaacaaaaucuggggucggaagucuuggcccuugaaugagggcauuauggcaaucgggauaguguccauccuccugagcucgcuacugaagaacgaugucccucuugcuggaccccucauugccggcgguaugcugaucgccuguuacgugauuucagggucuagugcugacuuguccuuagaaaaagcagccgagguaagcugggaacaggaggcggaacauucuggagcuagccacaauauccugguggagguccaagaugacggcacaaugaagauaaaagaugaggaaagagacgauacccucacgauucugcuuaaggccacucuguuggcaguuuccggcguguauccaaugucaaucccugccacccuauucgugugguacuuuuggcagaaaaagaaacagaggagugggguccugugggacacacccagcccaccggagguggaacgugcuguucucgaugacggaaucuaucgcauucugcagcggggucuuuuaggcagaucucaaguaggggugggagucuuccaggauggcguguuucauaccauguggcacguuacaaggggugcagugcugauguaccaggggaagcgacucgagccuuccugggccucagucaagaaagacuugauaaguuauggaggcggcuggcgguuccaggggagcuggaacacuggagaggaagugcaaguaaucgcggucgagcccgguaagaauccaaaaaacgugcagaccacgcccggcacauuuaagacuccugaaggggagguuggagcuauugcccuggacuucaaaccaggcaccuccgguucucccaucgugaaucgcgaagagaagauugucgggcucuacggaaacggcgugguuacaaccucgggcacuuacgugagcgcaaucgcccaggcuaaggccucacaagaggggccucugccggaaauagaggaugaagucuuuaaaaagagaaaucuuaccaucauggaccugcacccaggauccgguaaaacaaggcgguauuugcccgcaauugugcgagaggcuaucaagagaaaacuacgcacgcugauucucgccccuacuaggguaguggcgagugaaauggccgaggcauuaaagggcaugccaauccguuaccagaccacagcuguuaagucugagcauaccgggcgggaaauagucgaucugaugugccacgccacuuucacaaugagacuucugagccccgugagggugccuaacuauaauaugauuaucauggacgaggcucauuuuaccgauccggcauccaucgccgcccgcggauacauuucaacgcgagucggcaugggugaagcugcggcaaucuucaugacugccacacccccagggucuguagaggcuuuuccucagagcaacgccgugauacaggacgaagagagagauauucccgagcggaguuggaauuccggauaugacuggaucaccgauuucccaggcaaaaccguuugguucgugccuagcauuaagucuggcaacgacaucgcaaauugucucaggaaaaacgggaagcgcgucauacaauugucacguaaaacuuuugauacagaauaccagaagaccaagaacaaugacugggacuaugugguuacaacugauauuuccgagaugggagccaacuucagagcugaccgggugaucgaucccaggcgcugccugaaaccagucauccucaaggacgguccggaacgagugauucuggcgggcccuaugcccguaacgguggccagugcagcucagagacgggggaggaucggacgcaaucagaacaaagagggcgaucaauacguuuacaugggucagccacuuaauaacgacgaggaucacgcccauuggaccgaagcaaagaugcuacuggacaauauuaacacacccgaggggauaaucccugccuuguuugaaccagagagagaaaaaagcgcugccauugauggcgaguauagguuacggggagaggcgcguaagacuuucgucgaacugaugcgccgaggcgaccuccccguguggcugucguacaagguggcaucugagggguuucaguauuccgauagaagguggugcuucgacggagaacggaauaaccagguccuugaggaaaauauggauguugagaucuggaccaaagagggugaacgcaagaaacugagaccuagguggcucgacgcccggacauacagcgacccguuggcucugcgagaguuuaaggaauucgccgcuggcagacgcucagugaguggggaucuaauccuggagauuggaaaacucccacaacaccuuacccugagggcacagaacgccuuagacaauuugguaaugcugcacaacucugaacagggcgguaaggcuuaucggcaugccauggaggagcuccccgauacuauagaaacgcugaugcuucuggcacucaucgcgguguugaccgggggcgucacacuguuuuucuuauccggaaaaggccuagggaagacuagcauuggacugcucugugugaccgccucaagugcucuucuguggauggccagcguugagccucacuggaucgcagcuuccauuaucuuggaauuuuuccugauggugcuccugauacccgagccagaccgucagagaacaccucaagauaaucagcuugccuacgucguaaucggucuccuguuuaugauuuugaccguggcagccaacgagaugggccuguuagaaacuacaaagaaagaccuagggaucggauauguugcugcggagaaccaucagcacgccacgaugcuggauguggaccuccaccccgcaucugcuuggacccuuuacgccgucgccacuacagugauuaccccaaugaugaggcauaccaucgaaaauacaacugcaaacauaagccugacggcuauugccaaucaagcggcuaucuugaugggccuggauaaggguuggccuauuuccaaaauggacaucggggucccgcuccuggcccuuggcugcuacucacaggugaaccccuuaacccugacagcagccguucucauguugguggcucacuaugcaauaaucggaccaggccugcaggccaaggcgacucgcgaggcucagaaacggaccgccgcagggauuaugaagaauccuacaguagauggaaucguggccauugaccuagaucccgucguuuacgacgcuaaguucgaaaaacaacugggccagaucaugcuccuuauacuguguaccucucagauuuugcugaugcgaacuacgugggcccucugcgagaguaucacacuggcaaccgguccauuaacuacccuuugggaggggucgccuggaaaguucuggaacacaacuaucgcugugagcauggccaauauuuuuagaggcuccuaucuggcgggugccggccucgcauucucucuaaugaaaucacuggggggaggcaggcgcgggaccggagcucagggcgaaacauugggugagaaguggaaacggcaacugaaccagcucagcaaguccgaauuuaauacguacaagagaagugggaucauggaggucgaccguucugaagccaaagagggacuuaagaggggcgagaccacuaaacaugcagugagccgggguacagcuaagcugcgcugguucguagaacgaaacuuggugaaacccgagggcaagguuauagaucugggguguggaagaggcggguggucauauuacugcgccggacucaagaaagugaccgaagucaagggcuauacuaaaggugggccgggacacgaggaaccaauuccuauggccacauacggcuggaauuuagugaagcugcauuccggcaaagacgucuuuuucaugcccccagagaagugugauacccuucugugcgacaucggggagaguagccccaacccuacgauugaagagggaaggacccuacgggugcucaaaaugguugaaccguggcugcgcgguaaucaguuuuguaucaagauauugaaccccuacaugccaucuguaguggagacacuggagcagaugcaaagaaagcacggcgggaugcucgucaggaauccucuuucccgaaacucaacucacgaaauguauugggugagcugcggaaccggcaauaucguuucggcggugaacaugacaucucggaugcuguuaaaccguuucacuauggcucauagaaaacccaccuacgagcgcgaugucgaccugggugcagggacaaggcacguggccguagaaccugagguggcuaauuuggauauuaucggacagcggauugaaaacaucaagaaugagcauaaaaguaccuggcacuaugacgaggauaacccauacaagacuugggccuaucacggcuccuacgaaguuaaacccagcggcucagcauccucuauggucaaugggguggugagacuccugacgaagccuugggacgucauuccaaugguuacacagaucgccaugaccgauacuacccccuuuggacaacagcgcguguucaaggagaaaguagacacaaggacgccgcgagcuaagcgggguaccacucagauaauggaagugacagcgaaauggcuauggggcuuucuuagcagaaacaagaaaccuaggauuuguacccgcgaggaauucacucguaagguccggaguaaugccgcaaucggggcuguguuuguugacgagaaccaguggaauuccgccaaggaggcaguggaagaugagagauucugggaccugguccauagggaacgcgagcuccacaaacaaggaaagugcgccacaugcguguauaacaugaugggcaaacgagaaaagaaacugggugaguucgggaaggcuaagggaagccgggccaucugguacaugugguugggcgcgagauuucuggaguucgaagcacucggcuuuaugaaugaggaucauugguucucuagggaaaacucacuuagugggguagagggagagggucugcacaaauuaggcuacauucugcgcgacauauccaagaucccagggggaaauauguaugccgaugacaccgcuggcugggauacaagaauuacugaagacgauuugcagaacgaggccaaaaucaccgacauuauggaacccgagcaugcacuccuggcuacgagcaucuuuaagcuaaccuaccagaauaaaguugugcggguccagaggccugccaagaacgguacagugauggaugugauaucucgucgagaccaacgcgggucgggacaggucggcacuuauggccuuaacaccuucacaaauauggaaguucagcugaucagacagauggagucagaggggauuuuucucccaagcgaacuggagacucccaacuuggcugaacgggccuuagauuggcuggagaaacacggagcagaaaggcucaagcgcauggcgaucuccggugacgacugugugguaaagccgauugaugacagauucgccaccgcucuuacggcccugaaugauaugggcaaagugcggaaggacaucccucaaugggagcccaguaaaggguggaacgauuggcagcaggucccauuuugcucucaccauuuccaccagcuaauaaugaaggacggaagggagauugugguuccuugucgaaaucaagaugaacuggugggccgugcaagagucagccagggugcuggguggucccuccgcgagacagccugcuugggaaaaucauacgcacagauguggcaacugauguauuuucaucggagggaccuuagacuggccgcgaacgcuaucuguagugccgugcccguagauuggguuccagcaucucgcaccacuuggagcauccacgcccaccaucaguggaugacaaccgaagacaugcucuccguguggaaucgggucuggauugaggaaaaccccuggauggaggauaagacucacgugucaagcugggaggaaguuccuuacuuaggcaagagggaggaccaguggugcggcucucugauaggguugaccgcucgagccacaugggcaacgaauauccagguggcuauuaaccaagucagacggcugaucggaaaugaaaacuaucucgacuacaugaccuccaugaaaagguucaagaaugagagugauccagagggugcccuuugguga

SEQ ID NO: 14135 - RNA, 9879 nt, Artificial Sequence
  derived and/or modified CDS sequence (opt3) from DENV-1__KC692504__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaugaacccugccgugcugcggaagcuuugcauugaggcuaaaaucuccaauaccacgaccgauucucgcuguccaacacaaggagaagccacucuggucgaggagcaggacgcaaacuuuguuugccgaagaaccuucguggauaggggcugggguaauggguguggauuguuuggcaagggcagccuccugacaugcgcuaaauucaagugcguaacuaaguuagaagggaaaauagugcaguacgagaaccugaaguauuccgucauugugaccguucacacaggagaccagcaucaaguggguaaugaaaccacugagcacggcacgaucgccacaauuaccccccaggcgccuacuucagaaauccagcucaccgauuacggggcccuuacacuggacuguaguccacggaccggauuggacuuuaacgagaugguccuacugacuaugaaagagaagagcuggcucgugcauaaacagugguuccuggaucuuccgcugcccuggacaucuggcgcauccacgucacaagaaaccuggaaucgucaggacuugcucguaacuuuuaagacagcucacgccaaaaagcaggagguugugguccuggguagccaagaaggggcuaugcacaccgccuuaacaggcgcaacugagauccagaccaguggaacgaccacaauuuucgccggccaucugaagugccgccuaaaaauggauaagcucacucugaaagggaugucuuaugugauguguaccggauccuucaagcuugaaaaagaggucgcugagacacagcacgguacuguguugguucaggugaaguacgaaggcaccgacgcgccuugcaagauaccauuuagcacgcaagaugagaaagggguaacacagaacggaagacugaucaccgcaaaucccauugucacugacaaggaaaaaccugugaacaucgagacagagccacccuucggcgaaucguauauaguugugggugccggggagaaggcucucaaacugucuugguuuaagaggggcuccucaauuggaaagauguucgaagccaccgcacggggcgcccgacgcauggcuauccuuggggauacugccugggacuuuggaaguaucgguggcgucuucaccagcguggggaaacugguacaucagguguuuggaacagcauacggcguuuuguucuccggugucucuuggacgaugaagauugggaucggcauucuccugaccugguuaggacugaauagcagaucaacuagucuauccaugacauguauagcggugggcauggugacccucuaccugggggucaugguucaggcugauagcggaugcgugaucaacuggaaaggcagggagcuuaagugugguucugggauuuuugugacaaacgaaguacacacuuggaccgagcaauauaaauuccaggccgacucaccgaagcgguugagugcagccaucggaaaggcuugggaggaaggcgucugcgguauccgcagcgccacgagacuggagaauauuauguggaaacagauauccaacgaacucaaucauauccuguuagagaacgauaugaaguuuacagugguugugggcgacgcaaaugggauucuggcucagggaaaaaagaugaucaggccucaacccauggaacacaaauacucuuggaagucguggggcaaagccaagauuaucggggcggacauacagaacaccacuuucaucauugauggaccagacaccccugagugucccgauggccagcgugccuggaauaucugggaggucgaagacuaugguuuugggguguucacaacuaacauuuggcuuaaguugcgggauagcuacacccagaugugcgaccaccgacucauguccgcugcaaucaaagauucaaaggccguucaugcugacaugggauauuggauagagagugaaaaaaaugagacauggaagcuggccagagcaucuuucauugaagugaaaacguguaccuggccaaagagccacacucuaugguccaacggcguacuggagucagagaugaucauucccaagaucuuugguggcccuauaagccaacauaauuacaggccaggguauuucacacagaccgcgggaccguggcaccucggcaaacuggaacuugauuuugacuugugcgaggggacuacagucgugguggaugaacacugcggaaaccgcggccccucucugcggaccacgacugucaccgguaagaucauucaugagugguguugcagauccuguacauuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugaccggaacucucgcuguuuuccugcuacugauuaugggccagcucacauggaacgaccugauccgccuuugcaucauggugggggccaaugcauccgaccggaugggaaugggcaccacauacuuggcucugauggccacuuuuaagaugagaccuauguucgcagucgguuuacucuuuaggcgacugaccucucgcgaagugcuucugcuaacgauugggcucagccugguugccucaguggaguugccaaacagucuggaagaguuaggagauggccucgcuaugggcaucaugaugcugaagcuucugacagaauuccaaccccaccaguuguggaccacucuccugucccuaaccuuugucaaaacaacucugucucuugacuaugcguggaagaccacggccaugguacucagcauugugucccuguucccguugugucugucaacaaccagccagaaaacuacaugguuaccuguucuccuggggaguuuuggaugcaagccacuuaccauguuccugauaacugagaacaaaaucuggggucggaagucuuggcccuugaaugagggcauuauggcaaucgggauuguguccauccuccugagcucgcuacugaagaacgaugucccucuugcuggaccccucauagccggcgguaugcugaucgccuguuacgugauuucagggucuagugcugacuuguccuuagaaaaagcagccgagguaagcugggaacaggaggcggaacauucuggagcuagccacaauauccugguggagguccaagaugacggcacaaugaagauuaaagaugaggaaagagacgauacccucacgauccugcuuaaggccacucuguuggcaguuuccggcguguauccaaugucaauaccugccacccuauucgugugguacuuuuggcagaaaaagaaacagaggagugggguccugugggacacacccagcccaccggagguggaacgugcuguucucgaugacggaauuuaucgcauccugcagcggggucuuuuaggcagaucucaaguaggggugggagucuuccaggauggcguguuucauaccauguggcacguuacaaggggugcagugcugauguaccaggggaagcgacucgagccuuccugggccucagucaagaaagacuugaucaguuauggaggcggcuggcgguuccaggggagcuggaacacuggagaggaagugcaaguaauugcggucgagcccgguaagaauccaaaaaacgugcagaccacgcccggcacauuuaagacuccugaaggggagguuggagcuauagcccuggacuucaaaccaggcaccuccgguucucccaucgugaaucgcgaagggaagauugucggacucuacggcaacggcgugguuacaaccucggggacuuacgugagcgcaaucgcccaggcuaaggccucacaagagggaccucugccggagauugaagaugaggucuuuaaaaagagaaaucuuaccaucauggaccugcacccagguuccggcaaaacaaggcgguauuugcccgcaauagugcgagaagcuaucaagagaaaacuacgcacgcugauucucgccccuacuaggguaguggcgagugagauggccgaagcauuaaaggggaugccaauccguuaccagaccacagcuguuaagucugagcauaccggacgggagauugucgaucugaugugccacgccacuuucacaaugagacuucugagccccgugagggugccuaacuauaauaugaucauaauggacgaagcucauuuuaccgauccggcauccauugccgcccgcggcuacaucucaacgcgagucgguaugggggaggcugcggcaaucuucaugacugccacacccccaggaucuguagaagcuuuuccucagagcaacgccgugauucaggacgaggaaagagauauccccgagcggaguuggaauuccggcuaugacuggauaaccgauuucccaggcaaaaccguuugguucgugccuagcauuaagucugggaacgacaucgcaaauugucucaggaaaaacggaaagcgcgucauucaauugucacguaaaacuuuugauacagaguaccagaagaccaagaacaaugacugggacuaugugguuacaacugauaucuccgaaaugggugccaacuucagagcugaccgggugauagaucccaggcgcugccugaaaccagucauucucaaggacggcccggagcgagugauccuggcggggccuaugcccguaacgguggccagugcagcucagagacggggaaggaucggccgcaaucagaacaaagaaggugaucaauacguuuacauggggcagccacuuaauaacgacgaggaucacgcccauuggaccgaggcaaagaugcuacuggacaauauuaacacacccgaaggcaucauuccugccuuguuugagccagaaagagagaaaagcgcugccauagauggagaauauagguuacggggcgaggcgcguaagacuuucgucgagcugaugcgccgaggggaccuccccguguggcugucguacaagguggcaucugaaggauuucaguauuccgauagaagguggugcuucgacggugagcggaauaaccagguccuugaagagaauauggauguugaaaucuggaccaaagagggcgagcgcaagaaacugagaccuagguggcucgacgcccggacauacagcgacccguuggcucugcgagaauuuaaggaguucgccgcugggagacgcucagugaguggagaucuaauucuggaaaucggcaaacucccacaacaccuuacccugagggcacagaacgccuuagacaauuugguaaugcugcacaacucugagcagggugggaaggcuuaucggcaugccauggaagagcuccccgauacuaucgagacgcugaugcuucuggcacucauugcgguguugaccggcggagucacacuguuuuucuuauccggcaaagggcuaggaaagacuagcauaggucugcucugugugaccgccucaagugcucuucuguggauggccagcguugaaccucacuggaucgcagcuuccauuaucuuggaguuuuuccugauggugcuccugauucccgaaccagaccgucagagaacaccucaagauaaucagcuugccuacgucguaaucggccuccuguuuaugauauugaccguggcagccaacgagauggggcuguuagagacuacaaagaaagaccuaggaaucggcuauguugcugcggaaaaccaucagcacgccacgaugcuggauguggaccuccaccccgcaucugcuuggacccuuuacgccgucgccacuacagugauuaccccaaugaugaggcauaccaucgagaauacaacugcaaacauuagccugacggcuaucgccaaucaagcggcuauauugaugggucuggauaagggguggccuauuuccaaaauggacaucggcgucccgcuccuggcccuuggaugcuacucacaggugaaccccuuaacccugacagcagccguucucauguugguggcucacuaugcaauuaucggcccagggcugcaggccaaggcgacucgcgaagcucagaaacggaccgccgcaggaauaaugaagaauccuacaguagauggcaucguggccauugaccuagaucccgucguuuacgacgcuaaguucgagaaacaacugggucagaucaugcuccuuauucuguguaccucucagaucuugcugaugcgaacuacgugggcccucugcgaaaguauaacacuggcaaccgggccauuaacuacccuuugggagggaucgccuggcaaguucuggaacacaacuauugcugugagcauggccaaugucuuuagagguuccuaucuggcgggcgccgggcucgcauucucucuaaugaaaucacugggaggcgggaggcgcggaaccggcgcucagggugagacauugggggaaaaguggaaacggcaacugaaccagcucagcaaguccgaguuuaauacguacaagagaaguggaaucauggaaguggaccguucugaggccaaagaaggccuuaagaggggugagaccacuaaacaugcaguaagccggggcacagcuaagcugcgcugguucguggagcgaaacuugguuaaacccgaagggaaggugaucgaucugggauguggcagagggggauggucauauuacugcgccggccucaagaaagucaccgaggugaaggguuauacuaaagggggaccgggccacgaagagccaauuccuauggccacauacggcuggaauuuagucaagcugcauuccgggaaagacguguuuuucaugcccccagaaaagugugauacccuucugugcgacaucggagagaguagccccaacccuacgauagaggaagguaggacccuacggguucucaaaaugguagagccguggcugcgcggcaaucaguuuuguauuaagaucuugaaccccuacaugccaucuguggucgaaacacuggagcagaugcaaagaaagcacgggggaaugcucgugaggaauccucuuucccgaaacucaacucacgagauguauuggguuagcugcggcaccgguaauauugugucggcggucaacaugacaucucggaugcuguuaaaccguuucacuauggcucauagaaaacccaccuacgaacgcgauguggaccugggggcaggaacaaggcacguagccguggagccugaaguugcuaauuuggauaucauaggccagcggaucgagaacauuaagaaugaacauaaaaguaccuggcacuaugacgaggauaacccauacaagacuugggccuaucacggcuccuacgaggucaaacccagcgggucagcauccucuauggugaauggaguggucagacuccugacgaagccuugggacguuaucccaauggugacacagauugccaugaccgauacuacccccuuuggucaacagcgcguauucaaggaaaaaguggacacaaggacgccgcgagcuaagcggggcaccacucagaucauggaggucacagcgaaauggcuauggggguuucuuagcagaaacaagaaaccuaggauuuguacccgcgaagaguucacucguaaggugcggaguaaugccgcaaucggagcuguuuuuguggacgaaaaccaguggaauuccgccaaggaggcagucgaggaugaaagauucugggaccuggugcauagggagcgcgaacuccacaaacaaggcaagugcgccacaugcguauauaacaugauggguaaacgagagaagaaacugggggaauucggaaaggcuaagggcagccgggccauaugguacaugugguugggcgcgagauuucuggaguucgaggcacucggguuuaugaaugaagaucauugguucucuagggagaacucacuuaguggaguugaaggugagggccugcacaaauuaggguacauucugcgcgacaucuccaagaucccaggaggcaauauguaugccgaugacaccgcugguugggauacaagaauuacugaggacgauuugcagaacgaagccaaaauaaccgacaucauggagcccgaacaugcacuccuggcuacgagcauuuuuaagcuaaccuaccagaauaaagugguccgggugcagaggccugccaagaacgggacagugauggaugucaucucucgucgagaccaacgcggaucgggccagguuggcacuuaugggcuuaacaccuucacaaauauggaggugcagcugauuagacagauggaaucagagggaaucuuucucccaagcgagcuggaaacucccaacuuggcugagcgggccuuagauuggcuggaaaaacacggugcagagaggcucaagcgcauggcgauauccggcgacgacuguguagugaagccgaucgaugacagauucgccaccgcucuuacggcccugaaugauauggggaaaguccggaaggacauuccucaaugggaacccaguaaaggauggaacgauuggcagcaggugccauuuugcucucaccauuuccaccagcuaaucaugaaggacggcagggagauuguugugccuugucgaaaucaagaugagcuggucggucgugcaagagugagccagggggcuggauggucccuccgcgaaacagccugcuugggcaaaucauacgcacagauguggcaacugauguauuuucaucggagggaccuuagacuggccgcgaacgcuaucuguagugccguacccguugauugggugccagcaucucgcaccacuuggagcauacacgcccaccaucaguggaugacaaccgaggacaugcucuccgucuggaaucggguguggauugaagagaaccccuggauggaagauaagacucacguuucaagcugggaggaggugccuuacuuaggcaagagggaagaccaguggugcgggucucugaucggauugaccgcucgagccacaugggcaacgaauauccaggucgcuauuaaccaagugagacggcugauagguaaugagaacuaucucgacuacaugaccuccaugaaaagguucaagaaugaaagugauccagagggcgcccuuugguga

SEQ ID NO: 14136 - RNA, 9879 nt, Artificial Sequence
  derived and/or modified CDS sequence (opt3) from DENV-1__KC692508__SS-prME
agcgugaccaugcugcucaugcuucugcccacagccuuggcuuuccacuuaacuacgagaggcggggaaccucauaugaucgucuccaagcaggaaaggggaaaaucucugcuauuuaagaccucagcugguguuaacaugugcacccucauugccauggaccugggcgaacuuugugaagauacuaugaccuacaaaugcccacggauaacagaagcggaaccggacgauguggacuguuggugcaaugcuaccgauacuuggguaacauaugggaccuguagucaaacgggagaacaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauuccgcggggaagacggaugcugguacggcauggaaaucaggcccguuaaggagaaagaagagaaucuggugcgaaguaugguaagcgccgguucuggcgaaguggauuccuuuucacuugggauucugugugucaguaucaugauagaggaggugaugcggagccguuggucgagaaagauguugaugacuggaacacucgcuguuuuccugcuacugauuaugggccagcucaccuggaacgaccugaucaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaauugggcucagccugguugccucaguggaguugccaaacagucuggaagaguuaggagauggccucgcuaugggcaucaugaugcugaaacuucugaccgaguuccaaccccaccaguuguggacuacccuccugucccuaacauuugucaagacuacccugucucuugacuaugcguggaaaacgacagccaugguacucagcauugugucccuguucccguugugucugucaaccacuagccagaagacaaccugguuaccuguucuccuggggaguuuuggaugcaaaccacuuacuauguuccugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuacgugauuucagggucuagugcugacuuguccuuagaaaaggcagccgagguaagcugggaacaggaggcggaacauucuggagcuagccacaauauccugguggagguccaagaugacggcaccaugaaaauuaaggaugaggaacgggacgauacgcucacuauccugcuuaaagccacccuguuggcaguuuccggcguguauccaaugucaauaccugccacacuauucgugugguacuuuuggcagaagaaaaagcagagaagugggguccugugggacacccccagcccaccggagguggaaagggcuguucucgaugacggaauuuaucguauccugcagcgcggucuuuuaggccggucucaaguaggggugggagucuuccaggauggcguguuucauacaauguggcacguuacuagaggugcagugcugauguaccaggggaagaggcucgagccuuccugggccucagucaaaaaggacuugaucaguuauggaggcggcuggcgauuccaggggagcuggaacaccggagaggaagugcaaguaauugcggucgagcccgguaaaaauccaaagaacgugcagacgacacccggcacuuuuaaaaccccugaaggggagguuggagcuauagcccuggacuucaagccaggcacauccgguucucccaucgugaaucgggaagggaagauugucggacucuacggcaacggcgugguuaccacuucggggaccuacgugagcgcaaucgcccaggcuaaagccucacaagagggaccucugccggagauugaagaugaggucuuuaagaaacgcaaucuuacaaucauggaccugcacccagguuccggcaagacgagaagguauuugcccgcaauagugcgggaagcuaucaaacgaaagcuaagaacucugauucucgccccuacccgcguaguggcgagugagauggccgaagcauuaaaggggaugccaaucagguaccagacaaccgcuguuaaaucugagcauacuggacgugagauugucgaucugaugugccacgccacauucaccaugcggcuucugagccccgugagagugccuaacuauaauaugaucauaauggacgaagcucauuuuacggauccggcauccauugccgccaggggcuacaucucaacucgcgucgguaugggggaggcugcggcaaucuucaugacagccacacccccaggaucuguagaggcuuuuccucagagcaacgccgugauucaggacgaggaacgagauauccccgagagaaguuggaacuccggcuaugacuggauaaccgauuucccaggcaagacuguuugguucgugccuagcauuaaaucugggaacgacaucgcaaauugucuccggaagaacggaaaaagggucauucaauugucacgcaagacauuugauaccgaguaccagaagacuaaaaauaaugacugggacuaugugguuacuacggauaucuccgaaaugggugccaacuuccgugcugacagagugauagauccccggaggugccugaagccagucauucucaaagacggcccggagcgcgugauccuggcggggccuaugcccguaaccguggccagugcagcucagcgaagaggacggaucggcaggaaucagaacaaggaaggugaucaauacguuuacauggggcagccacuuaauaacgacgaggagcacgcccauuggacagaagcaaaaaugcuacuggauaauauuaacacucccgagggcaucauuccugccuuguuugaaccagagcgcgaaaagagcgcugccauagacggagaguauagauuaaggggcgaggcgcggaagaccuucgucgaacugaugcgucgcggggaucuccccguguggcugucguacaaaguggcaucugagggauuucaguauuccgaccgaagauggugcuucgauggugaaaggaauaaccagguccuugaggaaaauauggacguugagaucuggacaaaggagggcgaacggaaaaagcugcgcccuagauggcucgaugccaggaccuacagcgacccguuggcucugcgggaguuuaaagaguucgccgcugggcgaagaucagugaguggagaccuaauucuggagaucggcaagcucccacaacaccuuacucugcgcgcacagaacgccuuagauaauuugguaaugcugcacaacucugaacagggugggaaggcuuauaggcaugccauggaggagcuccccgacacgaucgaaacccugaugcuucuggcacucauugcgguguugacaggcggagucacucuguuuuucuuauccggcaaggggcuaggaaagaccagcauaggucugcucugugugacagccucaagugcacuucuguggauggccagcguugagccucacuggaucgcagcuuccauuaucuuggaauuuuuccugauggugcuccugauucccgagccagaucggcagcguaccccucaagacaaucagcuugccuacgucguaaucggccuccuguuuaugauauugacuguggcagccaacgagauggggcuguuagaaacaacgaaaaaggaucuaggaaucggcuauguugcugcggagaaccaucagcacgccaccaugcuggacguggaucuccaccccgcaucugcuuggacucuuuacgccgucgccacaaccgugauuaccccaaugaugagacauacaaucgaaaauacuacggcaaacauuagccugaccgcuaucgccaaucaagcggcuauauugaugggucuggacaaaggguggccuauuuccaagauggauaucggcgucccgcuccuggcccuuggaugcuacucacaggugaaccccuuaacacugacugcagccguucucauguugguggcucacuaugcaauuaucggcccagggcugcaggccaaagcgaccagggaggcucagaagcgcacagccgcaggaauaaugaagaauccuaccguagacggcaucguggccauugaucuagaccccgucguuuacgaugcuaaauucgaaaagcaacugggucagaucaugcuccuuauucuguguacuucucagaucuugcugaugcggacgacaugggcccucugcgagaguauaacccuggcaacugggccauuaaccacacuuugggagggaucgccuggcaaauucuggaacacuaccauugcugugagcauggccaauaucuuucgagguuccuaucuggcgggcgccgggcucgcauucucucuaaugaagucacugggaggcgggagaaggggaacaggcgcucagggugaaacguugggggagaaauggaagcgccaacugaaccagcucagcaaguccgaauuuaauaccuacaaacggaguggaaucauggaggucgacagaucugaagccaaggagggccuuaaacguggugagacuacaaagcaugcagugagcaggggcaccgcuaaacugcggugguucguagaacgcaacuuggugaagcccgaggggaagguuauugaccugggauguggccgagggggauggucauauuacugcgccggccucaaaaaggugacugaagucaaagguuauacaaaagggggaccgggccacgaggaaccaaucccuauggccaccuacggcuggaauuuagugaaacugcauuccgggaaggaugucuuuuucaugcccccagagaaaugugacacgcuucugugcgauauaggagagaguagccccaacccuaccauugaagaggguagaacacuaagggugcucaagaugguugaaccguggcugcggggcaaucaguuuuguaucaagauuuugaaccccuacaugccaucuguaguggagacucuggagcagaugcaacgcaaacacgggggaaugcucgucagaaauccucuuuccaggaacucaacccacgaaauguauugggugagcugcggcacagguaauaucguuucggcggugaacaugacuucucgaaugcuguuaaaccgguucaccauggcucaucguaagcccacauacgagagagacgucgaucugggggcaggaacccgccacguggccguagaaccugagguggcuaauuuggacauaaucggccagaggauugaaaacaucaaaaaugagcauaagaguacuuggcacuaugaugaggacaacccauacaaaacgugggccuaucacggcuccuacgaaguuaagcccagcgggucagcauccucuauggucaauggaguggugcggcuccugacaaagccuugggaugucauuccaaugguuacccagaucgccaugacugacaccacacccuuuggucaacagagaguguucaaagagaagguagauacgcgcaccccgagggcuaaacgaggcacuacacagauuauggaagugaccgcgaaguggcuauggagcuuucuuagucggaacaaaaagccuagaaucuguacuagggaggaguucacacgcaagguccguuccaaugccgcaauaggggcuguguuuguugacgagaaccaguggaauagcgccaaagaggcaguggaagacgagcgguucugggaucugguccauagagaaagggagcuccacaagcaaggaaaaugcgcaaccugcguguauaacaugaugggcaagcgcgagaagaaacugggugaguucgggaaagcuaaaggaucucgagccauuugguacaugugguugggcgcgcgguuucuggaguucgaagcacucggcuuuaugaaugaggaccauugguucucaagagaaaacagucuuuccgggguagagggagagggucugcacaaguuaggcuacauccugagggauaucagcaaaauuccagggggaaauauguaugccgacgauacagcuggcugggacacucgcauaaccgaagaugacuugcagaacgaggccaagaucacggauauuauggaacccgagcaugcacuccuggcuaccucuaucuuuaaacuaacauaccagaauaagguugugagaguccagcggccugccaaaaacgguacugugauggacgugauuucgaggcgugaucaacgagggucaggacaggucggcaccuauggccuuaacacauucacuaauauggaaguucagcugauccgccagauggagagcgaggggauauuucucccauccgaacuggagacccccaacuuggcugaaagagccuuagacuggcuggagaagcacggagcagaacggcucaagaggauggcgaucaguggugaugacugugugguaaaaccgauugacgaucgcuucgccacggcucuuacagcccugaaugacaugggcaaggugagaaaagauaucccucaaugggagcccucuaagggguggaacgacuggcagcaggucccauuuugcagccaccauuuccaccagcuaauuaugaaagauggacgggagaucgugguuccuuguaggaaucaagacgaacuggugggccgagcacgugucucccagggugcuggguggucacucagagagaccgccugcuugggaaagaguuacgcacagauguggcaacugauguauuuucaucgccgggaucuuaggcuggccgcgaacgcuauauguucugccgugcccguagacuggguuccagcaagcagaacuacaugguccauucacgcccaccaucaguggaugaccacugaagauaugcucucaguguggaaucgcgucuggaucgaggaaaaccccuggauggaggacaagacccacgugagcucuugggaggaaguuccuuacuuaggcaaacgggaggaucaguggugcggcucccugaucggguugacagcuagggccacgugggcaaccaauauucagguggcuauaaaccaaguccgaagacugaucggaaaugaaaacuaucucgacuacaugacaaguaugaagcgguucaaaaaugagagcgacccagagggugcccuuugguga

SEQ ID NO: 14137 - RNA, 9879 nt, Artificial Sequence
  derived and/or modified CDS sequence (opt3) from DENV-1__KC692509__SS-prME
agcgugaccaugcugcucaugcuucugcccacugccuuggcuuuccacuuaacuacgaggggcggggagccucauaugaucgucuccaaacaggaaaggggaaaaucucugcuauuuaagaccucagcugguguuaauaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaagggggugucuuaugucauguguacaggauccuucaaacuugaaaaggagguggcugagacucagcacgguaccguuuuggugcagguaaaguacgaaggcacggacgcgccuugcaaaauaccauuuagcacacaagaugagaagggggucacccagaacggacgccugaucacugcaaaucccauugugacagacaaagaaaagccuguuaacaucgagaccgagccacccuucggcgaaucguauauaguggucggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcguguucacaagcguagggaagcuggugcaucagguuuuuggaacggcauacggcgucuuguucuccggugugucuuggaccaugaaaauugggaucggcauucuccugacuugguuaggacugaauagccgcucaacaagucuauccaugaccuguauagcggugggcauggucacacucuaccuggggguuauggugcaggcugauagcggaugcgugaucaacuggaagggcagagagcuuaaaugugguucugggauuuuuguaacuaacgaaguccacaccuggacggagcaauauaaguuccaggccgacucaccgaagagguugagugcagccaucggaaaggcuugggaggaaggcgugugcgguauccggagcgccacacgccuggagaauauuauguggaagcagauauccaacgaacucaaucauauccuguuagagaacgauaugaaauuuaccguuguggucggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggagguggaagacuaugguuuugggguuuucacuaccaacauuuggcuuaaauugcgugauagcuacacacagaugugcgaccaccggcucauguccgcugcaaucaaggauucaaaagccgugcaugcugacaugggauauuggauagagagugaaaagaaugagacguggaaacuggcccgagcaucuuucauugaaguaaagaccuguacuuggccaaagagccacacacuaugguccaacggcguccuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgugguggucgaugaacacugcggaaacaggggccccucucugcgcacgacuaccguuacagguaaaaucauucaugagugguguugccgguccuguaccuuaccuccacucagauucagaggggaagacggaugcugguacggcauggaaauccgccccgugaaggagaaagaagagaaucugguacgaaguauggugagcgccgguucuggcgaagucgauuccuuuucacuugggauucugugugugaguaucaugauagaggagguuaugcggagccguuggucgagaaagauguugaugacuggaacacucgcuguguuccugcuacugauuaugggccagcucaccuggaacgaccugaucaggcuuugcaucauggucggggccaaugcauccgaccgcaugggaaugggcacaacuuacuuggcucugauggccaccuuuaagaugcggccuauguucgcaguggguuuacucuuuagaaggcugacgucucgagaaguucuucugcuaacaauugggcucagccugguggccucagucgaguugccaaacagucuggaagaguuaggagauggccucgcuaugggcaucaugaugcugaaacuucugaccgaguuccaaccccaccaguuguggacuacccuccugucccuaacauuuguacgcacuacccugucucuugacuaugcguggaagacgacagccauggugcucagcauuguuucccuguucccguugugucugucaaccacuagccagaaaacaaccugguuaccugugcuccuggggaguuuuggaugcaagccacuuacuauguuccugauaacagagaacaaaaucuggggucggaagucuuggcccuugaaugagggcauuauggcaaucgggauugucuccauccuccugagcucgcuacugaagaacgaugugccucuugcuggaccccucauagccggcgguaugcugaucgccuguuacguaauuucagggucuagugcugacuuguccuuagaaaaagcagccgaggugagcugggaacaggaggcggaacauucuggagcuagccacaauauccuggucgagguucaagaugacggcaccaugaagauuaaagaugaggaaagagacgauacgcucacuauccugcuuaaggccacccuguuggcaguguccggcguguauccaaugucaauaccugccacacuauucgucugguacuuuuggcagaaaaagaaacagaggaguggggugcugugggacacccccagcccaccggagauggaacgugcuguucucgaugacggaauuuaucgcauccugcagcggggucuuuuaggcagaucucaaguaggggugggagucuuccaggauggcguguuucauacaauguggcacguuacuaggggugcagugcugauguaccaggggaagcgacucgagccuuccugggccucagucaagaaagacuugaucaguuauggaggcggcuggcgguuccaggggagcuggaacaccggagaggaagugcaaguaauugcggucgagcccgguaagaaucccaaaaaugugcagacgacacccggcacuuuuaagaccccugaaggggagguuggagcuauagcccuggacuucaaaccaggcacauccgguucucccaucgugaaucgcgaagggaagauugucggacucuacggcaacggcgugguuaccacuucggggaccuacgugagcgcaaucgcccaggcuaaggccucacaagagggaccucugccggagauugaagaugaggucuuuaaaaagagaaaucuuacaaucauggaccugcacccagguuccggcaaaacgaggcgguauuugcccgcaauagugcgagaagcuaucaagagaaaacuacgcacucugauucucgccccuaccaggguaguggcgagugagauggccgaagcauuaaaggggaugccaauccguuaccagacaaccgcuguuaagucugagcauacuggacgggagauugucgaucugaugugccacgccacauucaccaugagacuucugagccccgugagggugccuaacuauaauaugaucauaauggacgaagcucauuuuacggauccggcauccauugccgcccgcggcuacaucucaacucgagucgguaugggggaggcugcggcaaucuucaugacagccacaccaccaggaucuguagaggcuuuuccucagagcaacgccgugauucaggacgaggaaagagauauccccgagcggaguuggaacuccggcuaugacuggauaaccgauuucccaggcaaaacuguuugguucgugccuagcauuaagucugggaacgacaucgcaaauugucucaggaaaaacggaaagcgcgucauucaauugucacguaaaacauuugauaccgaguaccagaagacaaagaacaaugacugggacuaugugguuacuacggauaucuccgaaaugggugccaacuucagagcugaccgggugauagaucccaggcgcugccugaaaccagucauucucaaggacggcccggagcgagugauccuggcggggccuaugcccguaaccguggccagugcagcucagagacggggaaggaucggccgcaaucagaacaaagaaggugaucaauacguuuacauggggcagccacuuaauaacgacgaggaucacgcccauuggacagaggcaaagaugcuacuggacaauauuaacacucccgaaggcaucauuccugccuuguuugagccagaaagagagaaaagcgcugccauagauggagaauauagguuacggggcgaggcgcguaagaccuucgucgagcugaugcgccgaggggaccuccccguguggcugucguacaagguggcaucugaaggauuucaguauuccgauagaagguggugcuucgacggugagcggaauaaccagguccuugaagagaauauggauguugaaaucuggacaaaagagggcgagcgcaagaaacugagaccuagguggcucgacgcccggaccuacagcgacccguuggcucugcgagaauuuaaggaguucgccgcugggagacgcucagugaguggagaucuaauucuggaaaucggcaaacucccacaacaccuuacucugagggcacagaacgccuuagacaauuugguaaugcugcacaacucugagcagggugggaaggcuuaucggcaugccauggaagaacuccccgauacgaucgagacccugaugcuucuggcacucauugcgguguugacaggcggagucacucuguuuuucuuauccggcaaagggcuaggaaagaccagcauaggucugcucugugugacagccucaagugcacuucuguggauggccagcguugaaccucacuggaucgcagcuuccauuaucuuggaguuuuuccugauggugcuccugauucccgaaccagaccgucagagaaccccucaagauaaucagcuugccuacgucguaaucggccuccuguuuaugauauugacuguggcagccaacgagauggggcuguuagagacaacgaagaaagaccuaggaaucggcuauguugcugcggaaaaccaucagcacgccaccaugcuggauguggaccuccaccccgcaucugcuuggacucuuuacgccgucgccacaaccgugauuaccccaaugaugaggcauacaaucgagaauacuacggcaaacauuagccugaccgcuaucgccaaucaagcggcuauauugaugggucuggauaagggguggccuauuuccaaaauggacaucggcgucccgcuccuggcccuuggaugcuacucacaggugaaccccuuaacacugacugcagccguucucauguugguggcucacuaugcaauuaucggcccagggcugcaggccaaggcgacccgcgaagcucagaaacggacagccgcaggaauaaugaagaauccuaccguagauggcaucguggccauugaccuagaucccgucguuuacgacgcuaaguucgagaaacaacugggucagaucaugcuccuuauucuguguacuucucagaucuugcugaugcgaacgacaugggcccucugcgaaaguauaacccuggcaacugggccauuaaccacacuuugggagggaucgccuggcaaguucuggaacacuaccauugcugugagcauggccaauaucuuuagagguuccuaucuggcgggcgccgggcucgcauucucucuaaugaaaucacugggaggcgggaggcgcggaacaggcgcucagggugagacguugggggaaaaguggaaacggcaacugaaccagcucagcaaguccgaguuuaauaccuacaagagaaguggaaucauggaagucgaccguucugaggccaaagaaggccuuaagaggggugagacuacaaaacaugcagugagccggggcaccgcuaagcugcgcugguucguagagcgaaacuuggugaaacccgaagggaagguuauugaucugggauguggcagagggggauggucauauuacugcgccggccucaagaaagugacugaggucaaggguuauacaaaagggggaccgggccacgaagaaccaaucccuauggccaccuacggcuggaauuuagugaagcugcauuccgggaaagacgucuuuuucaugcccccagaaaagugugauacgcuucugugcgacauaggagagaguagccccaacccuaccauugaggaagguaggacacuacgggugcucaaaaugguugagccguggcugcgcggcaaucaguuuuguaucaagauuuugaaccccuacaugccaucuguaguggaaacucuggagcagaugcaaagaaagcacgggggaaugcucgucaggaauccucuuucccgaaacucaacccacgagauguauugggugagcugcggcacagguaauaucguuucggcggugaacaugacuucucggaugcuguuaaaccguuucaccauggcucauagaaaacccacauacgaacgcgaugucgaccugggggcaggaaccaggcacguggccguagagccugaaguggcuaauuuggauauaaucggccagcggauugagaacaucaagaaugaacauaaaaguacuuggcacuaugacgaggauaacccauacaagacgugggccuaucacggcuccuacgagguuaaacccagcgggucagcauccucuauggucaauggaguggugagacuccugacaaagccuugggacgucauuccaaugguuacccagaucgccaugacugauaccacacccuuuggucaacagcgcguguucaaggaaaaaguagacacgaggaccccgcgagcuaagcggggcacuacacagauuauggaggugaccgcgaaauggcuauggggguuucuuagcagaaacaagaaaccuaggaucuguacucgcgaagaguucacacguaagguccggaguaaugccgcaauaggagcuguguuuguugacgaaaaccaguggaacuccgccaaggaggcaguggaggaugaaagauucugggaccugguccauagggagcgcgaacuccacaaacaaggcaagugcgcaaccugcguguauaacaugauggguaaacgagagaagaaacugggggaguucggaaaggcuaagggcagccgggccauuugguacaugugguugggcgcgagauuucuggaguucgaggcacucggguuuaugaaugaagaucauugguucucuagggagaacucacuuaguggaguagaaggugagggccugcacaaauuaggguacauccugcgcgacaucuccaagauuccaggaggcaauauguaugccgaugacacagcugguugggauacuagaauaaccgaggacgauuugcagaacgaagccaaaaucacggacauuauggagcccgaacaugcacuccuggcuaccagcaucuuuaagcuaacauaccagaauaaaguugugcggguccagaggccugccaagaacgggacugugauggaugugauuucucgucgagaccaacgcggaucgggccaggucggcaccuaugggcuuaacacauucacuaauauggagguucagcugaucagacagauggaaucagagggaauauuucucccaagcgagcuggaaacccccaacuuggcugagcgggccuuagauuggcuggaaaaacacggugcagagaggcucaagcgcauggcgaucuccggcgacgacugugugguaaagccgauugaugacagauucgccacggcucuuacagcccugaaugauauggggaaagugcggaaggacaucccucaaugggaacccaguaaaggauggaacgauuggcagcaggucccauuuugcucucaccauuuccaccagcuaauuaugaaggacggcagggagaucgugguuccuugucgaaaucaagaugagcuggugggucgugcaagagucagccagggggcuggauggucccuccgcgaaaccgccugcuugggcaaaucauacgcacagauguggcaacugauguauuuucaucggagggaccuuagacuggccgcgaacgcuauauguagugccgugcccguagauuggguuccagcaucucgcacuacauggagcauucacgcccaccaucaguggaugaccacugaggacaugcucuccguguggaaucgggucuggaucgaagagaaccccuggauggaagauaagacccacgugucaagcugggaggagguuccuuacuuaggcaagagggaagaccaguggugcgggucucugaucggauugacagcucgagccacgugggcaaccaauauucagguggcuauaucccaagucagacggcugaucgguaacgagaauuaucucgacuacaugacaaguaugaaaagguucaagaacgaaagcgauccagagggcgcccuuugguga

SEQ ID NO: 14138 - RNA, 9879 nt, Artificial Sequence
  derived and/or modified CDS sequence (opt3) from DENV-1__KC692510__SS-prME
agcgugaccaugcugcucaugcuucugcccaccgccuuggcuuuccacuuaacuacgagaggaggggaaccucauaugaucgucuccaagcaggaaaggggaaaaucucugcuauuuaagaccucagcugguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaggcagauccagcggguggagacuugggcccugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaaacuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagaaaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaaacuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggcaagaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugagaagaaugagacguggaagcuggccagagcaucuuucauugaagugaaaaccuguacuuggccaaagagccacacacuaugguccaacggcguacuggagucagagaugaucauucccaagaucuuugguggcccuauaagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagaucauucaugagugguguugcagauccuguaccuuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugacuggaacacucgcuguuuuccugcuacugauuaugggccagcucaccuggaacgaccugauccgccuuugcaucauggugggggccaaugcauccgaccggaugggaaugggcacaacuuacuuggcucugauggccaccuuuaagaugagaccuauguucgcagucgguuuacucuuuaggcgacugacgucucgcgaagugcuucugcuaacaauugggcucagccugguugccucaguggaguugccaaacagucuggaagaguuaggagauggccucgcuaugggcaucaugaugcugaaacuucugaccgaguuccaaccccaccaguuguggacuacccuccugucccuaacauuugucaaaacuacccugucucuugacuaugcguggaagacgacagccaugguacucagcauugugucccuguucccguugugucugucaaccacuagccagaaaacaaccugguuaccuguucuccuggggaguuuuggaugcaagccacuuacuauguuccugauaacagagaacaaaaucuggggucggaagucuuggcccuugaaugagggcauuauggcaaucgggauuguguccauccuccugagcucgcuacugaagaacgaugucccucuugcuggaccccucauagccggcgguaugcugaucgccuguuacgugauuucagggucuagugcugacuuguccuuagaaaaagcagccgagguaagcugggaacaggaggcggaacauucuggagcuagccacaauauccugguggagguccaagaugacggcaccaugaagauuaaagaugaggaaagagacgauacgcucacuauccugcuuaaggccacccuguuggcaguuuccggcguguauccaaugucaauaccugccacacuauucgugugguacuuuuggcagaaaaagaaacagaggagugggguccugugggacacccccagcccaccggagguggaacgugcuguucucgaugacggaauuuaucgcauccugcagcggggucuuuuaggcagaucucaaguaggggugggagucuuccaggauggcguguuucauacaauguggcacguuacuaggggugcagugcugauguaccaggggaagcgacucgagccuuccugggccucagucaagaaagacuugaucaguuauggaggcggcuggcgguuccaggggagcuggaacaccggagaggaagugcaaguaauugcggucgagcccgguaagaaucccaagaaugugcagacgacacccggcacuuuuaagaccccugaaggggagguuggagcuauagcccuggacuucaaaccaggcacauccgguucucccaucgugaaucgcgaagggaagauugucggacucuacggcaacggcgugguuaccacuucggggaccuacgugagcgcaaucgcccaggcuaaggccucacaagagggaccucugccggagauugaagaugaggucuuuaaaaagagaaaucuuacaaucauggaccugcacccagguuccggcaaaacgaggcgguauuugcccgcaauagugcgagaagcuaucaagagaaaacuacgcacucugauucucgccccuaccaggguaguggcgagugagauggccgaagcauuaaaggggaugccaauccguuaccagacaaccgcuguuaagucugagcauacuggacgggagauugucgaucugaugugccacgccacauucaccaugagacuucugagccccgugagggugccuaacuauaauaugaucauaauggacgaagcucauuuuacggauccggcauccauugccgcccgcggcuacaucucaacucgagucgguaugggggaggcugcggcaaucuucaugacagccacaccaccaggaucuguagaggcuuuuccucagagcaacgccgugauucaggacgaggaaagagauauccccgagcggaguuggaacuccggcuaugacuggauaaccgauuucccaggcaaaacuguuugguucgugccuagcauuaagucugggaacgacaucgcaaauugucucaggaaaaacggaaagcgcgucauucaauugucacguaaaacauuugauaccgaguaccagaagacaaagaacaaugacugggacuaugugguuacuacggauaucuccgaaaugggugccaacuucagagcugaccgggugauagaucccaggcgcugccugaaaccagucauucucaaggacggcccggagcgagugauccuggcggggccuaugcccguaaccguggccagugcagcucagagacggggaaggaucggccgcaaucagaacaaagaaggugaucaauacguuuacauggggcagccacuuaauaacgacgaggaucacgcccauuggacagaggcaaagaugcuacuggacaauauuaacacucccgaaggcaucauuccugccuuguuugagccagaaagagagaaaagcgcugccauagauggagaauauagguuacggggcgaggcgcguaagaccuucgucgagcugaugcgccgaggggaccuccccguguggcugucguacaagguggcaucugaaggauuucaguauuccgauagaagguggugcuucgacggugagcggaauaaccagguccuugaagagaauauggauguugaaaucuggacaaaagagggcgagcgcaagaaacugagaccuagguggcucgacgcccggaccuacagcgacccguuggcucugcgagaauuuaaggaguucgccgcugggagacgcucagugaguggagaucuaauucuggaaaucggcaaacucccacaacaccuuacucugagggcacagaacgccuuagacaauuugguaaugcugcacaacucugagcagggugggaaggcuuaucggcaugccauggaagaacuccccgauacgaucgagacccugaugcuucuggcacucauugcgguguugacaggcggagucacucuguuuuucuuauccggcaaagggcuaggaaagaccagcauaggucugcucugugugacagccucaagugcacuucuguggauggccagcguugaaccucacuggaucgcagcuuccauuaucuuggaguuuuuccugauggugcuccugauucccgaaccagaccgucagagaaccccucaagauaaucagcuugccuacgucguaaucggccuccuguuuaugauauugacuguggcagccaacgagauggggcuguuagagacaacgaagaaagaccuaggaaucggcuauguugcugcggaaaaccaucagcacgccaccaugcuggauguggaccuccaccccgcaucugcuuggacucuuuacgccgucgccacaaccgugauuaccccaaugaugaggcauacaaucgagaauacuacggcaaacauuagccugaccgcuaucgccaaucaagcggcuauauugaugggucuggauaagggguggccuauuuccaaaauggacaucggcgucccgcuccuggcccuuggaugcuacucacaggugaaccccuuaacacugacugcagccguucucauguugguggcucacuaugcaauuaucggcccagggcugcaggccaaggcgacccgcgaagcucagaaacggacagccgcaggaauaaugaagaauccuaccguagauggcaucguggccauugaccuagaucccgucguuuacgacgcuaaguucgagaaacaacugggucagaucaugcuccuuauucuguguacuucucagaucuugcugaugcgaacgacaugggcccucugcgaaaguauaacccuggcaacugggccauuaaccacacuuugggagggaucgccuggcaaguucuggaacacuaccauugcugugagcauggccaauaucuuuagagguuccuaucuggcgggcgccgggcucgcauucucucuaaugaaaucacugggaggcgggaggcgcggaacaggcgcucagggugagacguugggggaaaaguggaaacggcaacugaaccagcucagcaaguccgaguuuaauaccuacaagagaaguggaaucauggaagucgaccguucugaggccaaagaaggccuuaagaggggugagacuacaaaacaugcagugagccggggcaccgcuaagcugcgcugguucguagagcgaaacuuggugaaacccgaagggaagguuauugaucugggauguggcagagggggauggucauauuacugcgccggccucaagaaagugacugaggucaaggguuauacaaaagggggaccgggccacgaagaaccaaucccuauggccaccuacggcuggaauuuagugaagcugcauuccgggaaagacgucuuuuucaugcccccagaaaagugugauacgcuucugugcgacauaggagagaguagccccaacccuaccauugaggaagguaggacacuacgggugcucaaaaugguugagccguggcugcgcggcaaucaguuuuguaucaagauuuugaaccccuacaugccaucuguaguggaaacucuggagcagaugcaaagaaagcacgggggaaugcucgucaggaauccucuuucccgaaacucaacccacgagauguauugggugagcugcggcacagguaauaucguuucggcggugaacaugacuucucggaugcuguuaaaccguuucaccauggcucauagaaaacccacauacgaacgcgaugucgaccugggggcaggaaccaggcacguggccguagagccugaaguggcuaauuuggauauaaucggccagcggauugagaacaucaagaaugaacauaaaaguacuuggcacuaugacgaggauaacccauacaagacgugggccuaucacggcuccuacgagguuaaacccagcgggucagcauccucuauggucaauggaguggugagacuccugacaaagccuugggacgucauuccaaugguuacccagaucgccaugacugauaccacacccuuuggucaacagcgcguguucaaggaaaaaguagacacgaggaccccgcgagcuaagcggggcacuacacagauuauggaggugaccgcgaaauggcuauggggguuucuuagcagaaacaagaaaccuaggaucuguacucgcgaagaguucacacguaagguccggaguaaugccgcaauaggagcuguguuuguugacgaaaaccaguggaacuccgccaaggaggcaguggaggaugaaagauucugggaccugguccauagggagcgcgaacuccacaaacaaggcaagugcgcaaccugcguguauaacaugauggguaaacgagagaagaaacugggggaguucggaaaggcuaagggcagccgggccauuugguacaugugguugggcgcgagauuucuggaguucgaggcacucggguuuaugaaugaagaucauugguucucuagggagaacucacuuaguggaguagaaggugagggccugcacaaauuaggguacauccugcgcgacaucuccaagauuccaggaggcaauauguaugccgaugacacagcugguugggauacuagaauaaccgaggacgauuugcagaacgaagccaaaaucacggacauuauggagcccgaacaugcacuccuggcuaccagcaucuuuaagcuaacauaccagaauaaaguugugcggguccagaggccugccaagaacgggacugugauggaugugauuucucgucgagaccaacgcggaucgggccaggucggcaccuaugggcuuaacacauucacuaauauggagguucagcugaucagacagauggaaucagagggaauauuucucccaagcgagcuggaaacccccaacuuggcugagcgggccuuagauuggcuggaaaaacacggugcagagaggcucaagcgcauggcgaucuccggcgacgacugugugguaaagccgauugaugacagauucgccacggcucuuacagcccugaaugauauggggaaagugcggaaggacaucccucaaugggaacccaguaaaggauggaacgauuggcagcaggucccauuuugcucucaccauuuccaccagcuaauuaugaaggacggcagggagaucgugguuccuugucgaaaucaagaugagcuggugggucgugcaagagucagccagggggcuggauggucccuccgcgaaaccgccugcuugggcaaaucauacgcacagauguggcaacugauguauuuucaucggagggaccuuagacuggccgcgaacgcuauauguagugccgugcccguagauuggguuccagcaucucgcacuacauggagcauucacgcccaccaucaguggaugaccacugaggacaugcucuccguguggaaucgggucuggaucgaagagaaccccuggauggaagauaagacccacgugucaagcugggaggagguuccuuacuuaggcaagagggaagaccaguggugcgggucucugaucggauugacagcucgagccacgugggcaaccaauauucagguggcuauaaaccaagucagacggcugaucgguaaugagaacuaucucgacuacaugacuuccaugaaaagguucaagaaugaaagugauccagagggcgcccuuugguga

SEQ ID NO: 14139 - RNA, 9879 nt, Artificial Sequence
  derived and/or modified CDS sequence (opt3) from DENV-1__KC692511__SS-prME
agcgugaccaugcugcucaugcuucugcccacagccuuggcuuuccacuuaacuacgagaggcggggagccucauaugauagucuccaagcaggaaagaggcaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccacaugugggcuugggucucgagacuagaaccgaaacauggauguccucugagggggcauggaaacagauccagaagguugaaaacugggcccugaggcacccuggauucacugugauugcucuguuucucgcacaugccaucggcaccucgauuacacagaagggcaucauauucaucuuacugaugcuugucaccccaucaauggcuaugcggugcguggggauuggaaaucgcgauuuuguagaggguuugagcggcgccacguggguugacgugguccuggagcacgggaguugugugacuacaauggcgaaaaacaagcccacccuagauaucgaacuccugaaaacugaggugacaaauccugcaguccuuagaaagcugugcauugaagccaaaaucuccaacaccacgaccgacucuagguguccaacacaaggagaggcuacuuugguugaggaacaagaugccaauuucgugugccggcgcaccuuuguagaccgaggcugggguaacggguguggacucuucggcaagggcagccuguuaacaugcgcaaaguuuaaaugcgugacuaagcuggaggggaaaauaguccaguacgaaaaucucaaguauuccgugauuguuaccgugcacacaggagaucagcaucaagucgguaacgagaccacugaacacggcacgaucgcuacaauuacuccccaagccccuaccucagagauccagcuuaccgacuacggggcgcugacauuggacuguaguccaagaaccggacuagauuucaaugaaauggugcugcucacuaugaaagaaaagagcuggcugguacauaaacagugguuucuugaccugccguugcccuggacaucuggcgccuccacgucacaagagaccuggaacaggcaggaucuccugguuacuuucaagacagcacacgcuaagaaacaggaaguggucguguuagguagccaagagggggccaugcacaccgcucugacaggcgccacugaaauccagaccaguggaacgaccacaauuuuugcaggccaucuaaagugccggcucaaaauggacaagcugacucuuaaagggaugucuuaugucauguguaccggauccuucaaguuggagaaggaaguggccgagacacagcacgguacuguucuggugcagguaaaauacgagggcaccgaugcuccuugcaagauaccauuccucacgcaagacgaaaaaggggucacacagaauggacgucugaucaccgcgaaccccauugugacugauaaggagaaaccuguuaauaucgaaacagagccacccuuuggcgagagcuauauaguggucggugcaggggaaaaggcccuuaagcugucgugguucaaaaagggaucuuccauuggaaaaauguuugaggcuaccgcccgcggcgcaagaaggauggccaucuugggggacacugcuugggauuucggaucaaucgguggccucuuuaccaguguggggaagcugauucaucagaucuucggaacagccuacggcguauuauuuagcgguguguccuggacgaugaaaauugggauaggcauccugcuaaccuggcucggacugaacucucggagcacuucacuuaguaugacauguauugcaguuggcauggucaccuuguaccugggggugauggugcaggcggacuccggaugcgucaucaacuggaagggccgagaacucaagugugguagcgggaucuucguuacaaaugaggugcacacuuggaccgaacaauauaaauuucaggcugauucuccgaagcgccugucagccgcaauuggaaaagccugggaggagggcgugugcgguauaagaagugcuacgagguuagaaaacaucauguggaagcagauuagcaaugagcugaacuacauccuuuuggaaaaugacaugaaauucacaguagucgugggcgacauuaacgggauccucgcccagggaaagaaaaugauacggccucaacccauggagcauaaguauuccuggaagucuuggggcaaagcaaagaucauuggggcugauauccagaauaccacuuuuauuaucgacggaccagauaccccugaaugucccaacgaccagcgcgccuggaauauaugggagguugaggauuacggcuucgguauuuuuacaacuaacaucuggcugaaacuaagagacucgcacacccagaugugcgaucacaggcugaugagcgcggccauuaaggacuccaaagcugugcaugcagauaugggguauuggaucgaaucagagaagaaugaaacauggaagcucgcccgugcuaguuucauagaggucaaaacguguaucuggccaaagucucacacccuguggagcaacggagugcuugaauccgagaugguuauucccaaaaucuacggcgguccuauuucacaacauaauuaucggccaggcuacuucacucagacagccgggccguggcacuugggaaagcuggaguuagacuuugaucucugcgaaggcaccacugugguagucgacgagcacugcggguaccgaggacccagccugagaacaaccacggugacuggcaaaaucauacaugaaugguguugcaggucuuguacccuuccuccacugcgcuuccggggugaggaugggugcugguauggaauggagauuagacccgugaaggaaaaggaggaaaacuuggucagguccaugguuagugcaggcagcggugagguggacucuuuuucccucggcauccuguguguaucaauccuaauugaagaggugaugcgcagucgauggagccggaaaaugcugaugacagggacccucgcggucuuccugcuuuugaucaugggacagcugacuuggaaugacuuaauucgucucugcauaauggugggcgccaacgcuucggauagaauggggaugggaacaaccuaccuggcccuuauggcaacauuuaagaugaggccuauguucgcuguuggccugcuauuucgccggcucacuuccagagaggugcuguugcugaccgucgguuuaucucucguggccagcguugaacugccaaacucacuugaggaacugggggacggauuggcaaugggcaucaugaugcucaaacugcuaacggauuuccaaccccaccagcuguggacaacccuucucagucugacuuuuauuaggaccuccuugucucuggacuaugccuggaagacaauggcuauggcguuaagcaucgugucccucuucccgcugugucuuucaacuaccagccagaaaacgacauggcugccugucuugcucggcaguuuugggugcaagccacugaccauguuccuaauuacugagaauaagaucuggggacgaaaaucuuggcccauaaacgaagguaucauggccguaggcauuguguccauccugcuuagcucgcuccugaagaaugauguuccuuuggcagggcccuuaauugcuggaggcaugcugaucgccuguuacgugauaucagguucuagugccgaccucucccuggagaaagcugcagaggucagcugggaagaggaagccgagcauucugggacaagccacaacauucuuguggaaguacaggaugacggaaccaugaagaucaaagaugaggagcgcgacgauacucugacaaucuugcuaaaggcgacccugcucgcuguguccggcgucuauccaaugucaauuccugccacgcuguuuguuugguacuucuggcagaaaaagaagcagcggaguggcgugcuuugggacacucccagcccaccggaaguggagagagcagucuuagaugacgggauauauaggauccugcagcguggacucuugggucgcucucaggugggcguugggguauuccaagacggaguguuucauaccauguggcacgucacacggggcgccgugcugauguaccaggguaaaagacucgaaccuuccugggcuucaguuaagaaagaucugauuaguuacgggggaggcuggagguuccagggcagcuggaauaccggggaggaggugcaggucaucgcaguggaacccggaaagaaccccaaaaauguacaaacaacucccgguaccuuuaagacgccugagggcgaagucggggccauugcgcuugacuucaagccaggaacauccggcucucccaucgugaaccgagaggguaaaauaguugggcuguauggaaauggcguggucacuaccucgggcacauacgugagcgcuaucgcccaggcaaaggccacccaggaagggccuuugccggagauugaggaugaaguuuuuaaaaagcggaaccuaacuaucauggaccugcacccaggaucagguaaaacccgcagauaucuccccgcuauugugagggaggccaucaagcggaaguuacgaacacugauacuugcaccuacgagagucguggcuuccgaaauggccgaggcgcugaaaggcaugccaauucgcuaccaaacuaccgccguaaagagugaacauacagggagggagaucguggaucucaugugccacgcaaccuucacuaugcguuugcugucucccguucgggucccuaauuauaacaugaucauuauggacgaggcucauuuuacagauccggccagcaucgcugcaagaggauacauauccaccagggugggcaugggugaagccgccgcuauuuucaugacggcgacucccccagggucaguggaggcauuuccucagucuaaugccgucauccaggacgaggaacgcgauauucccgaacgaagcuggaacaguggauaugacuggaucacagauuucccaggcaaaaccguaugguuugugccuuccauaaagagcggcaaugacauugcuaacugucucaggaaaaacgggaagcggguuauccagcugucuaggaagaccuucgacacugaguaccagaaaacgaagaauaacgauugggacuacguggucaccacagauaucucagagaugggagccaauuuccgcgcagaccgugugauugaucccagacggugccuuaaaccaguuauccuaaaggaagguccggagagggugauucuggccggcccuaugcccgucacuguggcuuccgcggcccagcgccgagggagaauaggacggaaccagaauaaagaaggcgaccaguauaucuacaugggucaaccauugaacaaugaugaggaccacgcacauuggacggaggcuaagauguuacuggauaacauuaauacccccgaagggaucaucccugcccucuuugagccagaaagggagaagagugcagccauugacggcgaauaucgccugagaggagaggcuaggaaaacauucguagagcuuaugcggcguggcgaucugcccguguggcucagcuacaagguugccucggaaggguuucaguauucugaccgccgauggugcuucgauggagagagaaacaaucaggucuuggaagagaacauggacguggaaauauggacuaaagagggugagaggaagaaacugcggccucgcuggcuagacgcgagaaccuacuccgauccgcuggcacucagggaauuuaaggaguucgccgcuggccggcgaagcgugucaggggaccuuauccuggaaauuggaaaauuaccacagcacuugacacugagagcccaaaaugcucucgauaaccuggucaugcuucacaauagugagcagggcgguaaggcauaucgccaugccauggaggagcugcccgacaccaucgagacucucauguugcuggcuuuaauugccguucuaacagggggcgugacccuguuuuuccucucuggaaagggccuugggaaaacauccaucggacuguuguguguaauggcaagcucagcgcugcucuggauggccaguguggaaccucacuggauagcugccagcaucauucuggaguuuuuccuuaugguccuccugauccccgaaccagauaggcagcggacuccucaggacaaccaauuggcauacgugguuauuggucuguuauuuaugauccuaaccguggcugccaacgagaugggccugcucgagacaaccaagaaagaucuugggauaggacaugucgcaguagaaaaucaccaccaugccacuaugcuggacguggauuugcgucccgcuuccgcguggacacuguacgccguugcaacgaccgugauuacuccaaugaugagacacacaaucgagaacaccaccgcuaauauuucucucacagccaucgccaaccaggcagcuauacugaugggccuugacaaggguuggccuaucagcaaaauggauauuggggucccguuacuggcccucggcugcuauucccaggugaaucccuugacucugacggcggcuguccuaaugcugguggcccauuacgcaaucauuggaccaggccuccaagccaaggcuaccagggaagcacagaagcgcacagccgcggggaucaugaaaaacccuacuguugacggaauagugaccauugaucuugaccccguaguguaugacgcuaaguucgagaaacagcugggccagaucauguugcugauccucuguacaucacaaauucuguuaaugcggaccacuugggcccuuugcgaaucuaucacgcuggcaacagguccacucaccacucuaugggaggggaguccuggaaaguuuuggaauaccacaauagccgucucgauggcuaacauuuuccgaggcagcuaccuggccggugcaggcuuggcuuucucccugaugaaaucucucgggggaggcagaagggggacuggagcccagggcgagacccuuggugaaaaguggaagcgccagcugaaucaguugucaaaaagcgaguuuaacacauauaagaaauccgggaucauggaaguugaucggagugaggcgaaggaaggacugaaaagaggcgagacgaccaagcacgccgugucucgugguacugcaaagcucaggugguucgucgagcggaauuuagugaaacccgaaggcaagguaauugaccugggguguggacgcggcggguggagcuacuauugcgcuggacuuaaaaaggugacagagguuaaaggcuacaccaagggugggccgggacaugaggagccaaucccuauggccacuuacggcuggaaccuggugaaacuacacucaggcaaggaugucuuuuucacacccccagaaaagugugacacccuccugugcgauauaggggaguccagucccaauccuacgaucgaggaaggacgaaccuugagagugcugaaaauggucgagccguggcucagggguaaccaauuuuguauuaagauccuuaaucccuauaugccaagcgugguugaaacacuggagcagaugcagcggaaacacggcgggauguuaguacgcaacccucugucuagaaauuccacucaugagauguacugggugucaugcggaaccggcaacauugucagcgcagugaacaugacaucgaggauguugcucaaucgauucacuauggcucaccggaagcccaccuaugaacgugacguugaucugggugccgggacaagacauguggccgucgagccugaaguggcgaaccuagacaucauuggacagcgcaucgagaauaucaaaaacgaacacaagucuaccuggcacuacgaugaggacaauccauauaagacuugggcuuaccauggcaguuaugagguaaaacccuccggcagcgcaucauccauggugaacgggguugucaggcuucugacgaagccuugggaugugauuccaauggugacacaaaucgccaugaccgacacuacccccuuuggacagcagcgggucuucaaagaaaagguugacacaagaacgccgcgcgcuaaaagggguaccgcccaaaucauggaggugacugcaaaguggcucuggggcuuucugucucgaaauaagaaaccucggauuuguacaagagaagaguucaccaggaagguacgcagcaacgccgcuauaggggcgguguuugucgaugaaaaucaguggaacagugccaaagaggcaguggaggacgaacguuucugggauuugguucaccgggagagagaacugcauaagcagggaaaaugcgcuacuugcguguacaauaugaugggcaagagggagaagaaacucggugaauuugggaaggccaaaggaucccgcgcaaucugguacauguggcuuggcgcccgauuccuggaguucgaggcuuuaggcuuuaugaacgaagaccacugguucagccgggaaaauucucugucaggggucgaaggagaggguuugcauaagcucggcuauauucugagagauaucaguaaaauuccagggggaaacauguacgccgacgauacagcgggcugggacaccaggaucacagaggaugaccuacagaaugaagcaaagauaacugauaucauggagcccgaacacgcccuucuggcuaccuccauuuuuaaacucacguaucaaaacaaggugguacgcguucagagaccugccaagagcgguaccgugauggacgucaucucucggagggaucagcgugggucgggacaggugggcacauacggccugaacacuuucaccaauauggaggugcaauugauucgacagauggaaucagaggggaucuuuagcccauccgaguuagaaacacccaaccuggccaaaaagguccucgacuggcuugagaaacacggagcugaacgccugaagagaauggccauaaguggugacgauuguguugugaaaccgauugacgaucgguucgcuacugcccuaaccgcacugaaugacaugggcaagguaaggaaggauaucccucagugggagcccucuaaaggguggaacgacuggcagcaagugccauuuugcagccaucacuuccaucagcucaucaugaaggauggacgcgaaauugucgugccuuguagaaaucaggacgaguugguuggccgggcgagggugucccagggugccggguggucacugcgagagacggcuugccuuggaaaaaguuaugcccaaauguggcagcugauguacuuucaccguagagaucuccgcuuagcagcuaacgccauauguucugcaguccccguggacuggguaccaacaagccggaccacuugguccauccacgcccaucaccaguggaugacaaccgaagauaugcugucaguuuggaauaggguguggauugaggaaaaccccuggauggaggacaagacucaugucagcucuugggaagaggugccuuauuugggcaaaagagaggaccaauggugcggcucccugaucgggcucaccgcgcgcgcuacaugggccacgaauauucagguugcaaucaaccaggugcggaggcuuauaggaaaugaaaacuaccuggauuacaugaccaguaugaagcgauucaagaaugagagcgacccagaaggugcccuaugguga

SEQ ID NO: 14140 - RNA, 9879 nt, Artificial Sequence
  derived and/or modified CDS sequence (opt3) from DENV-1__KC692512__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagacuuuguggaggguuugagcggcgcgacuuggguagauguugugcuggaacacgggaguugugucacaaccauggcaaagaauaaacccacucuagacaucgagcuccugaagacagaagugaccaacccugccgugcuuaggaaacugugcauugaggcuaagaucuccaauacgaccacagauucucgguguccaacucaaggagaagccaccuuggucgaggagcaggacgcaaacuucguuugccgccgaacauuuguggauagaggcugggguaauggguguggacucuucggcaaaggcagccuguuaacuugcgcuaaguuuaagugcguaaccaaacuggaagggaagauagugcaguacgagaaccucaaauauuccgucauugugacaguucacaccggagaccagcaucaaguggguaaugaaacuacggagcacggcacaaucgccaccauuacuccccaggcgccuaccucagaaauccagcuuacagauuacggggcccugaccuuggacuguaguccaaggacuggacuagacuucaacgagaugguccugcucacaaugaaggagaaaagcuggcuggugcauaagcagugguuucuugaucugccguugcccuggacgucuggcgcauccaccucacaagaaacuuggaaucggcaggaccuccugguaacauucaaaaccgcucacgccaagaagcaggagguuguggucuuagguagccaagaaggggcuaugcacacagcccugacuggcgcaaccgagauccagacgaguggaaccacaacuauuuuugccggccaucuaaaaugccgucucaagauggauaaacugacccuuaaggggaugucuuaugugauguguacaggauccuucaaauuggaaaaggaggucgcugagacucagcacgguaccgugcugguucaggugaaguacgaaggcacggacgcgccuugcaaaauaccauucagcacacaagaugagaaggggguaacccagaacggacgccucaucacugcaaaucccauugucacagacaaagaaaagccugugaacaucgagaccgagccacccuuuggcgaaucguauauaguugugggugccggggagaaagcucugaagcuuucuugguucaagagaggcuccucaauuggaaaaauguuugaagccacugcaaggggcgcccggcgaauggcuauccugggggauaccgccugggacuucggaaguaucgguggcgucuuuacaagcguggggaaguugguacaucagguguucggaacggcauacggcguucucuuuuccggugucucuuggaccaugaaaauugggaucggcauucuguuaacuuggcugggacuaaauagccgcucaacaagucucuccaugaccuguauagcggugggcauggugacacuguaccuuggggucaugguucaggcugauagcggaugcgugaucaacuggaagggcagagaguugaaaugugguucugggauuuucgugacuaacgaaguacacaccuggacggagcaauauaaguuucaggccgacucaccgaagaggcugagugcagccaucggaaaagcuugggaggaaggcgucugcgguauccggagcgccacacgccucgagaauauuauguggaagcagauauccaacgaacugaaucauaucuuacuggagaacgauaugaaauucaccgugguugugggcgacgcaaaugggauucuugcucagggaaagaaaaugaucagaccucaacccauggaacacaaguacucuuggaaaucguggggcaaggccaagauuaucggggcggacauacagaacacuaccuuuaucauugauggaccagacacaccugagugucccgauggccagagggccuggaauaucugggaggucgaagacuaugguuucgggguguuuacuaccaacauuugguugaaacuccgugauagcuacacacagaugugcgaccaccggcugauguccgcugcaaucaaggauucaaaagccguucaugcugacaugggauauuggauagagagugaaaagaaugagacguggaaacuagcccgagcaucuuucauugaagugaagaccuguacuuggccaaagagccacacacugugguccaacggcguacucgagucagagaugaucauucccaaaaucuucgguggcccuauaagccaacauaauuacagaccaggguauuuuacccagacugcgggaccguggcaccugggcaagcuugaauuggauuucgaccugugcgaggggacaaccgucgugguggaugaacacugcggaaacaggggccccucuuuacgcacgacuaccgucacagguaaaaucauucaugagugguguugccgguccuguacccucccuccacugagauuuaggggggaggacggaugcugguacggcauggaaauccgccccguuaaggagaaagaagagaaucuugugcgaaguaugguaagcgccgguucuggcgaaguggauuccuucucacuggggauuuugugugucaguaucaugauagaggaggugaugcggagccguuggucgagaaagaugcucaugacuggaacacuggcuguuuuucuacugcucauuaugggccagcugaccuggaacgaccuuaucagguugugcaucauggugggggccaaugcauccgaccgcaugggaaugggcacaacuuaccuggcuuuaauggccaccuucaagaugcggccuauguuugcagucggucuccuguucagaaggcuuacgucucgagaagugcugcuacucacaauugggcugagcuugguugccucaguggagcugccaaacaguuuagaagagcucggagauggccuggcuaugggcaucaugaugcuuaaacuguugaccgaauuucaaccccaccagcucuggacuacccugcuaucccugacauucgucaagacuacccuuucucucgacuaugcguggaaaacgacagccaugguacugagcauuguguccuuguuuccgcuguguuuaucaaccacuagccagaagacaaccuggcucccuguucugcuugggaguuucggaugcaaaccacugacuauguuuuugauaacagagaacaagaucuggggucgcaagucuuggccccucaaugagggcauuauggcaaucgggauuguguccauccugcuaagcucgcugcuuaaaaacgaugucccucucgcuggaccccugauagccggcgguauguugaucgccuguuacgugauuucagggucuagugcugacuuaucccuggaaaaggcagccgagguaagcugggaacaggaggcggaacauucuggagcuagccacaauauccucguggagguccaagaugacggcaccaugaaaauuaaggaugaggaacgggacgauacgcugacuauccuucugaaagccaccuugcuagcaguuuccggcguguauccaaugucaauaccugccacacuguucgugugguacuucuggcagaagaaaaagcagagaagugggguccucugggacacccccagcccaccggagguggaaagggcuguucuggaugacggaauuuaucguauccuucagcgcgguuuacugggccggucucaaguaggggugggagucuuucaggauggcguguuccauacaauguggcacguuacuagaggugcagugcucauguaccaggggaagagguuggagccuuccugggccucagucaaaaaggaccugaucaguuauggaggcggcuggcgauuucaggggagcuggaacaccggagaggaagugcaaguaauugcggucgagcccgguaaaaauccaaagaacgugcagacgacacccggcacuuucaaaaccccugaaggggagguuggagcuauagcccucgacuuuaagccaggcacauccgguucucccaucgugaaucgggaagagaagauugucgggcuguacggaaacggcgugguuaccacuucgggcaccuacgugagcgcaaucgcccaggcuaaagccucacaagaggggccucuuccggaaauugaggaugaagucuucaagaaacgcaaucugacaaucauggacuugcacccaggauccgguaagacgagaagguaucuacccgcaauagugcgggaggcuaucaaacgaaagcugagaacucucauuuuagccccuacccgcguaguggcgagugaaauggccgaggcacugaagggcaugccaaucagguaccagacaaccgcuguuaaaucugagcauacugggcgugaaauugucgaucuuaugugccacgccacauuuaccaugcggcugcucagccccgugagagugccuaacuauaauaugaucauaauggacgaggcucauuucacggauccggcauccauugccgccaggggauacaucucaacucgcgucggcaugggugaagcugcggcaaucuuuaugacagccacccccccagggucuguagaggcuuucccucagagcaacgccgugauucaggacgaagagcgagauauccccgagagaaguuggaauuccggauaugacuggauaaccgauuuuccaggcaagacuguuugguucgugccuagcauuaaaucuggcaacgacaucgcaaauuguuugcggaagaacgggaaaagggucauucaacugucacgcaagacauucgauaccgaauaccagaagacaaaaaacaaugacugggacuaugugguuacuacggauaucuccgagaugggagccaacuuucgugcugacagagugauagauccccggaggugccucaagccagucauucugaaagacgguccggaacgcgugauccuugcgggcccuaugcccguaaccguggccagugcagcucagcgaagagggcggaucggaaggaaucagaacaaggagggcgaucaauacguuuacaugggucagccacuaaauaacgacgaggaucacgcccauuggacagaagcaaaaaugcuguuggacaauauuaacacucccgaggggaucauuccugccuuauucgaaccagagcgcgaaaagagcgcugccauagauggcgaguauagacugaggggagaggcgcggaagaccuuugucgaacucaugcgucgcggcgaccugcccguguggcuuucguacaaaguggcaucugagggguuccaguauuccgaucgaagauggugcuuugacggagaaaggaauaaccagguccuggaggaaaauauggauguugagaucuggacaaaggagggugaacggaaaaagcuccgcccuagaugguuggacgccaggaccuacagcgacccgcuggcucuacgggaguucaaagaauuugccgcuggccgaagaucagugaguggggaucugauucucgagaucggaaagcuuccacaacaccugacuuuacgcgcacagaacgccuuggacaaucugguaaugcuccacaacucugaacagggcgguaaagcuuauaggcaugccauggaggagcugcccgauacgaucgaaacccuuaugcugcucgcauugauugcggugcugacagggggcgucacuuuauucuuucuauccggaaagggccuggggaagaccagcauaggacuccuuugugugacagccucaagugcucuguuguggauggccagcguugagccucacuggaucgcagcuuccauuauccuggaauucuuucucauggugcugcuuauucccgagccagaccggcagcguaccccucaagauaaucagcucgccuacgucguaaucggucuguuguucaugauacugacuguggcagccaacgagaugggcuuacuagaaacaacgaaaaaggaccuggggaucggacauguugcugcggagaaccaccagcacucuaccaugcucgauguggaccuucaucccgccagcgcauggacucuguaugcugucgccacaaccgugauuaccccaaugaugagacacacaaucgaaaauacuacggccaacauuuccuugaccgcaaucgcuaaucaagccgcgauacugaugggccucgauaaagguuggccuauuucaaagauggacaucggggucccgcugcuugcuuuaggcugcuacucucaggugaacccccugacacucacugccgcaguuuugaugcugguggcccauuacgcuauuaucggaccaggccuacaggcaaaagccaccagggaggcgcagaagcgcacagcugccgggauaaugaagaauccuaccguagauggaaucguggcaauugaccuggaucccgucguuuaugacgccaaauuugaaaagcaacucggccagaucaugcuucugauuuuguguacuagucagauccugcucaugcggacgacaugggcucugugcgagucgauaaccuuagccacugguccacuuaccacacugugggaggggagcccuggaaaauucuggaacacuaccauugcaguguccauggcuaauaucuuccgaggcucuuaccucgccggugcgggccuagccuuuucacugaugaagagcuuggggggaggcagaagggggacaggagcacagggcgaaacgcugggugagaaauggaagcgccaacucaaccagcuuuccaagagugaauucaauaccuauaaacggucugggaucauggaggucgacagaagcgaagcuaaggagggacugaaacguggcgagacuacaaagcacgccgugucaagggguaccgcaaaauugcggugguuuguagaacgcaaccuggugaagcccgagggcaagguuauugaucucggguguggacgaggcgggugguccuacuauugcgcuggauuaaaaaaggugacugaagucaaaggcuacacaaagggugggccgggacaugaggaaccaaucccuauggccaccuauggcuggaaucuggugaaacuucacaguggcaaggacgucuucuuuaugcccccagagaaaugugauacgcugcuaugcgacauaggggagagcucucccaacccuaccauugaagagggaagaacacucagggugcugaagaugguugaaccgugguugcgggguaaucaguucuguaucaagauucugaaccccuacaugccauccguaguggagacucucgagcagaugcaacgcaaacacggcgggaugcuugucagaaauccucugucaaggaacagcacccaugaaauguacugggugucgugcggaacaggcaauaucguuucugccgugaacaugacuagucgaauguuacugaaccgguuuaccauggcgcaccguaagcccacauaugagagagaugucgacuugggugcugggacccgccauguggcaguagaaccugagguggccaaucucgauauaaucggacagaggauugaaaacaucaaaaaugagcaccgguccacuuggcacuacgacgaggauaacccauauaagacgugggcuuaccauggcagcuaugaaguuaaacccucaggcuccgccucuagcauggucaaugggguggugagacugcuaacaaagccuugggacgucauuccaaugguuacccagaucgcaaugacugauaccacacccuucggacaacagcgcguguuuaaggagaaaguagacacgaggaccccgcgagccaagcgggguacuacacagauuauggaagugaccgcuaaauggcuuuggggcuuccugaguagaaacaagaaaccuaggaucuguacucgcgaggaauuuacacguaagguccgguccaaugcggccauaggggcaguguucguugacgagaaccaguggaauagcgcuaaggaggccguggaagaugagagauuuugggaccucguccacagggaacgcgagcugcauaaacaaggaaagugcgcaaccugcguguacaacaugaugggcaaacgagaaaagaaauugggugaguucgggaaggccaagggaucucgggcuauuugguauauguggcugggcgccagauuccucgaguuugaagcgcuuggcuucaugaaugaggaucacugguuuucaagggaaaacagucuguccgggguagagggagaggguuuacauaaacugggcuacaucuugcgcgacaucagcaagauuccagggggaaauauguacgcagaugacacagccggcugggauacuagaauaaccgaagacgaucuccagaacgaggcuaaaaucacggacauuauggaacccgagcacgcccugcuagcaaccucuaucuucaagcuuacauaucagaauaaaguugugcggguccagaggccugcuaagaacgguacugugauggaugugauuucgcgucgagaccaacgcgggucaggacaggucggcaccuacggccugaacacauuuacuaauauggaaguucagcucaucagacagauggagagcgaggggauauuccugccauccgaauuggagacccccaacuuagccgaacgggcucuggauuggcucgagaaacacggagccgaaaggcuuaagcgcauggcaaucaguggugacgacugugugguaaagccgauugaugacagauuugcgacggcccugacagcucuaaaugauaugggcaaagugcggaaggacaucccucaaugggagcccucuaaaggguggaacgauuggcagcaggucccauucugcagccaucacuuucaucagcugauuaugaaggacggaagggagaucgugguuccuugucgaaaucaagaugaacucgugggccgugccagagucucccagggugcaggguggucauugcgcgagaccgcuugccugggaaaaaguuaugcccagauguggcaacuuauguacuuccaccggagggaccugagacucgcagccaacgcgauauguucugcugugcccguagauuggguuccagccagccgcacuacaugguccauucacgcacaucaccaguggaugaccacugaagacauguuaucaguguggaaucgggucuggaucgaggaaaaccccuggauggaggauaagacccaugugagcucuugggaggaaguuccuuaucugggcaagagggaggaccaguggugcggcuccuugaucgggcugacagcccgagcuacgugggccaccaauauucagguggcaauaaaccaagucagacggcucaucggaaaugaaaacuaccuugacuauaugacuaguaugaaaagguuuaagaaugagagcgauccagagggugcucugugguga

SEQ ID NO: 14141 - RNA, 9879 nt, Artificial Sequence
  derived and/or modified CDS sequence (opt3) from DENV-1__KC692513__SS-prME
agcgugaccaugcugcucaugcuucugcccacugccuuggcuuuccacuuaacuacgagaggcggggagccucauaugaucgucuccaagcaggaaagaggaaaaucucugcuguuuaagaccucaguuggugugaacaugugcacacucauugcaauggaccugggcgagcuuugugaagauacuaugaccuacaaaugcccacggauuacagaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaggaacaagaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagaaaagagcuggcugguacauaaacagugguuucuugaccugccguugcccuggacgucuggcgccuccaccccucaagagacuuggaauaggcaggaucuccugguuacauucaagaccgcacacgcuaagaaacaggaaguggucguguuagguucacaagagggggccaugcacacagcucugacuggcgccaccgaaauccagacgagcggaaccacaacuauuuuugcaggccaucuaaagugccggcucaaaauggacaagcugacccuuaaagggaugaguuaugucauguguacaggaucuuucaaguuggagaaggaaguggccgagacucagcacgguaccguucuggugcagguaaaauacgagggcacggaugcuccaugcaagauacccuuccucacacaagacgaaaaaggggucacccagaacggacgucugaucacugcgaauccuauugugacagauaaggagaaaccaguuaacaucgaaaccgagcccccguuuggcgaguccuauauaguggucggugcaggggaaaaggcccuuaagcugagcugguucaaaaagggcucgucuauuggaaaaauguuugaggcuacugcccgcggcgcaagaaggauggccaucuugggggacaccgcuugggauuucggauccaucgguggccucuuuacaucaguggggaagcugauucaucagguauucggaacggccuacggcguguuauuuagugguguuagcuggaccaugaaaaucgggauuggcauacugcuaacuuggcucggacuaaauucccggucuacaagccuuucaaugaccuguaucgcagucggcauggugacauuguaccugggggugaugguccaggcggacaguggaugcguuauuaacuggaagggccgagaacucaagugugguuccgggaucuucgugacuaacgaggugcacaccuggacggaacaauauaaauuucaggcugauagcccuaagcgccugucugccgcaaucggaaaagccugggaggagggcguaugcgguauuagaucagcuacaagguuagaaaauauaauguggaagcagaucaguaacgagcugaauuacauucuuuuggaaaacgacaugaaauucaccgucgugguuggcgacaucaaugggauucucgcccagggaaagaaaaugauccggccccaaccaauggagcauaaguauagcuggaaguccuggggcaaagcaaagauaaucggggcugauauucagaacacuaccuuuaucauugacggaccugauacacccgaauguccagacgaucagcgcgccuggaauaucugggagguggaggacuacggcuucgguauauuuacuaccaacauuuggcugaaacuaagagauucucacacacagaugugcgaccacaggcugaugucggcggccaucaaggauagcaaagcuguccaugcagacaugggguauuggauugaauccgagaagaaugaaacguggaagcucgcccgugcuucauucaucgaggugaaaaccuguauauggcccaagagucacacucuguggucuaacggaguucuugaaagcgagauggugaucccuaaaauuuacggcgguccaaucucccaacauaauuaucggccgggcuacuucacacagaccgccgggcccuggcacuugggaaagcuggaguuagauuuugaccucugcgaaggcacuacaguagucguggaugagcacugcggguaccgaggaccuucacugagaaccacgacugugaccggcaaaauuauccaugaaugguguugcaggagcuguacacuuccaccccugcgcuuccggggugaggacgggugcugguauggaauggagauaagaccugucaaggaaaaggaggaaaacuugguuaggucuaugguguccgcaggcaguggugagguagacagcuuuucucucggcauucuguguguguccauccuaaucgaagaggucaugcgcucacgauggagucggaaaaugcugaugaccgggacucucgcgguguuccugcuuuugauuaugggacagcugacauggaaugauuuaauccgucucugcauuaugguuggcgccaacgcuagcgacagaauggggaugggaaccacauaccuggcccuuauggcaacuuuuaagaugaggccaauguucgcugugggccugcuauuucgccggcucaccucgagagagguccuguugcugacgguggguuuaucccucguugccucuguggaacugcccaauagccuugaggaacugggggauggauuggcaaugggcauaaugaugcucaaacugcuaacagacuuccaaccgcaccagcuguggaccacucuucucucacugaccuuuaucaggacaaguuugucccuggauuaugccuggaagacuauggcuauggcguuaucuauugucagccucuucccucugugucuuuccaccacgucacagaaaacaaccuggcugccaguauugcucggcagcuuugggugcaagccccugacuauguuccuaaucacagagaacaagauuuggggacgaaaaaguuggccuaucaacgaagguauaauggccgugggcaucguuucuauucugcuuuccagccuccugaagaaugacgugcccuuggcagggccauuaaucgcuggaggcaugcugauugccuguuacgucaucucggguucaucugccgaucucagucuggagaaagcugcagagguguccugggaagaggaagccgagcauagcgggaccucucacaacauacuuguagaagugcaggacgauggaacuaugaagauuaaagacgaggagcgcgaugacacacugaccaucuugcuaaaggcgacgcugcucgcugucagcggcguuuauccuauguccauccccgccacucuguuugugugguacuucuggcagaaaaagaagcagcggucaggcgugcuuugggauaccccaaguccgccugaagucgagagagcaguguuagacgacgggauuuauaggauacugcagcguggacucuugggucgcagccagguuggcguagggguguuccaagauggagucuuucauacaauguggcacgugacccggggcgccguucugauguaccaggguaaaagacucgaacccucuugggcuuccgugaagaaagaccugaucucauacgggggaggcuggagguuccagggcaguuggaauacaggggaggagguccaggugauugcaguagaaccaggaaagaaccccaaaaauguccaaacuaccccugguacguuuaagacaccagagggcgaagugggggccaucgcgcuugauuucaagcccggaacuagcggcuccccuauuguuaaccgagaggguaaaaucguggggcuguauggaaauggcgucgugaccacaucuggcaccuacguuucggcuauagcccaggcaaaggccacucaggaagggccguugccagagaucgaggacgaaguguuuaaaaagcggaaccuaaccauuauggaucugcaccccggaagcgguaaaacacgcagauaucucccugcuaucgucagggaggccauuaagcggaaguuacgaacgcugauccuugcaccaacuagagugguagcuucagaaauggccgaggcgcugaaaggcaugcccauacgcuaccaaaccacagccgugaaguccgaacauaccgggagggagauuguugaccucaugugccacgcaacuuucacaaugcguuugcugaguccuguccgggugccgaauuauaacaugaucaucauggaugaggcucauuuuaccgaccccgccucuauugcugcaagaggauacaucagcacgagggugggcaugggugaagccgccgcuauauucaugacugcgacaccaccuggguccgucgaggcauuuccccagucaaaugccguaauucaggaugaggaacgcgacaucccagaacgaucuuggaacagcggauaugauuggauuaccgacuucccuggcaaaaccgugugguuuguucccaguaucaaguccggcaaugacauagcuaacugucucaggaaaaaugggaagcgggugauucagcugagcaggaagacuuucgauacagaguaccagaaaaccaagaacaacgacugggauuacgucgugacaacugacaucucugagaugggagccaauuuccgcgcagaucguguuaucgacccaagacggugccuuaaaccggugauucuaaaggaagguccugagagggucauccuggccggccccaugccagugacgguagcuucagcggcccagcgccgagggagaauuggacggaaccagaauaaagaaggcgaucaguauauauacaugggucaacccuugaacaaugacgaggaucacgcacauuggaccgaggcuaagauguuacuggacaacaucaauacaccugaagggauuaucccagcccucuuugagcccgaaagggagaaguccgcagccaucgauggcgaauaucgccugagaggagaggcuaggaaaacuuucguggagcuuaugcggcguggcgaccugccuguuuggcucaguuacaaggucgccagcgaaggguuucaguauucggaucgccgauggugcuucgacggagagagaaacaaucagguguuggaagagaacauggacguggaaauuuggaccaaagagggugagaggaagaaacugcggccgcgcuggcuagaugcgagaacauacucugacccacuggcacucagggaauuuaaggaguucgccgcuggccggcgauccgucagcggggaucuuauacuggaaaucggaaaauuaccccagcacuugacccugagagcccaaaaugcucucgacaaccugguuaugcuucacaauucagagcagggcgguaaggcauaucgccaugccauggaggaacugccugauacuauugagacgcucauguugcuggcuuuaaucgccgugcuaaccgggggcguaacacuguuuuuccucaguggaaagggccuugggaaaacuucuauuggacuguugugugugauggcauccagcgcgcugcucuggauggccucagucgaaccccacuggaucgcugccaguauaauccuggaguuuuuccuuauggugcuccugauuccagaaccugacaggcagcggacaccccaagauaaccaauuggcauacguugugaucggucuguuauuuaugauucuaaccgucgcugccaaugagaugggccugcucgagaccacuaagaaagaccuugggaucggacauguagcaguggaaaaccaccaccaugccacaaugcuggauguugacuugcguccagcuagcgcguggacgcuguacgccguggcaaccacugucauaacaccuaugaugagacacaccauugagaacaccacagcuaauaucucccucacugccauugccaaccaggcagcuauccugaugggccuugauaaggguuggccgauaucuaaaauggacaucggggugcccuuacuggcccucggcugcuauagccaggucaauccauugacgcugaccgcggcugugcuaaugcugguugcccauuacgcaauuaucggaccuggccuccaagccaaggcuacaagggaagcacagaagcgcacugccgcggggauuaugaaaaaccccaccguggauggaaucguaacaauagaccuugacccaguggucuaugaugcuaaguucgagaaacagcugggccagauuauguugcugauccucuguaccucccaaauccuguuaaugcggacuacgugggcccuuugcgaaucaauuacacuggcaaccgguccucucacuacccuaugggaggggucucccggaaaguuuuggaauacaacuaucgccguuaguauggcuaacauauuccgaggcucguaccuggccggugcaggcuuggcuuucagccugaugaaaucccucgggggaggcagaagggggaccggagcccagggcgagacacuuggugaaaaguggaagcgccagcugaaucaguugucuaaaucagaguuuaacacguauaagaaaagcgggauuauggaaguggaccgguccgaggcgaaggaaggacugaaaagaggcgagaccacuaagcacgccgucagucgugguacagcaaagcucaggugguucguggagcggaauuuaguaaaaccggaaggcaaggugaucgaucugggguguggacgcggcggguggucuuacuauugcgcuggacuuaaaaagguuaccgaggugaaaggcuacacuaagggugggccaggacaugaggagccuauucccauggccacauacggcuggaaccuggucaaacuacacagcggcaaggacguguuuuucaccccacccgaaaagugugauacgcuccugugcgacaucggggagucauccccuaauccgaccauagaggaaggacgaacauugagaguccugaaaaugguggagcccuggcucagggguaaccaauuuuguaucaagauucuuaauccauauaugccuaguguuguagaaacucuggagcagaugcagcggaaacacggcgggauguuagugcgcaacccccugagcagaaauucuacccaugagauguacugggucuccugcggaacaggcaacaucgugucagcaguuaauaugacuagcaggauguugcucaaccgauucaccauggcucaccggaagccuacauaugaacgugauguggaccugggugccgggaccagacaugucgccguggagccagaaguagcgaaccuagauauuaucggacagcgcauugagaauaucaaaaacgaacacaagucgacuuggcacuacgacgaggauaaucccuauaagacgugggcuuaccauggcucuuaugaggugaaaccuaguggcuccgcaagcucaaugguuaacggggucgugaggcuucugacaaagccaugggacgugauacccauggucacccaaauugccaugacugacaccacaccguuuggacagcagcggguuuucaaagaaaagguggauacgagaaccccucgcgcuaaaagggguacugcccaaaucauggagguaacagcaaaguggcucuggggcuuucugucccgaaauaagaaaccacggaucuguaccagagaagaguucacuaggaaggugcgcucuaacgccgcuauuggggcggucuuuguggacgaaaaucaguggaacagcgccaaagaggcaguugaggaugaacguuucugggacuuggugcaccgggagagagaacugcauaagcagggaaaaugcgcuacaugcgucuacaauaugaugggcaagagggagaagaaacucggugaauuugggaaggccaaaggaagucgcgcaauaugguacauguggcuuggcgcccgauuccuggaguucgaggcuuuaggcuuuaugaacgaagaucacugguucucccgggagaauagccugucugggguggaaggagaggguuugcauaagcucggcuauauccugagagacauuucaaaaauccccgggggaaacauguacgccgaugacaccgcgggcugggauacaaggauuacugaggacgaucuacagaaugaagcaaagaucaccgacauaauggagccugaacacgcccuucuggcuacgaguaucuuuaaacucaccuaucaaaacaagguaguucgcgugcagagaccagccaaguccgguacagucauggaugugauuagccggagggaccagcgugggucuggacaggugggcacuuacggccugaauaccuucacaaacauggagguccaauugauccgacagauggaaucggaggggauauuuucacccagcgaguuagaaacuccgaaccuggccaaaaagguucucgacuggcuugagaaacacggagcugaacgccugaagagaauggccaucuccggugaugacugugugguaaaaccuauagaugaccgguucgcuaccgcccuaacggcacugaaugauaugggcaaggugaggaaggacauuccccagugggagccaaguaaaggguggaacgauuggcagcaagucccuuuuugcucucaucacuuccaucagcucaucaugaaggacggacgcgaaaucgugguucccuguagaaaucaggaugaguuggugggccgggcgagggucagccagggugccggguggucccugcgagagacagcuugccuuggaaaaucauaugcccaaauguggcagcugauguacuuucaccguagagaccuccgcuuagcagcuaacgccauuuguagugcagugccaguagauuggguucccaccucucggacuacauggagcauacacgcccaucaccaguggaugaccacugaagacaugcuguccguguggaauagggucuggaucgaggaaaacccuuggauggaggacaagacccaugugucaagcugggaagagguuccauauuugggcaaaagagaggaucaauggugcggcucucugauugggcucacagcgcgcgcuacgugggccaccaauauccagguggcaauuaaccagguccggaggcuuaucggauccgaaaauuaccuggacuacaugacaaguaugaagcgauucaagaacgagagcgauccggaaggugcccuaugguga

SEQ ID NO: 14142 - RNA, 9879 nt, Artificial Sequence
  derived and/or modified CDS sequence (opt3) from DENV-1__KC692514__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaggcagauccagcggguggagacuugggcucugcgccacccuggauucaccguuauugcauuuuuccuggcccaugcuaucggcacaucgauuacccagaaaggcaucauauuuauccucuuaaugcuggugacgccaucaauggccaugagaugcgucgggauuggaaacagggacuucguggagggucuuagcggcgcgacuuggguagauguuguguuggaacacgggaguugugucacaaccauggcaaagaauaagcccacucuggacaucgagcuacucaaaacagaagugaccaacccugccgugcugcggaagcuuugcauugaggcuaaaaucuccaauacgaccacagauucucgcuguccaacucaaggagaagccacccuggucgaggagcaggacgcaaacuuuguuugccgaagaacauucguggauaggggcugggguaauggguguggauuguuuggcaagggcagccuccugacuugcgcuaaauucaagugcguaaccaaguuagaagggaaaauagugcaguacgagaaccugaaguauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccacggacuggauuggacuuuaacgagaugguccuacugacaaugaaagagaagagcuggcucgugcauaaacagugguuccuggaucuuccgcugcccuggacgucuggcgcauccaccucacaagaaacuuggaaucgucaggacuugcucguaacauuuaagaccgcucacgccaaaaagcaggagguugugguccuggguagccaagaaggggcuaugcacacagccuuaacuggcgcaaccgagauccagacgaguggaaccacaacuauuuucgccggccaucugaagugccgccuaaaaauggauaagcucacccugaaagggaugucuuaugugauguguacaggauccuucaagcuugaaaaagaggucgcugagacucagcacgguaccguguugguucaggugaaguacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggaaaaaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugaaaaaaaugagacguggaagcuggccagagcaucuuucauugaagugaaaaccuguacuuggccaaagagccacacacuaugguccaacggcguacuggagucagagaugaucauucccaagaucuuugguggcccuauaagccaacauaauuacaggccaggguauuucacccagacugcgggaccguggcaccucggcaaacuggaacuugauuuugacuugugcgaggggacaaccgucgugguggaugaacacugcggaaaccgcggccccucucugcggacgacuaccgucacagguaagaucauucaugagugguguugcagauccuguaccuuaccuccacucagguuccgcggggaggacggaugcugguacggcauggaaauccgacccguuaaagagaaggaagagaaucuggugcggaguaugguaagcgccgguucuggcgaaguggauuccuuuucacuugggauucugugugucaguaucaugauagaggaggugaugcguagcagauggucgaggaaaauguugaugacuggaacacucgcuguuuuccugcuacugauuaugggccagcucaccuggaacgaccugauccgccuuugcaucauggugggggccaaugcauccgaccggaugggaaugggcacaacuuacuuggcucugauggccaccuuuaagaugagaccuauguucgcagucgguuuacucuuuaggcgacugacgucucgcgaagugcuucugcuaacaauugggcucagccugguugccucaguggaguugccaaacagucuggaagaguuaggagauggccucgcuaugggcaucaugaugcugaagcuucugaccgaauuccaaccccaccaguuguggacuacccuccugucccuaacauuugucaaaacuacccugucucuugacuaugcguggaagacgacagccaugguacucagcauugugucccuguucccguugugucugucaaccacuagccagaaaacaaccugguuaccuguucuccuggggaguuuuggaugcaagccacuuacuauguuccugauaacagagaacaaaaucuggggucggaagucuuggcccuugaaugagggcauuauggcaaucgggauuguguccauccuccugagcucgcuacugaagaacgaugucccucuugcuggaccccucauagccggcgguaugcugaucgccuguuacgugauuucagggucuagugcugacuuguccuuagaaaaagcagccgagguaagcugggaacaggaggcggaacauucuggagcuagccacaauauccugguggagguccaagaugacggcaccaugaagauuaaagaugaggaaagagacgauacgcucacuauccugcuuaaggccacccuguuggcaguuuccggcguguauccaaugucaauaccugccacacuauucgugugguacuuuuggcagaaaaagaaacagaggagugggguccugugggacacccccagcccaccggagguggaacgugcuguucucgaugacggaauuuaucgcauccugcagcggggucuuuuaggcagaucucaaguaggggugggagucuuccaggauggcguguuucauacaauguggcacguuacuaggggugcagugcugauguaccaggggaagcgacucgagccuuccugggccucagucaagaaagacuugaucaguuauggaggcggcuggcgguuccaggggagcuggaacaccggagaggaagugcaaguaauugcggucgagcccgguaagaauccaaaaaacgugcagacgacacccggcacuuuuaagaccccugaaggggagguuggagcuauagcccuggacuucaaaccaggcacauccgguucucccaucgugaaucgcgaagggaagauugucggacucuacggcaacggcgugguuaccacuucggggaccuacgugagcgcaaucgcccaggcuaagacaucacaagagggaccucugccggagauugaagaugaggucuuuaaaaagagaaaucuuacgaucauggaccugcacccagguuccggcaaaacuaggcgguauuugcccgccauagugcgagaagcaaucaagagaaaacuacgcacccugauucucgcuccuacaaggguaguggccagugagauggcggaagccuuaaaggggaugccaauccguuaccagaccacugcaguuaagucugagcauacaggacgggagauugucgaucugaugugccacgcuaccuucacgaugagacuucugagccccgugagggugccuaacuauaauaugaucauaauggacgaagcccauuuuacugauccggcuuccauugcagcccgcggcuacaucucaacacgagucgguaugggggaggccgcugcgaucuucaugaccgcaacccccccaggaucuguagaagccuuuccucagagcaacgcugugauucaggacgaggaaagagauauccccgagcggaguuggaauuccggcuaugacuggauaacugauuucccaggcaaaacaguuugguucgugccuagcauuaagucugggaacgacaucgccaauugucucaggaaaaacggaaagcgcgucauucaauugucacguaaaaccuuugauacagaguaccagaagacuaagaacaaugacugggacuaugugguuacgaccgauaucuccgaaaugggugcaaacuucagagccgaccgggugauagaucccaggcgcugccugaaaccagucauucucaaggacggcccggagcgagugauccuggcugggccuaugcccguaacaguggcgagugccgcacagagacggggaaggaucggccgcaaucagaacaaagaaggugaucaauacguuuacauggggcagccacuuaauaacgacgaggaucacgcucauuggacugaggccaagaugcuacuggacaauauuaacacccccgaaggcaucauuccugcauuguuugagccagaaagagagaaaagcgccgcuauagauggagaauauagguuacggggcgaggcccguaagacauucgucgagcugaugcgccgaggggaccuccccguguggcugucguacaagguggcgucugaaggauuucaguauuccgauagaagguggugcuucgacggugagcggaauaaccagguccuugaagagaauauggauguugaaaucuggaccaaagagggcgagcgcaagaaacugagaccuagguggcucgacgcacggacuuacagcgacccguuggcccugcgagaauuuaaggaguucgcugccgggagacgcucagugaguggagaucuaauucuggaaaucggcaaacucccacaacaccuuacgcugagggcucagaacgcauuagacaauuugguaaugcugcacaacucugagcagggugggaaggccuaucggcaugcuauggaagagcuccccgauaccaucgagacacugaugcuucuggcccucauugcaguguugacuggcggagucacccuguuuuucuuauccggcaaagggcuaggaaagacaagcauaggucugcucugugugaccgcgucaagugcccuucuguggauggcuagcguugaaccucacuggaucgccgcauccauuaucuuggaguuuuuccugauggugcuccugauucccgaaccagaccgucagagaacuccucaagauaaucagcuugcuuacgucguaaucggccuccuguuuaugauauugacaguggccgcaaacgagauggggcuguuagagacgaccaagaaagaccuaggaaucggcuauguugccgcugaaaaccaucagcacgcgacuaugcuggauguggaccuccaccccgccucugcauggacacuuuacgcugucgccaccaccgugauuacaccaaugaugaggcauacuaucgagaauacgaccgccaacauuagccugacagcaaucgcuaaucaagccgcgauauugaugggucuggauaagggguggccuauuuccaaaauggacaucggcgucccgcuccuggcucuuggaugcuacucacaggugaaccccuuaacucugaccgccgcaguucucauguugguggcccacuaugcuauuaucggcccagggcugcaggcaaaggccacacgcgaagcgcagaaacggaccgcugccggaauaaugaagaauccuacuguagauggcaucguggcaauugaccuagaucccgucguuuacgacgccaaguucgagaaacaacugggucagaucaugcuccuuauucuguguacgucucagaucuugcugaugcgaacaaccugggcucucugcgaaaguauaacucuggccaccgggccauuaacaacucuuugggagggaucgccuggcaaguucuggaacaccacaauugcagugagcauggcuaauaucuuuagagguuccuaucuggccggcgcggggcucgccuucucucuaaugaaaucacugggaggcgggaggcgcggaacgggcgcacagggugagaccuugggggaaaaguggaaacggcaacugaaccagcucagcaaguccgaguuuaauacuuacaagagaaguggaaucauggaagucgaccguucugaggcuaaagaaggccuuaagaggggugagacaaccaaacaugccgugagccggggcacugcaaagcugcgcugguucguagagcgaaacuuggugaaacccgaagggaagguuauugaucugggauguggcagagggggauggucauauuacugcgcuggccucaagaaagugacagaggucaaggguuauaccaaagggggaccgggccacgaagagccaaucccuauggccacguacggcuggaauuuagugaagcugcauuccgggaaagacgucuuuuucaugcccccagaaaagugugauacccuucugugcgacauaggagagaguagccccaacccuacaauugaggaagguaggacucuacgggugcucaaaaugguugagccguggcugcgcggcaaucaguuuuguaucaagauuuugaaccccuacaugccaucuguaguggaaacccuggagcagaugcaaagaaagcacgggggaaugcucgucaggaauccucuuucccgaaacucaacacacgagauguauugggugagcugcggcacugguaauaucguuucggccgugaacaugaccucucggaugcuguuaaaccguuucacaauggcgcauagaaaacccaccuacgaacgcgaugucgaccugggggcuggaacuaggcacguggcaguagagccugaaguggccaauuuggauauaaucggccagcggauugagaacaucaagaaugaacauaaaaguacguggcacuaugacgaggauaacccauacaagacaugggcuuaucacggcuccuacgagguuaaacccagcgggucagccuccucuauggucaauggaguggugagacuccugaccaagccuugggacgucauuccaaugguuacucagaucgcaaugaccgauacaacgcccuuuggucaacagcgcguguucaaggaaaaaguagacaccaggacuccgcgagccaagcggggcacaacccagauuauggaggugacugcuaaauggcuauggggguuucuuagcagaaacaagaaaccuaggaucuguacacgcgaagaguucacccguaagguccggaguaaugcggccauaggagcaguguuuguugacgaaaaccaguggaauuccgcuaaggaggccguggaggaugaaagauucugggaccugguccauagggagcgcgaacuccacaaacaaggcaagugcgcaacaugcguguauaacaugauggguaaacgagagaagaaacugggggaauucggaaaggccaagggcagccgggcuauuugguacaugugguugggcgccagauuucuggaguucgaggcgcucggguuuaugaaugaagaucauugguucucuagggagaacucacuuaguggaguagaaggugagggccugcacaaauuaggguacauccugcgcgacaucuccaagauuccaggaggcaauauguaugcagaugacacugccgguugggauaccagaauaacggaggacgauuugcagaacgaagcuaaaaucaccgacauuauggagcccgaacaugcccuccuggcaacaagcaucuuuaagcuaacuuaccagaauaaaguugugcggguccagaggccugcuaagaacgggaccgugauggaugugauuucucgucgagaccaacgcggaucgggccaggucggcacauaugggcuuaacacuuucaccaauauggagguucagcugaucagacagauggaaucagagggaauauuucucccaagcgagcuggaaacgcccaacuuggccgagcgggcuuuagauuggcuggaaaaacacggugccgagaggcucaagcgcauggcaaucuccggcgacgacugugugguaaagccgauugaugacagauucgcgacagcccuuaccgcucugaaugauauggggaaagugcggaaggacaucccucaaugggaacccaguaaaggauggaacgauuggcagcaggucccauuuugcucucaccauuuccaccagcuaauuaugaaggacggcagggagaucgugguuccuugucgaaaucaagaugagcuggugggucgugccagagucagccagggggcaggauggucccuccgcgaaacugcuugcuugggcaaaucauacgcccagauguggcaacugauguauuuucaucggagggaccuuagacuggcagccaacgcgauauguagugcugugcccguagauuggguuccagccucucgcacaaccuggagcauucacgcacaccaucaguggaugacuaccgaggacaugcucuccguguggaaucgggucuggaucgaagagaaccccuggauggaagauaagacacacgugucaagcugggaggagguuccuuacuuaggcaagagggaagaccaguggugcgggucucugaucggauugacggcccgagcuaccugggccacuaauauucagguggcaauaaaccaagucagacggcugaucgguaaugagaacuaucucgacuacaugacauccaugaaaagguucaagaaugaaagugauccagagggcgcucuuugguga

SEQ ID NO: 14143 - RNA, 9879 nt, Artificial Sequence
  derived and/or modified CDS sequence (opt3) from DENV-1__KC692515__SS-prME
agcgugaccaugcugcucaugcuucugcccacugccuuggcuuuccacuuaacuacgaggggaggggagccucauaugaucgucuccaagcaggaaaggggaaagucucuguuauuuaagaccucagccgguguuaacaugugcacucucauugccauggaccugggagagcuuugugaagauacuaugaccuacaagugcccacggauaacagaggcggaaccggacgauguggacuguuggugcaaugcuaccgauacuuggguaaccuaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagacuuuguggaggguuugagcggcgcgacuuggguagauguugugcuggaacacgggaguugugucacaaccauggcaaagaauaaacccacucuagacaucgagcuccugaagacagaagugaccaacccugccgugcuuaggaaacugugcauugaggcuaagaucuccaauacgaccacagauucucgguguccaacucaaggagaagccaccuuggucgaggagcaggacgcaaacuucguuugccgccgaacauuuguggauagaggcugggguaauggguguggacucuucggcaaaggcagccuguuaacuugcgcuaaguuuaagugcguaaccaaacuggaagggaagauagugcaguacgagaaccucaaauauuccgucauugugacaguucacaccggagaccagcaucaaguggguaaugaaacuacggagcacggcacaaucgccaccauuacuccccaggcgccuaccucagaaauccagcuuacagauuacggggcccugaccuuggacuguaguccaaggacuggacuagacuucaacgagaugguccugcucacaaugaaggagaaaagcuggcuggugcauaagcagugguuucuugaucugccguugcccuggacgucuggcgcauccaccucacaagaaacuuggaaucggcaggaccuccugguaacauucaaaaccgcucacgccaagaagcaggagguuguggucuuagguagccaagaaggggcuaugcacacagcccugacuggcgcaaccgagauccagacgaguggaaccacaacuauuuuugccggccaucuaaaaugccgucucaagauggauaaacugacccuuaaggggaugucuuaugugauguguacaggauccuucaaauuggaaaaggaggucgcugagacucagcacgguaccgugcugguucaggugaaguacgaaggcacggacgcgccuugcaaaauaccauucagcacacaagaugagaaggggguaacccagaacggacgccucaucacugcaaaucccauugucacagacaaagaaaagccugugaacaucgagaccgagccacccuuuggcgaaucguauauaguugugggugccgggggcaaagcucugaaacuuucuugguucaagagaggauccucaauuggcaaaauguuugaggccacugcaagaggggcacggcgaauggcuauccugggagauaccgccugggacuucgguaguaucggcggggucuuuacaagcgugggaaaguugguacaucagguguucggcacggcauacgguguucucuuuuccggggucucuuggaccaugaaaauuggcaucggcauucuguuaacuuggcugggccuaaauagccgcucaacaagucucuccaugaccuguauagcgguggggauggugacacuguaccuuggagucaugguucaggcugauagcggcugcgugaucaacuggaaggguagagaauugaaaugugggucuggaauuuucgugacuaacgagguacacaccuggacggaacaauauaaguuucaggccgacucaccgaagaggcugagugcagccaucggcaaggcuugggaggagggugucugcggcauccggagcgccacacgccucgaaaauauuauguggaagcagauauccaacgagcugaaucauaucuuacuggaaaacgauaugaaauucaccgugguugugggggacgcaaauggcauucuugcucagggcaagaaaaugaucagaccucaacccauggagcacaaguacucuuggaaaucgugggggaaggccaagauuaucggagcggacauacagaacacuaccuuuaucauugauggcccagacacaccugaaugucccgauggucagagggccuggaauaucugggaggucgaggacuauggguucggaguguuuacuaccaacauuugguugaaacuccgugauagcuacacacagaugugcgaccaccggcugauguccgcugcaaucaaggauucaaaagccguucaugcugacaugggcuauuggauagaaagugagaagaaugaaacguggaaacuagcccgagcaucuuucauugaggugaagaccuguacuuggccaaagagccacacacugugguccaacgguguacucgaaucagagaugaucauucccaaaaucuucggcgggccuauaagccaacauaauuacagaccaggauauuuuacccagacugcgggcccguggcaccuggggaaacuugaguuggauuucgaccugugcgaaggaacaaccgucgugguggaugagcacugcggcaacaggggucccucuuuacgcacgacuaccgucacagggaaaaucauucaugaaugguguugccgguccuguacccucccuccacugagauuuaggggagaggacggcugcugguacgguauggagauccgccccguuaaggaaaaagaggaaaaucuugugcgaaguaugguaagcgccggcucuggggagguggauuccuucucacugggaauuuugugugucaguaucaugauagaagaggugaugcggagccguuggucgagaaagaugcucaugacuggcacacuggcuguuuuucuacugcucauuauggggcagcugaccuggaacgaccuuaucagguugugcaucauggugggagccaaugcauccgaccgcaugggcauggguacaacuuaccuggcuuuaauggccaccuucaagaugcggccuauguuugcagucgggcuccuguucagaaggcuuacgucucgagaggugcugcuacucacaauuggacugagcuugguugccucaguggaacugccaaacaguuuagaggaacucggcgauggccuggcuauggggaucaugaugcuuaaacuguugaccgaguuucaaccccaccagcucuggacuacccugcuaucccugacauucgucaagacuacccuuucucucgacuaugcguggaaaacgacagccaugguacugagcauuguguccuuguuuccgcuguguuuaucaaccacuagccagaagacaaccuggcucccuguucugcuuggaaguuucgguugcaaaccacugacuauguuuuugauaacagaaaacaagaucuggggccgcaagucuuggccccucaaugaggggauuauggcaaucggaauuguguccauccugcuaagcucgcugcuuaaaaacgaugucccucucgcuggcccccugauagccggugggauguugaucgccuguuacgugauuucaggaucuagugcugacuuaucccuggagaaggcagccgaaguaagcugggagcaggaagcggagcauucuggcgcuagccacaauauccucguggaaguccaagaugacggcaccaugaaaauuaaggaugaggagcgggacgauacgcugacuauccuucugaaagccaccuugcuagcaguuuccgggguguauccaaugucaauaccugccacacuguucgugugguacuucuggcagaagaaaaagcagagaaguggaguccucugggacacccccagcccaccggaaguggagagggcuguucuggaugacgguauuuaucguauccuucagcgcggcuuacuggggcggucucaaguaggagugggcgucuuucaggaugguguguuccauacaauguggcacguuacuagaggggcagugcucauguaccagggaaagagguuggaaccuuccugggccucagucaaaaaggaccugaucaguuauggcggcggguggcgauuucagggaagcuggaacaccggugaggaggugcaaguaauugcggucgaacccggcaaaaauccaaagaacgugcagacgacacccgggacuuucaaaaccccugagggagaaguuggcgcuauagcccucgacuuuaagccagguacauccgggucucccaucgugaaucgggaggaaaagauugucggacuguacggcaacggcgugguuaccacuucggggaccuacgugagcgcaaucgcccaggcuaaagccucacaagagggaccucuuccggagauugaagaugaggucuucaagaaacgcaaucugacaaucauggacuugcacccagguuccggcaagacgagaagguaucuacccgcaauagugcgggaagcuaucaaacgaaagcugagaacucucauuuuagccccuacccgcguaguggcgagugagauggccgaagcacugaaggggaugccaaucagguaccagacaaccgcuguuaaaucugagcauacuggacgugagauugucgaucuuaugugccacgccacauuuaccaugcggcugcucagccccgugagagugccuaacuauaauaugaucauaauggacgaagcucauuucacggauccggcauccauugccgccaggggcuacaucucaacucgcgucgguaugggggaggcugcggcaaucuuuaugacagccacacccccaggaucuguagaggcuuucccucagagcaacgccgugauucaggacgaagaacgagauauccccgagagaaguuggaacuccggcuaugacuggauaaccgauuuuccaggcaagacuguuugguucgugccuagcauuaaaucugggaacgacaucgcaaauuguuugcggaagaacggaaaaagggucauucaacugucacgcaagacauucgauaccgaguaccagaagacuaagaauaaugacugggacuaugugguuacuacggauaucuccgaaaugggugccaacuuucgugcugacagagugauagauccccggaggugccucaagccagucauucugaaagacggcccggagcgcgugauccuugcggggccuaugcccguaaccguggccagugcagcucagcgaagaggacggaucggcaggaaucagaacaaggaaggugaucaauacguuuacauggggcagccacuaaauaacgacgaggaucacgcccauuggacagaggcaaaaaugcuguuggacaauauuaacacucccgaaggcaucauuccugccuuauucgagccagaacgcgaaaagagcgcugccauagauggagaauauagacugaggggcgaggcgcggaagaccuuugucgagcucaugcgucgcggggaccugcccguguggcuuucguacaaaguggcaucugaaggauuccaguauuccgaucgaagauggugcuuugacggugagaggaauaaccagguccuggaagagaauauggauguugaaaucuggacaaaggagggcgagcggaaaaagcuccgcccuagaugguuggacgccaggaccuacagcgacccgcuggcucuacgggaguucaaagaguuugccgcugggcgaagaucagugaguggagaucugauucucgaaaucggcaaacuuccacaacaccugacuuuacgcgcacagaacgccuuggacaaucugguaaugcuccacaacucugagcagggugggaaggcuuauaggcaugccauggaagaacugcccgauacgaucgagacccuuaugcugcucgcauugauugcggugcugacaggcggagucacuuuauucuuucuauccggcaaggggcugggaaagaccagcauaggucuccuuugugugacagccucaagugcucuguuguggauggccagcguugaaccucacuggaucgcagcuuccauuauccuggaguucuuucucauggugcugcuuauucccgaaccagaccggcagcguaccccucaagauaaucagcucgccuacgucguaaucggccuguuguucaugauacugacuguggcagccaacgagaugggguuacuagagacaacgaaaaaggaccugggaaucggccauguugcugcggaaaaccaccagcacucuaccaugcucgauguggaccuucaucccgccagcgcauggacucuguaugcugucgccacaaccgugauuaccccaaugaugagacacacaaucgagaauacuacggccaacauuuccuugaccgcaaucgcuaaucaagccgcgauacugaugggucucgauaaaggguggccuauuucaaagauggacaucggcgucccgcugcuugcuuuaggaugcuacucucaggugaacccccugacacucacugccgcaguuuugaugcugguggcccauuacgcuauuaucggcccagggcuacaggcaaaagccaccagggaagcgcagaagcgcacagcugccggaauaaugaagaauccuaccguagauggcaucguggcaauugaccuggaucccgucguuuaugacgccaaauuugagaagcaacucggucagaucaugcuucugauuuuguguacaagucagauccugcucaugcggacgacaugggcucugugcgaaucgauaaccuuagccacugggccacuuaccacacugugggagggaagcccuggcaaauucuggaacacuaccauugcaguguccauggcuaauaucuuccgagguucuuaccucgccggcgcggggcuagccuuuucacugaugaaauccuugggaggcgggagaaggggaacaggcgcacagggugagacgcugggggaaaaauggaagcgccaacucaaccagcuuagcaagagugaguucaauaccuauaaacggucuggaaucauggaagucgacagaagcgaggcuaaggaaggccugaaacguggugagacuacaaagcacgccgugucaaggggcaccgcaaaauugcggugguuuguagagcgcaaccuggugaagcccgaagggaagguuauugaucucggauguggccgagggggaugguccuacuauugcgcuggccuaaagaaggugacugaggucaaagguuacacaaaagggggaccgggccaugaggaaccaaucccuauggccaccuauggcuggaaucuggugaaacuucacagugggaaggacgucuucuuuaugcccccagaaaaaugugauacgcugcuaugcgacauaggagagagcucucccaacccuaccauugaggaagguagaacacucagggugcugaagaugguugagccgugguugcggggcaaucaguucuguaucaagauucugaaccccuacaugccauccguaguggaaacucucgagcagaugcaacgcaaacacgggggaaugcuugucagaaauccucugucaaggaacagcacccaugagauguacugggugucgugcggcacagguaauaucguuucugccgugaacaugacaagucgaauguuacugaaccgguuuaccauggcgcaccguaagcccacauaugaaagagaugucgacuugggggcuggaacccgccauguggcaguagagccugaaguggccaaucucgauauaaucggccagaggauugagaacaucaaaaaugaacaccgguccacuuggcacuacgacgaggauaacccauauaagacgugggcuuaccauggcagcuaugagguuaaacccucaggguccgccucuagcauggucaauggaguggugagacugcuaacaaagccuugggacgucauuccaaugguuacccagaucgcaaugacugauaccacacccuucggucaacagcgcguguuuaaggaaaaaguagacacgaggaccccgcgagccaagcggggcacuacacagauuauggaggugaccgcuaaauggcuuuggggguuccugaguagaaacaagaaaccuaggaucuguacucgcgaagaguuuacacguaagguccgguccaaugcggccauaggagcaguguucguugacgaaaaccaguggaauagcgcuaaggaggccguggaggaugaaagauuuugggaccucguccacagggagcgcgaacugcauaaacaaggcaagugcgcaaccugcguguacaacaugauggguaaacgagagaagaaauugggggaguucggaaaggccaagggcucucgggcuauuugguauauguggcugggcgccagauuccucgaguuugaggcgcuuggguucaugaaugaagaucacugguuuucaagggagaacagucuguccggaguagaaggugagggcuuacauaaacugggguacaucuugcgcgacaucagcaagauuccaggaggcaauauguacgcagaugacacagccgguugggauacuagaauaaccgaggacgaucuccagaacgaagcuaaaaucacggacauuauggagcccgaacacgcccugcuagcaaccucuaucuucaaacuuacauaucagaauaaaguugugcggguccagaggccugcuaagaacgggacugugauggaugugauuucgcgucgagaccaacgcggaucaggccaggucggcaccuacgggcugaacacauuuacuaauauggagguucagcucaucagacagauggaaagcgagggaauauuccugccauccgaguuggaaacccccaacuuagccgagcgggcucuggauuggcucgaaaaacacggugccgagaggcuuaagcgcauggcaaucaguggcgacgacugugugguaaagccgauugaugacagauuugcgacggcccugacagcucuaaaugauauggggaaagugcggaaggacaucccucaaugggaacccucuaaaggauggaacgauuggcagcaggucccauucugcagccaucacuuucaucagcugauuaugaaggacggcagggagaucgugguuccuugucgaaaucaagaugagcucgugggucgugccagagucucccagggggcaggauggucauugcgcgaaaccgcuugccugggcaaaaguuaugcccagauguggcaacuuauguacuuccaccggagggaccugagacucgcagccaacgcgauauguucugcugugcccguagauuggguuccagccagccgcacuacaugguccauucacgcacaucaccaguggaugaccacugaggacauguuaucaguguggaaucgggucuggaucgaagagaaccccuggauggaagauaagacccaugugagcucuugggaggagguuccuuaucugggcaagagggaagaccaguggugcggguccuugaucggacugacagcccgagcuacgugggccaccaauauucagguggcaauaaaccaagucagacggcucaucgguaaugagaacuaccuugacuauaugacaaguaugaaaagguuuaagaaugaaagcgauccagagggcgcucugugguga

SEQ ID NO: 14144 - RNA, 9879 nt, Artificial Sequence
  derived and/or modified CDS sequence (opt3) from DENV-1__KC692516__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaagcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggauuuucacuaccaacaucuggcuuaaauugcgugauagcuacacacagaugugcgaccaccggcucauguccgcugcaauaaaggauucaaaagccgugcaugcugacaugggauauuggauugagagugaaaagaaugagacguggaaacuggcccgagcaucuuucaucgaaguuaagaccuguacuuggccaaagagccacacacuaugguccaacggcgugcuggagucagagaugauuauccccaaaauauacgguggcccuaucagccaacauaauuauagaccaggguacuuuacccagacugcgggaccguggcaccucggcaagcuggaacuugauuucgacuugugcgaggggacaaccguagucguggaugaacacugcggaaacaggggccccucucugcgcacgacuaccgugacagguaaaauuauccaugagugguguugccgguccuguaccuuaccuccacucagauuuaggggggaggacggaugcugguacggcauggaaauucgccccgucaaggagaaagaagagaaucugguucgaaguauggugagcgccgguucuggcgaaguagauaacuucucccuugggauccugugugugucaauaaugauugaggaggucaugcggagucguuggagcagaaagauguugaugacuggaacacucgcuguguuucugcuacugaucaugggccagcucaccuggaaugaccugaucaggcuuugcauuaugguuggggccaacgcaucggaccgcaugggaaugggcacaacuuauuuggcucugauggccaccuucaagaugcggccuauguuugcaguggguuuacucuucagaaggcugacgucccgagaaguccuucugcuaacaaucgggcucucucugguggccagcuuggagcugccaaacucauuagaagagcucggagauggccuggcuaugggcauuaugaugcuuaaacuguugaccgaauuucaaccccaccagcucuggacuacccugcuaagucugacauucguuaagacuacccuuucccucgacuacgcguggaaaacgacagccauggugcugucuauagucagcuuguuuccgcuguguuuauccaccacuucacagaagacaaccuggcucccuguacugcuugggagcuucggaugcaaaccacugacuauguuuuugaucacagagaauaagauuuggggucgcaagaguuggccccucaacgagggcaucauggcaauugggaucgugucuauacugcuauccagccugcuuaaaaaugauguuccucucgcuggaccccugaucgccggcgguauguugauugccuguuaugugaucucggggucaucugcugacuuaagucuggaaaaggcagccgaggucuccugggaacaggaggcggaacauagcggagcuucucacaacauucucguggagguacaagaugacggcaccaugaaaaucaaggaugaggaacgggacgauacgcugacuauacuucugaaagccaccuugcuagcagugagcggcgucuacccaauguccauuccugccacacuguucguuugguauuucuggcagaagaaaaagcagagaucaggggugcucugggacacccccaguccaccggagguggaaagggcuguccuggaugacggaaucuaccguauccuucagcgcgguuuacugggccggagccaaguggggguuggaguauuucaggauggcguguuccauacaauguggcacgucacuagaggugcagugcucauguaucaggggaagagguuggagccuucuugggccugcguuaaaaaggaccugauuuccuacggaggcggcuggcgauuucaggggcucuggaauaccggagaggaagugcaagucauagcgguggagcccgguaaaaacccaaagaauguacagacgacacccggcacuuucaaaaccccugaaggggaggucggagcuaucgcccuggacuuuaagccaggcacaucagguagucccauugugaaccgggaagggaagaucguuggacuuuacggcaauggcguggucaccacuagcgggaccuauguguccgcaauugcccaggcuaaagccucucaagagggaccucugccggagaucgaagaugagguuuucaagaaacgcaacuugacaauaauggaccuacacccagguucgggcaagacgagaagguaccugcccgcaaucgugcgggaagcuauuaaacgaaagcucagaacuuuaauccuggccccuacccgcgucguggcgagcgagauggccgaagcacuuaaggggaugccaauuagguaucagacaaccgcuguaaaaucagagcauacuggacgugagaucguggaucugaugugucacgccacauuuaccaugcggcucuugucccccguuagagucccuaauuacaacaugauaauuauggacgaagcucauuucacggauccggcaaguaucgccgccaggggcuauaucucuacucgcguggguaugggggaggcugcggcaauuuuuaugacagccacccccccaggaagcguggaagcuuucccucaguccaaugccgucauccaggacgaggaacgagauauacccgagagaucauggaacucuggcuacgacuggauuaccgauuuuccaggcaagacuguaugguucgugccuagcaucaaaagugggaaugacauugcaaacugccugcggaagaacggaaaaaggguuauccaacucucccgcaagacauucgauaccgaguaucagaagacaaaaaauaacgacugggacuacguggucacuacggauauaagcgaaaugggugccaauuuucgugcugacagagugauugauccccggaggugccugaagccaguuauccuuaaagacggcccggagcgcgugauccuagcggggccuaugcccgucaccguggccucugcagcucagcgaagaggacggauuggcaggaaccagaauaaggaaggugaucaauacguauauauggggcagccacugaacaaugacgaggaucacgcccauuggacagaggcaaaaauguuguuagacaacaucaauacucccgaaggcauuauaccugcccuguucgagccagaacgcgagaagucagcugccaucgauggagaauacagacucaggggcgaggcgcggaagaccuuuguggagcugaugcgucgcggggaccuucccguuuggcuguccuauaaagucgcaagugaaggauuccaguacagcgaucgaagaugguguuuugacggugagaggaacaaucaggugcucgaagagaacauggauguggaaauuuggacaaaggagggcgagcggaaaaaguugcgcccuagauggcuggacgccaggaccuauucggacccgcuagcucugcgggaauucaaagaguuugccgcugggcgaagaucugucuccggagaucucauccuugaaaucggcaagcugccacaacacuuaacuuugcgcgcacagaaugcccuggacaaccucguuaugcugcacaauagcgagcagggugggaaagcuuacaggcaugccauggaagagcuucccgauacgauugagacccugaugcucuuggcacugauagcgguguuaacaggcggaguaacucuauucuuucugucaggcaaggggcucggaaagaccaguaucggucuucugugcgugacagccucuuccgcuuugcuguggauggccagcgucgaaccucacuggauugcagcuucaaucauucucgaguucuuucugauggugcuucucauccccgaaccagaccggcagcguaccccucaagauaaccagcuggccuauguugugauaggcuugcuguucaugaucuuaacugucgcagccaacgagauggggcuacuggagacaacgaaaaaggaccucggaauuggccauguagcugcggaaaaucaccagcacgccaccaugcuugauguggaccugcaucccgcaagugcuuggacuuuguacgccguugccacaaccgugaucaccccaaugaugagacacacaauugagaacacuacggcaaauaucagccugaccgcuauagccaaccaagcggcuauucucaugggucuggauaaaggguggccuaucuccaagauggacauuggcgucccgcuuuuagcccugggauguuacucucaggugaauccccucacauugacugcagccguccugaugcuaguggcucauuaugcaaucauaggcccagggcugcaggccaaagcgaccagggaagcucagaagcgcacagccgcaggaaucaugaagaacccuaccguugauggcauuguggccaucgaccucgaucccguaguguacgacgcuaaauuugagaagcaacuuggucagauuaugcuguugauccugugcacuagccagauacuccugaugcggacgacaugggccuuaugugaauccauuacccuugcaacugggccacugaccacacucugggagggaucaccuggcaaauucuggaauacuaccaucgcugucucuauggccaacaucuuccgagguaguuaucuagcgggcgccgggcuggcauuuucguugaugaagagccugggaggcgggagaaggggaacaggcgcucagggugagacgcucggggaaaaauggaagcgccaacuuaaucagcuguccaagucugaguucaacaccuacaaacggucaggaauuauggaaguugacagaagcgaggccaaggaaggcuugaaacguggugagacuacaaagcacgcaguguccaggggcaccgcuaaacugcggugguuugucgagcgcaaucucgugaagcccgaagggaagguaaucgauuuaggaugcggccgagggggauggaguuauuacugugccggccugaaaaaggugacugagguuaaagguuauacaaaggggggaccgggccaugaagagccaauaccuauggccaccuacggcuggaaccuugugaaacugcacucugggaaggacgucuucuuuaugcccccagaaaaaugcgauacgcuacucugugacauuggagagagcucacccaauccuaccaucgaggaagguagaacacugaggguguugaagauggucgagccguggcugcggggcaaccaguucugcauuaagauccucaaucccuacaugccauccgugguugaaacucuugagcagaugcaacgcaaacacgggggaaugcugguaagaaacccuuuaaguaggaauagcacccaugagauguauugggugucucgaggcacagguaacauagucuccgcggugaacaugacuucacggaugcuguugaaucguuuuaccauggcucacagaaagcccacauacgaacgcgauguugaccucggggcaggaaccaggcauguggccgucgagccugaaguggcuaaccuggauaucauuggccagcggaucgagaauauuaaaaacgaacacaagagcacuuggcacuaugacgaggauaauccauacaaaacgugggccuaucauggcucguacgagguaaagcccucugggagugcauccagcauggugaacggaguugucagacuacuuacaaagccuugggacgugaucccaauggugacccagauugccaugacugauaccacacccuucggucaacagcgcgucuuuaaagaaaagguugacacgaggaccccgcgagcuaaacggggcacuacacagaucauggaggugaccgcgaaguggcuguggggguuccucucaagaaauaaaaagccuaggauauguacucgcgaagaguuuacacguaagguacgguccaacgccgcaauuggagcuguguucgucgacgaaaaacaguggaauucugccaaggaggcaguggaggaugaaagauuuugggaccugguucacagggagcgcgaauugcauaaacaaggcaagugcgccaccugcguguauaacaugauggguaaacgagagaagaagcugggggaauucggaaaagcuaagggcagccgggccaucugguacauguggcucggcgcgagauuccuugaguuugaggcacugggguucaugaaugaagaucacugguuuaguagggagaacuccuuaagcggagucgaaggugagggccugcauaaauugggguacauccuccgcgacauuucuaagauaccaggaggcaauauguaugccgaugacacagcugguugggauacuagaaucaccgaggacgaucugcagaacgaagccaaaauuacggacaucauggagcccgaacacgcacuacuugcuaccucaauuuucaagcugacauaccagaauaaagugguacggguucagaggccugccaagaacgggacugugauggaugucaucagucgucgagaccaacgcggauccggccaggugggcaccuaugggcucaacacauuuacuaauauggaggugcagcugauaagacagauggaaagcgagggaaucuucuugccaucugaguuagaaacccccaaccuggcugagcggguccucgauuggcuugaaaagcacggugccgagaggcugaaacgcauggcaauuucgggcgacgacuguguugugaagccgaucgaugacagauuugcgacggcccuaacagcucugaaugauauggggaaaguacggaaggacauuccucaaugggaacccucaaaaggauggaacgauuggcagcaggugccauucugcagccaucacuuucaucagcucaucaugaaggacggcagggagauagucgugccuugucgaaaucaagaugaguugguuggucgugccagagugucccagggggcaggauggagucugcgcgaaaccgcuugccuuggcaagucuuacgcccagauguggcaacugauguauuuccaccggagggaccucagauuagcagccaacgcgauuuguagcgcuguccccguggauuggguaccaacuucccgcacaaccuggucaauccacgcccaucaccaguggaugacuaccgaggacaugcugaguguuuggaaucggguguggaucgaagagaaccccuggauggaagauaaaacacaugucucuagcugggaggaggugccuuacuugggcaagagggaagaccaguggugcgggucccugauuggacucacggcacgagccaccugggcuacuaauauacagguugccaucaaccaagugagacggcuuauugguaaugagaacuaucuggacuacaugacaucaaugaaaagguuuaagaaugaaagcgauccagagggcgcacuaugguga

SEQ ID NO: 14145 - RNA, 9879 nt, Artificial Sequence
  derived and/or modified CDS sequence (opt3) from DENV-1__KC692517__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuaucgaacacggcacgauugccacaaucaccccccaggcgccuacuucagagauccagcuuaccgacuacggggcccugacauuggacuguaguccaaggaccggacuagauuucaacgaaaugguccugcucacuaugaaggagaaaagcuggcuggugcauaagcagugguuucuugaccugccguugcccuggacaucuggcgcauccacgccucaagagaccuggaaucggcaggaucuccugguaacuuucaaaacagcucacgccaagaagcaggaaguuguggucuuagguucacaagagggggcuaugcacaccgcccugacaggcgcaacugaaauucagaccagcggaacgaccacaauauuugccggccaucuaaaaugccgucucaagauggacaaacugacucuuaaggggaugaguuaugugauguguaccggaucuuucaaauuggagaaggaagucgcugagacacagcacgguacugugcugguucaggugaaguacgagggcaccgaugcgccaugcaaaauccccuucuccacgcaagacgaaaaggggguaacacagaacggacgccucauuaccgcaaauccuaucgucacugauaaagagaagagcgugaacauagaaacagagccacccuuuggcgagucguauauuguugugggugucggggaaaaagcccugaagcuuucuugguucaagaaaggcuccucaaucggaaagauguuugaggcuaccgccagaggcgcaaggcggauggccauccugggggacacugcuugggauuucggaaguauugguggcguguuuaccagcguagggaaauuggugcaucagguuuucggaacagccuacggcguccucuuuuccggugugucuuggacgaugaagaucgggauuggcauacuguuaaccuggcugggacuaaauagccgaucaacuagucucuccaugacauguaucgcagugggcauggucacccuguaccuugggguuauggugcaggcggacagcggaugcgugauuaacuggaaaggccgcgaauugaagugugguucugggaucuucguaacaaacgagguccacacuuggaccgaacaauauaaguuucaggcugauucaccgaaaagacugagugccgcaaucggaaaggccugggaggagggcgugugcgguauuaggagcgcuacgcggcucgaaaauauaauguggaaacagaucuccaacgagcugaaucauauuuuacuggaaaacgacaugaaguucacaguuguggucggcgacgccaaugggauccuugcacagggaaaaaagaugauucgcccucaacccauggagcacaaauacucuuggaagucguggggcaaggcuaaaaucauaggggccgauauccagaacaccacuuuuauuaucgacggaccagauaccccugaaugucccgacggccagagagcguggaauauuugggagguggaggauuaugguuucgggaucuuuacaacuaacauaugguugaagcucagggacagcuacacccagaugugcgaucaccgucugauguccgccgcuauuaaagacucaaaggcaguucaugccgauaugggauauuggaucgaaagugagaaaaaugaaacauggaagcuagcucgggccucuuucauugaggugaagacguguaccuggccaaaaagccacacucugugguccaacggcguacucgaaucagagaugaucauacccaagaucuacgguggcccuauuagccaacauaauuaucgaccaggguacuucacacagaccgcaggaccguggcaccugggcaaacuugaguuggacuuugaucugugcgaagggacuacagucgugguggacgagcacugcggaaacagaggccccucuuuaaggaccacgacugucaccgguaagaucauucaugaaugguguugccgcuccuguacacucccuccacugcgguucagaggggaggauggaugcugguacggcauggagaucaggcccguuaaagaaaaggaggaaaaucuugugcgcaguaugguaagcgcggguucuggcgagguggacuccuuuucacuggggauauugugugucaguauuaugaucgaagaggugaugcgaagccgguggucgcguaagaugcucaugaccggaacucuggccguuuuccuacugcucaucaugggccagcugacauggaacgaccuuauuagauugugcaucauggugggggcuaaugccuccgauaggaugggaaugggcaccacauaucuggcauuaauggcuacuuuuaaaaugcgcccuauguucgccgucggucuccuguuucggagacuuaccucuagggaggugcugcuacucacgauugggcugagcuugguugcaucaguggaacugccaaacaguuuagaggaacucggagacggccuggccaugggcauaaugaugcuuaagcuguugacagaguuccaaccccaccagcucuggaccacucugcuaucccugaccuuugucaaaacaacucuuucucucgauuacgcuuggaagaccacggcgaugguacugagcaucguguccuuguucccgcuguguuuaucaacaaccagccagaaaacuacauggcucccuguucugcuugggaguuuuggaugcaacccacugaccauguucuugauuacugaaaauaagaucuggggucgaaagucuuggccccucaacgagggcauuauggccaucgggauaguguccauccugcuaagcucgcugcuuaaaaaugacgucccucucgcaggaccccugauugcuggcgguauguugaucgccuguuaugugauuucagggucuagugccgauuuaucccuggagaaggcugcagaaguaagcugggagcaggaagccgagcauucuggagcgagccacaacauccucguggaaguccaagacgauggcacaaugaaaauaaaggacgaggagcgcgaugacacccugacgauucuucugaaagcuacuuugcuagccguuuccggcguguacccaaugucaaucccugcaacccuguuugugugguauuucuggcagaagaaaaagcagcggagugggguccucugggauacacccagcccaccgaagguggaaagagccguucuggacgauggaaucuacaggauucuucagcgugguuuacugggccgcucucaaguaggggugggagucuuccaggacggcguguuucauaccauguggcacguuacacggggugcugugcucauguaucaggggaaaagauuggagccuuccugggcaucagucaagaaagaccugauaaguuacggaggcggcuggagguuccaggggagcuggaauacuggagaagaggugcaaguaaucgccgucgagcccgguaagaacccaaaaaaugugcagaccacgcccggcacauuuaagacuccugaaggggagguuggagcgauugcucucgauuucaagccaggcaccuccgguucucccaucgugaaccgagaagggaaaauugucggacuguacggcaauggcgugguuacaaccucggggacuuaugugagcgccaucgcacaggccaaggcuucacaagagggaccucuuccggaaauagaggacgaggucuuuaaaaagcggaaccugaccaucauggauuugcacccagguuccggcaaaacacgcagauaccuacccgccauugugagggaagcaaucaagcggaagcugcgaacgcucauuuuagcuccuacuagaguaguggccagugagauggcggaagcccugaaagggaugccaauccgcuaucagaccacagcaguuaagucugagcauaccggaagggaaauagucgaccuuaugugccacgcuacuuucacaaugcgucugcucagccccgugcgggugccuaauuacaacaugauuaucauggaugaggcccauuuuaccgacccggcuuccaucgcagccagaggcuauauuucaacgagggucgguaugggggaggccgcugcgaucuucaugacugcaacacccccaggaucuguagaagccuuuccucagagcaaugcugugauacaggaugaggaacgcgacauucccgagcgaaguuggaacuccggcuacgauuggaucaccgacuucccaggcaaaaccguuugguuugugccuagcauuaagucugggaaugauaucgccaacuguuugagaaaaaacggaaagcgggucauacaacugucaaggaagacuuucgacacagaauaucagaaaaccaagaauaacgacugggauuacgugguuacaacugacauuuccgagaugggugcaaauuuccgcgccgaucgugugaucgaccccagacggugccucaaaccagucauccugaaggauggcccggagagggugauucuugcugggccuaugcccguaacgguggcgagugccgcacagcgccgaggaagaaucggccggaaccagaauaaagaaggugaccaauacguuuauauggggcagccacuaaacaaugaugaggaccacgcucauuggaccgaagccaagaugcuguuggauaacauuaauacacccgagggcauaaucccugcauuauuugagccagaaagggagaagagcgccgcuauugacggagaauaccgccugagaggcgaggccaggaaaacuuucgucgaacucaugcggcguggggaucugcccguguggcuuucguauaagguggcgucugagggauuucaguacuccgaccgccgauggugcuucgauggugagagaaacaaucagguccuggaagagaacauggacguugaaaucuggaccaaagagggcgaaaggaagaaacuccggccucgcugguuggacgcaagaacauauagcgauccgcuggcccuaagggaguuuaaggaguucgcugccgggcggcgaucagugaguggagaccugauccucgaaauuggcaaacuuccacaacaccugaccuuaagagcucagaaugcauuggauaaccugguaaugcuccacaauucugagcagggugggaaggccuaccgccaugcuauggaagagcugcccgacacuauagaaacgcuuaugcugcucgccuugaucgcagugcugaccggcggagucacauuauuuuuccuauccggcaaggggcugggaaaaacuagcauuggucuccuuugugugaccgcgucaagugcccuguuguggauggcuagcguugagccucacuggaucgccgcauccauuauccuggaguuuuuccucauggugcugcuuauacccgaaccagauaggcagcggacaccucaagacaaccagcucgcuuaugucguaaucggccuguuguuuaugauucugaccguggccgcaaacgagaugggguuacuagaaacuacaaagaaagaucugggaaucggcuacguugccgcugagaaucaucagcacgcgacgaugcucgacguggaucuucgucccgccucugcauggacccuguacgcugucgccacuacagugauuaccccaaugaugagacacaccaucgagaacacaacugccaauauaagcuugacggcaauugcuaaccaagccgcgauccugaugggucucgacaagggguggccuauuuccaaaauggauaucggcgucccgcugcuugcuuuaggaugcuauucacaggugaauccccugacccucacagccgcaguuuugaugcugguggcccauuacgcuauaaucggcccagggcuacaggcaaaggccacuagggaagcgcagaagcgcaccgcugccggaauuaugaaaaacccuacaguagacggcaucguggcaauugaucuggaccccgucguuuaugacgccaaguucgagaaacaacucggucagaucaugcuucugauauuguguaccucucagauucugcucaugcggacuacgugggcucugugcgaaaguaucacauuagccaccgggccacuuacuacccugugggagggaucgccuggcaaguuuuggaauacaacuaucgcagugagcauggcuaacauuuuccgagguuccuaccucgccggcgcggggcuagccuucucucugaugaaaucauugggaggcgggagaaggggaaccggcgcacagggugaaacacugggggagaaguggaagcgccaacucaaucagcuuagcaaauccgaguuuaacacguauaagcggaguggaaucauggaagucgauagaucugaggcuaaagaaggccugaagcguggugagaccacuaaacacgccgugagcaggggcacagcaaaguugcggugguucguagaacgcaaucuggugaagcccgaggggaaaguuauagaccucggauguggccgagggggauggucauacuauugcgcuggcuuaaagaaagugaccgaggucaaggguuacacuaaagggggaccgggccaugaagagccaauuccuauggccacauacggcuggaaccuggugaagcuucacuccgggaaagaugucuuuuucaugcccccagaaaagugugacacccugcuaugcgauaucggagagaguagccccaauccuacgauugaagaggguagaacccucagggugcugaagaugguugagccgugguugcggggcaaccaguuuuguaucaaaauacugaaucccuauaugccaucuguaguggaaacacucgagcagaugcaacgcaagcaugggggaaugcuugucagaaacccucuguccaggaauucaacucacgaaauguacugggugagcugcggcaccgguaacaucguuucggccgugaacaugacaucucgaauguuacugaaucgguucacuauggcgcaccguaaacccaccuaugagagagacgucgauuugggggcuggaacacgccauguggcaguagagccugaaguggccaaccucgacauuaucggccagaggauugagaauaucaagaacgaacacaaaaguaccuggcauuacgaugaggacaauccauauaagacuugggcuuaccacggcuccuaugaaguuaagcccagcgggucagccuccucuauggucaacggaguggugcggcugcuaacgaaaccuugggaugucauuccaaugguuacacagaucgcaaugaccgacacuacccccuuuggucaacagagaguguucaaggagaaaguagacacacgcacgccgagggccaagcgaggcaccacucagauaauggaggugacagcuaaauggcuuuggggguuucugagccggaauaagaagccuagaauuuguaccagggaagaguucacucgcaaaguccguaguaacgcggccaucggagcaguguuuguugaugaaaaucaguggaacuccgcuaaggaggccguggaagacgagcgguucugggaucucguccacagagagagggaacugcauaaacaaggcaagugcgcaacaugcguguacaauaugauggguaaacgcgagaagaaguugggggaauuuggaaaagccaagggcagccgagcuaucugguacauguggcugggcgcccgguuccucgaguucgaagcgcuuggguuuaugaacgaggaccacugguucucuagagagaauucacugaguggaguagaaggugagggcuuacauaaacugggguauauuuugagggauauauccaagaucccaggaggcaacauguacgcagacgauaccgccgguugggacacacgcauuacugaagaugaccuccagaaugaggcuaaaaucaccgauauuauggagcccgaacacgcccugcuagcaacgagcaucuuuaagcuuaccuaucagaacaaaguugugagaguccagcggccugcuaagaacgggacagugauggacgugauaucuaggcgugaucaacgaggaucgggccaggucggcacuuacgggcugaauaccuucacaaacauggagguucagcucgugcgccagauggaaucagagggaaucuuucugccaagcgaauuggagacucccaauuuagccgagagaguacuggacuggcucgaaaagcaugguguggagcggcuuaaaaggauggcuauuuccggcgacgauugugucgugaagccgaucgacgaucgcuucgccaccgcacugacggcgcuaaacgacauggggaaaguuagaaaggauauuccucaaugggaacccaguaaaggauggaaugacuggcagcaggugccauuuugcucucaccacuuccaucagcugaucaugaaggauggccgggagauagucgugccuuguaggaaccaagacgaacucguaggucgagcccguguuagccagggggcuggaugguccuugagagagacagccugccugggcaagucauaugcacagauguggcaacuuauguacuuucaccgccgggaucugaggcucgcugccaaugcaauuuguagugccgugcccgucgacugggugccaaccucuagaacuacauggagcauccaugcgcaccaccaguggaugaccacugaggauauguuauccguuuggaaccgcguguggaucgaagagaaucccuggauggaagacaaaacccaugucucaagcugggaggaagugccuuaucugggcaagcgggaggaccaguggugcgggucuuugauuggacugacagcuagggccacgugggcaaccaacauacagguagccaucaaucaagugcgaagacucauugguaacgagaauuaccuugauuacaugacuuccaugaaacgguucaagaacgaaagugacccagagggcgcucugugguga

SEQ ID NO: 14146 - RNA, 9879 nt, Artificial Sequence
  derived and/or modified CDS sequence (opt3) from DENV-1__KC762649__SS-prME
agcgugaccaugcugcucaugcuuaugcccacagcacuggcuuuccacuugacuacgagaggaggggaaccucauaugaucgucuccaagcaggaaagaggaaaaucuuuacuguuuaagaccucagccgguguuaacaugugcacauuaauugccauggaccucggcgaacugugugaagauacucuuaccuacaaaugcccacggauuacagaagcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcgccucgauuacacagaagggcaucauauucaucuuacugaugcuugugaccccaucaauggcgaugcgcugcgucgggauuggaagcagagauuuuguggaggguuugaguggcgcaacguggguagacguugugcuggagcacggguccugugucacuacaauggccaaggauaaacccacccuagacaucgaacuccugaagacugaggugacaaacccugcugugcuuaggaaacugugcauugaagccaagaucucuaauaccacgaccgauagccgguguccaacacaaggagaggcaacuuuggucgaagaacaggacgcuaacuucguuugccgccgaaccuuuguggauagaggcugggguaauggguguggacucuucggcaaaggcucccugauaacaugcgccaaguuuaagugcguaucaaaauuagaggggaagauugugcaguacgaaaaccugaaauauagugucaucgugacuguucacaccggagaccagcaucaaguggguaaugagagcacagaacacggcaccacugcgacgauuacaccccaggccccuaccacugagauccagcucaccgacuacggggcacuuacacuggauuguucuccaaggaccggauuggacuucaacgaaaugguccuacugacuaugaaggagaaauccuggcucgugcauaagcagugguuucuggaucuuccgcugcccuggacaucaggcgcuagcacgagucaagagaccuggaaucggcaggacuugcucguaacuuucaaaacagcccacgcuaagaagcaggaaguugugguccuggguucucaagagggggccaugcacaccgcauuaacaggcgccacugaaauccagaccuccggaacgaccacaauuuuugcuggccaucugaaaugccgucuaaagauggauaaacucacucugaaggggaugagcuaugugauguguaccggaucguucaaacuugagaaggaagucgcggagacacagcacgguacuguguugguucagauaaaguacgagggcaccgacgcaccuugcaaaaucccauucucuacgcaagaugaaaagggggugacacagaacggacgccugauuaccgccaaucccaucguaacugacaaagagaagccugucaacauagaagcugagccacccuuuggcgaguccuauauugugaucggugccggggaaaaagcacucaagcugucaugguucaagaaaggcaguagcaucggaaagauguuugaggccacagcuagaggcgccaggcggauggcaauucuuggggauaccgcgugggacuucggauccaucgguggcguuuuuacuucuguggggaaacugguccaucagauuuucggaaccgcuuacggcguguuguuuagcgguguaucauggacaaugaagauagggaucggcgugcuccugacgugguuaggacugaauagucgauccaccagccuaucuaugacuuguauugccguuggccucgucacacuguaccuuggggugauggugcaggcagauucaggaugcgucaucaacuggaaaggccgcgaauugaagugugguagugggaucuucguuaccaaugaggugcacacauggacugaacaauauaaguuucaggccgacagcccgaaaagacuguccgcugccauuggaaaggcaugggaggagggcgugugcgguauaaggucugcuacccggcucgaaaacaucauguggaaacagauuucgaacgagcugaaucauaucuuacuggaaaacgacaugaaguucacgguagucgugggcgauguugccgggauucuugcgcagggcaaaaagaugauccgcccucaacccauggagcacaaauacagcuggaaguccuggggcaaggccaaaauaaucggggcugacgugcagaauacaaccuuuauuaucgauggaccaaacacuccugaaugucccgacgaucagagagcauggaauauuugggaggucgaggacuauggcuucgguaucuuuaccacaaacauaugguugaagcucagggauucauacacucaggugugcgaccaccgucugaugagugccgcuauuaaagauucuaaggccguucaugcagacaugggguauuggaucgaaagcgagaaaaaugaaaccuggaagcuagcgcgggccuccuucauugaggugaagacauguaucuggccaaaaucacacacgcuguggagcaacggaguacucgaaucugagaugauaauccccaagauuuacggcgguccuaucucccaacauaauuaucgaccaggcuacuucacccagacugcugggccguggcaccugggaaaacuugaguuggauuuugaccugugcgaaggcacaaccgucgugguggaugagcacugcgggaacagaggacccaguuuaaggacuacaaccgucacgggcaagauuauccaugaaugguguugccgcagcuguacucucccuccacugcgguucagaggugaggacgggugcugguacggaauggagauaaggcccguuaaagaaaaggaggaaaaucuugugaagucuaugguauccgccggcucaggugagguggacaguuuuagccugggcuugcucuguauuucgaucaugaucgaagaggucaugcgcucccgauggucucggaaaaugcugaugaccgggacacuagcaguguucuuucugcucauuaugggacagcugaccuggaacgaucuuauccguuugugcauuaugguuggcgcuaaugccagcgacagaauggggaugggaacuacauaucuggcauuaauggccaccuucaagaugaggccuauguuugcugugggccuccuguuccgccggcuuacaucaagagagguccugcuacucacuauaggucugaguuugguggcguccguugaacugccaaacucuuuagaggaacucggggauggacuggccaugggcaucaugauucuuaaacuguugaccgacuuucaaagccaccagcucugggcaacgcugcuaucccugacauucaucaagaccacuuuuucacuucauuacgcuuggaaaaccauggccauggugcucagcauugucagucuguuccccuugugucugucuacaacuucccagaagaccacgugguuaccgguacuccugggcagccuugggugcaagccucugacaauguuuuugaucgccgagaauaaaauauggggaaggaagucguggccacucaacgaagguaucauggcugugggcauuguuucaauccugcuaucuagucugcuuaaaaacgaugugccccucgcagggccucugauugccggaggcauguugaucgcguguuaugucauauccgguagcucugcugacuuaagccuggagaaggccgcagagguguccugggaagaggaagccgagcacucaggggcuagucauaauauucucguagaagugcaggaugacggaaccaugaaaaucaaggaugaggagcgagacgauacucugacaauccuucugaaagcaaccuugcuagccgucagcggcguuuacccccugucuauuccagcgacucucuucgugugguauuucuggcaaaagaagaaacagcgcuccggcgugcugugggacacaccuucacccccagaagucgagcgggcugugcuugaugacgggauauacagaaucaugcagaggggauuacugggucguagucagguuggcguagggguguuucaagaaaacgucuuccacaccauguggcacgugacgcgcggagccguucucauguaucagggcaagcgguuggagccgagcugggcauccgugaaaaaggaccugauuucuuacggugggggauggagacuccagggcucguggaauacuggcgaggaaguccaggugaucgccguagagccugggaaaaaccccaagaauguccaaaccgcuccaggaauuuuuaagacacccgaaggugaggugggcgccaucgcacuggauuucaaaccugggaccagcggaucaccaauaguuaacagggaaggcaagaucgugggucuuuacgggaauggagucgugacaacuuccggcaccuauguuagugcuauugcccaggcgaaagccucucaggagggcccccugccugagaucgaagacgagguguuucgaaagcggaacuugacgauuauggaucuacauccggggagcggaaaaacacgcagauaccugccagcaaucgucagggaagcuauaaagcggaagcuccgaacuuuaauucuggcccccaccagagugguagcuuccgagauggcagaagcccuuaaagguaugccuauccgcuaucaaacaaccgccgugaagucagagcacacuggcaaagagaucguugaccugaugugccaugcuaccuucacaaugaggcucuugucuccaguccgugugcccaauuacaacaugauuaucauggaugaagcgcacuuuacggacccuagcaguauagcagcccggggguauauuuccacuagagugggaaugggcgaggcugccgcaaucuucaugaccgccacaccgcccgguagcgucgaggcuuuuccacagucuaaugcgguaauucaggaugaggaaagggacaucccugagcgcucauggaacuccggguacgaguggauaaccgauuuccccggaaagacugugugguuuguuccaaguauuaaaagcggcaaugacaucgccaacugucugcgaaagaauggcaagagagugauccagcucucgcggaaaacauucgauaccgaauaucaaaagacgaaaaacaacgacugggacuacgucgugacuacagauauuucugagaugggggcaaauuucagggcugaccgcguuaucgauccucguagaugccugaagcccgugauucuuaaagacggaccagaacgggucauacuagccgguccgaugccugugaccguagcauccgccgcucagaggcgcggccgaguggggagaaaccauaauaaggagggagaucaguacaucuauaugggccagccccugaacaaugacgaggaucacgcccacuggaccgaagcgaagauguuguuagacaacauuaauacuccagaggguaucauccccgcacuguuugaaccugagcgggagaaaagcgccgcuauugauggggaguacaggcuccgcggcgaggccagaaagacauucguugaacugaugaggcggggagaccuuccagucuggcugucauauaaaguggcuagugagggcuuucaauacucugaucgucgcuggugcuucgacggggaacgaaacaaucaggugcucgaggaaaacauggaugucgagauauggaccaaggagggagaaaggaaaaaguugaggccccgguggcuggacgcacgcacauauuccgacccucuagcccugagagaguuuaaagaguucgcugccgguaggcggagcguuucaggcgaucucauccuugagauugggaagcugccgcagcauuuaacucagcgagcacaaaaugcguuggacaaccuggugaugcuccacaauagugaacagggaggcagagccuaccgccaugcuauggaggagcugccagauacgaucgaaacccuuaugcugcucgccuugauugcaguacugacagguggggugacuuuauuuuuccuaagcggcaggggacugggcaagaccuccaucgggcuccuuugugucauggcuucuagcgugcuguuguggauggccuccguugagccccacuggauagcagccucaaucauucuggaauuuuuccucauggugcugcuuaucccugagcccgaccggcagcguacaccacaggauaaccaacucgcuuaugucguaauuggacuguuguuuaugauccugaccguggcggccaaugagauggguuuacuagaaacuacgaaaaaggaccugggcauagggcacguugcaguggagaaccaucaccaugcugccaugcucgaugucgaccuucacccugccucugcauggacccuguacgcuguggccacaacuauuaucacccccaugaugagacauacaauugaaaacaccacugcgaauaucaguuugacagcuauagccaaccaggcagccauccugaugggacucgauaaaggcuggccaauuucgaagauggacaucggugucccucugcuugcuuuagggugcuacagccaggugaauccgcugacgcucaccgcagccguuuugaugcugguggcgcacuaugcuauuaucggccccggacuacaagccaaagcaacuagggaggcccagaagcgcacagcugccggcauaaugaagaacccaaccguagaugggauuguggcaaucgaccuggauccugucguuuacgacgcuaaauucgaaaagcagcucggacagaucaugcuucugauuuuguguaccucccaaauccugcucaugcggacaacuugggcccugugcgagucuauaacguuagcgaccggcccccuuacaacucugugggaggguucaccagggaaauuuuggaauaccacaauugccgugagcauggcaaacaucuuccgaggauccuaucucgcuggcgccggucuagcauucagucugaugaagucuuugggcgggggaagaaggggcaccggggcucagggagaaacucugggcgagaaauggaagcgccagcucaaucagcuuagcaagucagaauuuaacacguacaaacgguccgguauuauggaggucgacagaagugaagccaaggaggggcugaaacguggagagacaaccaagcacgccgugagcaggggcacugcgaaauugcggugguucguagaacgcaaucuggugaagccugaggguaagguuaucgaucucggcugugggcgaggaggcuggucuuauuacugcgcugggcugaaaaaggugaccgaagucaaaggauauacaaagggcggucccgggcaugaggaaccgauaccaauggcaacuuacggauggaaccuagugaaacuucacuccggcaaggacgucuuuuucaucccucccgagaaaugugauacccugcuaugcgacauuggcgagucaagcccaaaucccacaaucgaagaggggagaacgcucagggugcugaagaugguugaaccuugguugcggggaaaccaauuuuguauuaagauccugaauccguacaugcccucgguaguggagacccucgagcagaugcagcgcaaacaugguggcaugcuugucagaaacccacugucuaggaauaguacucacgaaauguauuggguguccugcgggacaggaaacauuguuagcgccgugaauaugaccucacgaauguuacugaaccgguucacuauggcucaccguaagccuacauacgagagagaugucgacuugggcgccgguacccgccauguggcaguagaacccgagguggccaaccucgauaucauagggcagaggauugaaaauaucaaacacgagcauaaguccacguggcacuaugacgaggauaacccuuacaaaaccugggcuuaucauggaucuuacgaaguuaagccaagcggcagugcguccagcauggucaauggcguggugaagcugcuaacaaaacccugggacgucaucccuaugguuacucaaauugccaugaccgauacaacuccauuugggcagcagcggguguucaaggagaaaguagacaccagaacacccaaggcaaaacgcggaaccacucaaauaauggaagugacggcuagguggcuuugggguuuucugucucgaaacaagaagccgcggaucuguacaagagaggaguucaccaggaaaguccgcucaaaugccgcaauuggcgccguguuuguugacgagaaccaguggaauagugcuaaggaggccguggaagaugagcguuucugggaccucguccaccgggaaagagagcugcacaaacaggggaagugcgcgacuugcguguauaacaugaugggaaaaagggaaaagaaguugggcgaguuugguaaagcaaaggggucccgcgccaucugguacauguggcugggagcucgauuccucgaguucgaagcccuuggcuuuaugaaugaggaucauugguucagccgggaaaacucucugucgggcguagagggggagggauuacacaaacuggguuacauuuugagagacaucucaaagauaccuggcgggaauauguaugcagaugacaccgcuggaugggauacaaggaucacggaagacgaucuccagaacgaggccaaaauuaccgacaucauggaaccagagcaugcucugcuagccaaggcaauuuuuaaacuuacuuaccaaaauaagguugugcgcguccagagacccgcgaagaacggcacagugauggaugugaucagccggagggaccagcgugguuccgggcaggucggaaccuauggccugaauacuuucacaaacauggaagcccaacucauacgacagauggagagugagggcauauuuucuccuagcgaacuggagaccccaaacuuggcugaacgcguuuuagauuggcuggagaaauacgggguggaaagacucaagcggauggccaucuccggagacgacuguguagugaaacccaucgaugacagguucgcaacagcucuuacugcccugaaugauauggguaagguccgcaaagacauuccgcagugggagccuucaaagggcuggaacgauuggcagcaagugcccuuuugcagucaccacuuccaucagcuaauaaugaaggacgggagagagaucguugugccaugucggaaucaggaugaacuggucggaagggcacgagugucucagggcgccgguuggagccuccgugagaccgcgugcuuggggaaauccuaugcucaaauguggcagcugauguacuuucacagacgcgaccuucggcuggccgcaaacgccauuuguucagcuguaccuguugauugggugcccacgagcaggaccacauggucuauccaugcccaccaucaguggaugacuaccgaagacaugcucuccgucuggaauagaguguggauugaggaaaacccauggauggaggauaagacacacaucaguagcugggaggacguucccuauuuaggaaaacgcgaagaccaauggugcggcucgcugauaggcuugacugcacgggcuaccugggccacgaauauccagguggcgauuaaccaggucaggcgacugaucgggaaugagaacuaccucgauuacaugacauccaugaagagauucaaaaaugaaucugacccugagggagcucuuugguga

SEQ ID NO: 14147 - RNA, 9879 nt, Artificial Sequence
  derived and/or modified CDS sequence (opt3) from DENV-1__KC762625__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuagacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaucaaaauuagaggggaagauugugcaguacgaaaaccugaaauauagugucaucgugaccguucacacaggagaccagcaucaaguggguaaugagagcaccgaacacggcacuacggccacaauuacaccccaggcgccuacuaccgagauccagcucacagacuacggggcccuuacccuggauuguucuccaaggacuggauuggacuucaacgaaaugguccuacugacaaugaaggagaaauccuggcucgugcauaagcagugguuucuggaucuuccgcugcccuggacgucaggcgcaagcaccagucaagagacuuggaaucggcaggacuugcucguaacauucaaaaccgcucacgccaagaagcaggaaguugugguccuggguucucaagagggggcuaugcacacagccuuaacuggcgcaaccgaaauccagacguccggaaccacaacuauuuuugccggccaucugaaaugccgucuaaagauggauaaacucacccugaaggggaugagcuaugugauguguacaggaucguucaaacuugagaaggaagucgcugagacucagcacgguaccguguugguucagauaaaguacgagggcacggacgcgccuugcaaaaucccauucucuacacaagaugaaaagggggugacccagaacggacgccugauuacugcaaaucccaucguaacagacaaagagaagccugucaacauagaagccgagccacccuuuggcgaguccuauauugugaucggugcuggggaaaaagcccucaagcugucaugguucaagaaaggcaguagcaucggaaagauguuugaggcaaccgccagaggcgcuaggcggauggccauucuuggggauacugcaugggacuucggauccaucgguggcguuuuuaccucuguggggaaacugguccaucagauuuucggaacagcguacggcguguuguuuagcgguguaucauggacgaugaagauagggaucggcgugcuccugaccugguuaggacugaauagucgauccacuagccuaucuaugacauguauugcuguuggccucgucacccuguaccuuggggugauggugcaggccgauucaggaugcgucaucaacuggaaaggccgcgaauugaagugugguagugggaucuucguuacaaaugaggugcacacuuggaccgaacaauauaaguuucaggcagacagcccgaaaagacuguccgccgcuauuggaaaggccugggaggagggcgugugcgguauaaggucugcaacgcggcucgaaaacaucauguggaaacagauuucgaacgagcugaaucauaucuuacuggaaaacgacaugaaguucacaguagucgugggcgauguugcugggauucuugcccagggcaagaagaugauccgcccucaacccauggagcacaaauacagcuggaaguccuggggcaaggcgaaaauaaucggggccgacgugcagaauaccacuuuuauuaucgauggaccaaacaccccugaaugucccgacgaucagagagcuuggaauauuugggaggucgaggacuauggcuucgguaucuuuacaacuaacauaugguugaagcucagggauucauacacccaggugugcgaccaccgucugaugagugcagccauuaaagauucuaaggcuguucaugccgacaugggguauuggaucgaaagcgagaaaaaugaaacauggaagcuagcacgggcguccuucauugaggugaagucauguaucuggccaaaaagccacacgcuguggucuaacggaguacucgaauccgagaugauaauccccaagauuuacggcgguccuaucagucaacauaauuaucgaccaggcuacuucacccagacugccgggccguggcaccugggaaaacuugaguuggauuuugaccugugcgaaggcacaaccgucgugguggaugagcacugcgggaacagaggacccagcuuaaggacuacaaccgucacgggcaagauuauccaugaaugguguugccgcucuuguacucucccuccacugcgguucagaggugaggacgggugcugguacggaauggagauaaggcccguuaaagaaaaggaggaaaaucuugugaaguccaugguaucagcuggcaguggugagguggacagcuuuucgcugggcuugcucuguauuuccaucaugaucgaagaggucaugcgcucucgauggagccggaaaaugcugaugaccgggacacuagccguguucuuucugcucauuaugggacagcugaccuggaacgaucuuauccguuugugcauuaugguuggcgcaaaugcuucagacagaauggggaugggaacuacauaucuggccuuaauggcaaccuucaagaugaggccuauguuugccgugggccuccuguuccgccggcuuacaaguagagagguccugcuacucacuauaggucuguccuugguggcuucuguugaacugccaaacagcuuagaggaacucggggauggacuggcgaugggcaucaugauucuuaaacuguugaccgacuuucaaucccaccagcucugggccacgcugcuaucacugacauucaucaagaccacuuuuagccuucauuacgcauggaaaaccauggcuauggugcucaguauugucucucuguuccccuugugucuguccacaacuagccagaagaccacgugguuaccgguacuccugggcucgcuugggugcaagccucugacaauguuuuugaucgccgagaauaaaauauggggaaggaagucauggccacucaacgaagguaucauggccgugggcauuguuucuauccugcuaaguucccugcuuaaaaacgaugugccccucgcugggccucugauugcaggaggcauguugaucgccuguuaugucauaagcgguucuagcgcggacuuaucccuggagaaggcugccgaggugucaugggaagaggaagcagagcacaguggggccagccauaauauucucguagaagugcaggaugacggaaccaugaaaaucaaggaugaggagcgagacgauacucugacaauccuucugaaagcuaccuugcuagcagucucuggcguuuacccccuguccauuccagccacucucuucgugugguauuucuggcaaaagaagaaacagcgcucaggcgugcugugggacacaccuagucccccagaagucgagcgggcggugcuugaugacgggauauacagaaucaugcagaggggauuacugggucguagccagguuggcguagggguguuucaagaaaacgucuuccacaccauguggcacgugacgcgcggagcuguucucauguaucagggcaagcgguuggagccguccugggccucugugaaaaaggaccugauuucguacggugggggauggagacuccagggcagcuggaauacuggcgaggaaguccaggugaucgcaguagagccugggaaaaaccccaagaauguccaaaccgccccaggaacauuuaagacccccgaaggugaggugggcgcuauugcccuggauuucaaaccugggacaucaggauccccaaucguuaacagggaaggcaagauagugggucuuuacgggaauggagucgugacuaccaguggcacguauguuucugcaaucgcucaggccaaagcgagccaggagggcccccugccugagauugaagacgagguguuucgaaagcggaacuugacaaucauggaucuacauccgggguccggaaaaacucgcagauaccugccagccauugucagggaagcaaucaagcggaagcuccgaaccuuaauacuggcucccacaagagugguagccucagagauggcugaagcacuuaaagguaugccuauucgcuaucaaaccacugccgugaagucugagcacaccggcaaagagaucguugaccugaugugccaugccacauucacgaugaggcucuugagcccaguccgugugcccaauuacaacaugaucauuauggaugaagcucacuuuacugacccuaguuccaucgcggcacggggguauauaagcaccagagugggaaugggcgaggccgcugccauuuucaugacagcaaccccgcccgguucugucgaagccuuuccacagucaaaugcuguaauccaggaugaggaaagggacauuccugagcgcuccuggaacaguggguacgaguggaucacugauuuccccggaaagacagugugguuuguuccaagcauaaaaucgggcaaugacauugcgaacugucugcgaaagaauggcaagagagugauccagcucucucggaaaaccuucgauacggaauaucaaaagacuaaaaacaacgacugggacuacgucgugacaaccgauaucuccgagaugggggccaauuucagggcagaccgcguuauugauccucguagaugccugaagcccgugauccuuaaagacggaccagaacgggucauucuagcugguccgaugccugugaccguagccagcgcagcccagaggcgcggccgaguggggagaaaccauaauaaggagggagaucaguacauauauaugggccagccccugaacaaugacgaggaucacgcucacuggacugaagccaagauguuguuagacaacaucaauacaccagaggguauuauccccgcgcuguuugaaccugagcgggaaaaaucagcagccaucgauggggaguacaggcuccgcggcgaggcuagaaagaccuucguugaacugaugaggcggggagaccuuccagucuggcugaguuauaaaguggccucugagggcuuucaauacuccgaucgucgcuggugcuucgacggggaacgaaacaaucaggugcucgaggaaaacauggaugucgagauuuggacaaaggagggagaaaggaaaaaguugaggccccgguggcuggacgcucgcacuuauagcgacccucuagcacugagagaguuuaaagaguucgccgcugguaggcggucaguuaguggcgaucucauacuugagaucgggaagcugccgcagcauuuaacgcagcgagcccaaaaugcauuggacaaccuggugaugcuccacaauagcgaacagggaggcagagcguaccgccaugccauggaggagcugccagauaccauugaaacacuuaugcugcucgcuuugaucgccguacugacugguggggugaccuuauuuuuccuauccggcaggggacugggcaagacaucuauugggcuccuuugugucauggcaagcuccgugcuguuguggauggcuucaguugagccccacuggaucgccgcaucuauaauccuggaauuuuuccucauggugcugcuuauuccugagcccgaccggcagcguaccccacaggauaaccaacucgccuaugucguaaucggacuguuguuuaugauucugacuguggcugcgaaugagauggguuuacuagaaacgaccaaaaaggaccugggcaucgggcacguugccguggagaaccaucaccaugcagcuaugcucgaugucgaccuucacccugccagugccuggacacuguacgcaguggcuacuaccauaauuacacccaugaugagacauaccaucgaaaacacuacagccaauauuucguugacggcgaucgcuaaccaggccgcaauacugaugggacucgauaaaggcuggccaaucagcaagauggacauuggugucccucugcuugccuuagggugcuacucccaggugaauccgcugacccucacugcugcaguuuugaugcugguggcccacuaugcgaucauuggccccggacuacaagcuaaagccacaagggaggcacagaagcgcaccgccgcuggcaucaugaagaacccaaccguagaugggauaguggccauugaccuggauccugucguuuacgacgcaaaauucgaaaagcagcucggacagaucaugcuucugaucuuguguacaucucaaauucugcucaugcggacuacgugggcucugugcgagucaaucaccuuagccacaggcccccuuacuacccugugggaggguagcccagggaaauuuuggaauacaaccauagcgguguccauggccaacauuuuccgaggaaguuaucucgcaggcgcuggucuagccuucucucugaugaaaagccuaggcgggggaagaaggggcacuggggcacagggagaaacgcugggcgagaaauggaagcgccagcucaaucagcuuucaaaguccgaauuuaacacauacaaacggagugguaucauggaggucgacagaagcgaagcuaaggaggggcugaaacguggagagaccacuaagcacgccgugucuaggggcaccgccaaauugcggugguucguagaacgcaaucuggugaagccugaggguaagguuauugaucucggcugugggcgaggaggcugguccuauuacugcgcgggguugaaaaaggugacagaagucaaaggauauacuaagggcggucccgggcaugaggaaccgaucccaauggcuaccuacggauggaaccuggugaaacuucacucaggcaaggacgucuuuuucauaccucccgagaaaugugauacacugcuaugcgacaucggcgagagcucgccaaaucccacgauugaagaggggagaacccucagggugcugaagaugguugaaccuugguugcggggaaaccaauuuuguaucaagauucugaauccguacaugcccucuguaguggagacucucgagcagaugcagcgcaaacaugguggcaugcuugucagaaacccacugaguagaaauuccacacacgaaauguauugggugagcugcgggaccggaaacaucguuucagcagugaauaugacuucccgaauguuacugaaccgguucacaauggcccaccguaagccuaccuacgagagagaugucgacuugggcgcugguacgcgccauguggccguagaacccgagguggcaaaccucgauauuaucgggcagaggauagaaaauauuaaacacgagcauaagucuaccuggcacuaugacgaggauaacccuuacaaaacaugggccuaucauggaagcuacgaaguuaagccaaguggcuccgcuagcucuauggucaauggcguggugaagcugcuaacuaaacccugggacgucaucccuaugguuacccaaaucgcgaugacagauacuaccccauuugggcagcagcggguguucaaggagaaaguagacacaagaacccccaaggccaaacgcggaacuacgcaaauuauggaagugacagcaagguggcuuugggguuuucugucacgaaacaagaagccgcggauauguaccagagaggaguucacuaggaaaguccgcaguaaugcugccaucggcgcaguguuuguugacgagaaccaguggaacuccgccaaggaggcuguggaagaugagcguuucugggaccucguccaccgggaaagagagcugcacaaacaggggaagugcgcaaccugcguguauaacaugaugggaaaaagggaaaagaaguugggcgaguuugguaaagcgaaggggagccgcgcaauuugguacauguggcugggagcccgauuccucgaguucgaagcucuuggcuuuaugaaugaggaucauugguucucucgggaaaacucgcugucaggcguagagggggagggauuacacaaacuggguuacaucuugagagacauuagcaagaucccuggcgggaauauguaugccgaugacacagcaggaugggauacgaggauaaccgaagacgaucuccagaacgaggcuaaaaucacugacauuauggaaccagagcaugcccugcuagcuaaggccaucuuuaaacuuacauaccaaaauaagguugugcgcguccagagacccgcaaagaacggcaccgugauggaugugauuucccggagggaccagcgugguagugggcaggucggaacuuauggccugaauacauucaccaacauggaagcgcaacucauccgacagauggagucugagggcauauuuagcccuuccgaacuggagacaccaaacuuggccgaacgcguuuuagauuggcuggagaaauacgggguggaaagacucaagcggauggcuauuucaggagacgacuguguagugaaacccaucgaugacagguucgccacugcacuuaccgcucugaaugauauggguaagguccgcaaagacaucccgcagugggagccuaguaagggcuggaacgauuggcagcaagugcccuuuugcucucaccacuuccaucagcuaauuaugaaggacgggagagagauaguugugccaugucggaaucaggaugaacuggucggaagggcccgagugagccagggcgcagguuggucccuccgugagacggccugcuuggggaaaucauaugcgcaaauguggcagcugauguacuuucacagacgcgaccuucggcuggcugccaacgcaaucuguagcgccguaccuguugauugggugcccaccucuaggacaacuugguccauucaugcucaccaucaguggaugaccacagaagacaugcucagugucuggaauagaguguggaucgaggaaaacccauggauggaggauaagacucacauuagcucgugggaggacguucccuauuuaggaaaacgcgaagaccaauggugcggcucccugaucggcuugaccgcccgggcaacgugggcuacaaauauacagguggccaucaaccaggucaggcgacugauugggaaugagaacuaccucgauuacaugaccucuaugaagagauucaaaaaugaaucagacccugagggagcgcuuugguga

SEQ ID NO: 14148 - RNA, 9879 nt, Artificial Sequence
  derived and/or modified CDS sequence (opt3) from DENV-1__KC762635__SS-prME
agcgugaccaugcugcucaugcuuaugcccacagcacuggcuuuccacuugacuacgagaggcggggaaccucauaugaucgucuccaagcaggaaagaggaaaaucuuuacuguuuaagaccucagccgguguuaacaugugcacacugauugccauggaccucggcgaacugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagcggguggaaacuugggcucugcgccacccuggauucaccguuauugcacuguuucucgcccaugcuaucggcacaucgauuacccagaaaggcaucauauucaucuuacugaugcuugugacgccaucaauggccaugagaugcgucgggauuggaagcagggauuuuguggaggguuugaguggcgcgacuuggguagacguugugcuggagcacggguccugugucacaaccauggcaaaggauaagcccacucuagacaucgaacuccugaaaacagaggugaccaacccugccgugcuucggaagcugugcauugaagcuaaaaucucuaauacgaccacagauagccgcuguccaacucaaggagaggccaccuuggucgaagaacaagacgcaaacuucguuugccgaagaacauuuguggauaggggcugggguaauggguguggacucuucggcaagggcucccugauaacuugcgcuaaauuuaagugcguaaccaaguuagaggggaaaauugugcaguacgaaaaccugaaguauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccacggacaggauuggacuucaacgaaaugguccuacugacgaugaaagagaagucuuggcucgugcauaaacagugguuucuggaucuuccgcugcccuggaccuccggcgcaucaacuagccaagagacauggaaucgucaggacuugcucguaaccuucaagacagcucacgccaaaaagcaggaaguugugguccuggguagucaagagggggcuaugcacacugccuuaaccggcgcaacggaaauccagaccucuggaacaacuaccauuuuugccggccaucugaagugccgccuaaaaauggauaagcucacacugaaagggauguccuaugugauguguacugggagcuucaaacuugagaaagaagucgcugagacccagcacgguacgguguugguucagauaaaguacgagggcacagacgcgccuugcaagaucccauucucgacccaagaugaaaaaggggugacucagaacggaagacugauuacagcaaaucccaucguaaccgacaaggagaaaccugucaacauagaagccgagccacccuuuggcgagucuuauauugugaucggugcuggggaaaaggcccucaaacuguccugguucaagaagggcucaaguaucggaaaaauguuugaggcaacugccaggggcgcucggcgaauggccauucuuggggauaccgcaugggacuucggaagcaucgguggcguuuuuacauccguggggaagcugguccaucagauuuucggaacggcguacggcguguuguuuucugguguaagcuggaccaugaaaauagggaucggcgugcuccugacuugguuaggacuaaauucacgcaguacaucccuaagcaugaccuguauugcuguuggccucgucacacuguaccuuggggugauggugcaggccgauucuggaugcgucaucaacuggaagggcagagaauugaaaugugguucagggaucuucguuacuaaugaggugcacaccuggacggaacaauauaaguuucaggcagacaguccgaagaggcugagcgccgcuauuggaaaagccugggaggagggcgugugcgguauacgguccgcaacacgccucgaaaacaucauguggaagcagauuucuaacgagcugaaucauaucuuacuggaaaacgacaugaaauucaccguagucgugggcgauguugcugggauucuugcccagggaaagaaaaugaucagaccucaacccauggagcacaaguacucguggaaaagcuggggcaaggcgaagauaaucggggccgacgugcagaauacuaccuuuauuaucgauggaccaaacacaccugaaugucccgacgaucagagggcuuggaauauuugggaggucgaggacuauggcuucgguaucuuuacuaccaacauaugguugaaacuccgugauuccuacacacaggugugcgaccaccggcugaugucagcagccauuaaggauaguaaagcuguucaugccgacaugggguauuggaucgaaucugagaagaaugaaacguggaaacuagcacgagcgagcuucauugaggugaagaccuguaucuggccaaagucccacacucuguggucaaacggaguacucgaaagcgagaugauaauccccaaaauuuacggcgguccuaucucucaacauaauuauagaccaggcuacuucacacagaccgccgggccguggcaccugggaaaacuugaguuggauuuuaaccugugcgaaggcacuacagucgugguggacgagcacugcgggaauaggggacccuccuuacgcaccacgacugucaccggcaaaauuauccaugaaugguguugccggaguuguacacucccuccacugagauucaggggugaggaugggugcugguacggaauggagauacgccccguuaaggaaaaagaggaaaaccuugugaaguccaugguaucugcuggcuccggugagguggacucauuuagucugggcuugcucuguauuagcaucaugaucgaagaggucaugcgaucgcgguggucccguaagaugcugaugaccgggacucuagccguguucuuucugcucauuaugggacagcugacauggaaugaccuuaucagauugugcauuaugguuggcgcaaacgcuucugauaggauggggaugggaaccacauaucuggccuuaauggcaacuuucaaaaugcgcccuauguuugccgugggccuccuguuccggagacuuaccagcagggagguccugcuacucacgauaggucugucauugguggcuaguguugaacugccaaauuccuuagaggaacucggggacggacuggcgaugggcaucaugauucuuaagcuguugacagauuuucaaucucaccagcucugggccacccugcuaagccugacuuucaucaaaaccacauuuucccuucauuacgcauggaagacuauggcuauggugcucucaauugucagccuguuccccuugugucugaguaccacgucucagaaaacaaccugguuaccgguacuccugggcucccuugggugcaagccucugacuauguuuuugaucgccgagaacaagauauggggacgaaaaagcuggccacucaacgaagguaucauggccgugggcauuguuucgauccugcuaucaucucugcuuaagaaugacgugccccucgcugggccucugauugcaggaggcauguugaucgccuguuaugucauaagugguuccagcgcggauuuaucucuggagaaagcugccgaggugagcugggaagaggaagcagagcacuccggggccucacauaacauucucguagaagugcaggacgauggaacaaugaagaucaaagacgaggagcgcgaugacacccugacuauccuucugaaggcuacauugcuagcagucaguggcguuuacccccugagcauuccagccacccucuucgugugguauuucuggcagaagaagaagcagcggucuggcgugcugugggauacgccuucacccccagaagucgagagagcggugcuugacgaugggauauacaggaucaugcagcguggauuacugggucgcagccagguuggcguagggguguuucaagaaaaugucuuccacacuauguggcacgugacccggggagcuguucucauguaucagggcaaaagauuggagccgaguugggccagcgugaagaaagaccugauuuccuacggugggggauggaggcuccagggcucuuggaacacaggcgaggaaguccaggugaucgcaguagagccugggaagaaucccaaaaacguccaaaccgccccaggaacauuuaagacucccgaaggugaggugggcgcuauugcccuggacuucaagccugggaccucgggaagcccaaucguuaaucgagaaggcaaaauagugggucuuuacgggaacggagucgugacgacaucaggcacuuauguuuccgcaaucgcucaggccaaggcgagucaggagggcccccugccugagauugaagaugagguguuucggaaacgcaauuugaccaucauggaccuacauccggggucuggaaagacaagaagguaccugccagccauuguccgggaagcaaucaaacgaaagcucagaaccuuaauacuggcucccacucgcgugguagccagcgagauggcugaagcacuuaaggguaugccuauuagguaucaaaccacagccgugaaauccgagcacacgggcaaggagaucguugaucugaugugccaugccacuuucaccaugcgucucuugucaccaguccgggugcccaacuacaauaugaucauuauggacgaagcucacuuuacagauccuucuagcaucgcggcaagaggguauauaaguaccagggugggaaugggcgaggccgcugccauuuucaugacugcaacaccgcccgguuccgucgaagccuuuccacagagcaacgcuguaauccaggacgaggaacgcgauauuccugagcgaucuuggaacucaggguacgaguggaucaccgacuuccccggaaaaacggugugguuuguuccauccauaaagaguggcaacgauauugcgaauugucugaggaagaauggcaagcgggugauccagcucagcaggaagacuuucgacacagaauaucagaagaccaagaacaaugauugggacuacgucgugaccacugacaucucggagaugggggccaacuuccgcgcagaucguguuauugacccuagacggugccugaaacccgugauccuuaaggauggaccagaaagggucauucuagcugguccgaugccugugacaguagccucugcagcccagcgccgaggcagaguggggcggaaucauaacaaagagggagaccaguacauauauaugggccagccccugaauaacgaugaggaccacgcucacuggaccgaagccaagauguuguuagauaauaucaacacaccagaggguauuauccccgcgcuguuugaaccugagagggaaaaguccgcagccaucgacggggaguaccgccucagaggcgaggcuaggaaaacuuucguugaacugaugcggcguggagaucuuccagucuggcugagcuauaagguggccucagagggcuuucaauacagugaccgccgauggugcuucgauggggaaagaaauaaccaggugcucgaggaaaauauggacgucgagauuuggacgaaagagggagaaaggaagaaauugcggccccgcuggcuggaugcuagaaccuauucugacccucuagcacugagggaguuuaaggaguucgccgcuggucggcgauccguuagcggcgaccucauacuugagaucgggaaacugccgcagcauuuaacacagagagcccaaaacgcauuggauaaucuggugaugcuccacaacucagaacagggaggccgcgcguacaggcaugccauggaggagcugccagacacuauugaaacccuuaugcugcucgcuuugaucgccguacugacagguggggugaccuuauuuuuccuaaguggccggggacugggcaagacuagcauugggcuccuuugugucauggcauccucugugcuguuguggauggcuagcguugagccccacuggaucgccgcauccauaauccuggaauuuuuccucauggugcugcuuauuccugagcccgaucgucagagaacgccacaggacaaucaacucgccuaugucguaaucggacuguuguuuaugauucugaccguggcugcgaacgagauggguuuacuagaaacaacuaagaaagaucugggcaucgggcacguugccguggagaaccaucaccaugcagcuaugcucgacgucgaucuucacccugccucagccuggacccuguacgcaguggcuacaaccauaauuacucccaugaugaggcauacaaucgaaaauacgaccgccaacauuucuuugacugcgaucgcuaaucaggccgcaauacugaugggacucgacaagggcuggccaaucaguaaaauggauauuggugucccucugcuugccuuagggugcuacucgcaagugaacccgcugacacucaccgcugcaguuuugaugcugguggcccacuaugcgaucauuggccccggacuacaagcuaaggccacccgcgaggcacagaaacggacagccgcuggcaucaugaagaauccaacuguagacgggauaguggccauugaucuggacccugucguuuacgaugcaaaguucgaaaaacagcucggacagaucaugcuucugaucuuguguacgagccaaauucugcucaugcgaaccacaugggcucugugcgaguccaucacuuuagccaccggcccccuuacaacccugugggaggguucuccagggaaguuuuggaacacuacgauagcggugucaauggccaauauuuucagaggaagcuaucucgcaggcgcuggucuagccuucucccugaugaaaaguuugggcgggggaaggcgcggcacaggggcacagggagaaacccugggcgagaaguggaaacggcagcucaaccagcuuucuaagagcgaauuuaauacuuacaagagaucagguaucauggaggucgaccguuccgaagcuaaagaggggcugaagaggggagagaccacaaaacacgccgugagucggggcacugccaaguugcgcugguucguagaacgaaaccuggugaaaccugaggguaagguuauugaccucggcugugggagaggaggcuggagcuauuacugcgcgggguuaaagaaagugaccgaagucaagggauauacaaaaggcggucccgggcaugaggaaccgaucccaauggcuacguacggauggaaucuggugaaacuucacucuggcaaagaugucuuuuucauaccucccgagaagugugacacccugcuaugcgauaucggcgaguccucaccaaaccccacuauugaagaggggaggacacuccgggugcugaaaaugguugaaccuugguugcgcggaaaucaauuuuguaucaagauucugaacccguacaugcccagcguaguggagacccucgagcagaugcagagaaagcaugguggcaugcuugucaggaauccacugucgcgaaacucuacucacgaaauguauugggugaguugcgggacaggaaauaucguuuccgcagugaacaugaccagccggauguuacugaaccguuucacgauggcccacagaaaaccuaccuacgagcgcgacgucgauuugggcgcugguacaaggcauguggccguagaacccgagguggcaaaucucgacauuaucgggcagcggauagaaaacauuaagcacgagcauaaaucaacuuggcacuaugaugaggacaauccuuacaagaccugggccuaucauggauccuacgaaguuaaaccaucuggcagcgcuaguuccauggucaacggcguggugaagcugcuaacaaagcccugggaugucaucccuaugguuacucaaaucgcgaugaccgacacaaccccauuugggcagcagagaguguucaaagagaagguagauacucgcacgcccaaagccaagaggggaacaacccaaauuauggaagugacugcacgauggcuuugggguuuucugagccggaauaaaaagccgagaauauguaccagggaggaguucacacgcaagguccguucuaacgcugccaucggcgcaguguuuguugacgagaaucaguggaacucagccaaagaggcuguggaagacgagcgguucugggaucucguccacagagaaagggagcugcacaagcaggggaaaugcgccacgugcguguauaauaugaugggaaagcgcgagaagaaguugggcgaguuugguaaggcgaaagggagucgagcaauuugguacauguggcugggagcccgguuccucgaguucgaagcucuuggcuuuaugaacgaggaccauugguucuccagagaaaauagccugucuggcguagagggggagggauuacacaagcuggguuacaucuugagggauauuucgaaaaucccuggcgggaacauguaugccgacgauaccgcaggaugggacacucgcauaacagaagaugaccuccagaaugaggcuaagaucaccgauauuauggaaccagagcaugcccugcuagcuaaagccaucuuuaaacuuacuuaccaaaacaaaguugugagaguccagcggcccgcaaagaauggcacagugauggacgugauuucaaggcgugaucagcgagguagcgggcaggucggaaccuauggccugaacacauucacuaacauggaagcgcaacucauccgccagauggaguccgagggcauauuuaguccuucugaacuggagaccccaaauuuggccgaaagaguuuuagacuggcuggagaaguacgggguggaacggcucaaaaggauggcuauuagcggagaugacuguguagugaagcccaucgacgaucgcuucgccacggcacuuaccgcucugaacgacauggguaaagucagaaaggauaucccgcagugggagccuuccaaaggcuggaaugacuggcagcaagugcccuuuugcucacaccacuuccaucagcuaauuaugaaggaugggcgggagauaguugugccauguaggaaccaggacgaacuggucggacgagcccgugugagucagggcgcagguuggucucucagagagacagccugcuugggaaagagcuaugcgcaaauguggcagcugauguacuuucaccgccgggaucuuaggcuggcugccaaugcaaucuguuccgccguaccuguugacugggugcccacuucaagaaccacauggagcauucaugcucaccaucaguggaugacuaccgaagauaugcucucugucuggaaccgcguguggaucgaggaaaauccauggauggaggacaaaacgcacauuuccaguugggaggauguucccuauuuaggaaagcgggaagaccaauggugcggcagccugaucggcuugacagccagggcaaccugggcuacuaacauacagguggccaucaaucagguccgaagacugauugggaacgagaauuaccucgacuacaugacaucgaugaaacgguucaagaacgaauccgauccugagggagcgcuuugguga

SEQ ID NO: 14149 - RNA, 9879 nt, Artificial Sequence
  derived and/or modified CDS sequence (opt3) from DENV-1__KC762650__SS-prME
agcgugaccaugcugcucaugcuuaugcccacagcacuggcuuuccacuugacuacgagaggcggggaaccucauaugaucgucuccaagcaggaaagaggaaaaucuuuacuguuuaagaccucagccgguguuaacaugugcacacugauugccauggaccucggcgaacugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagcggguggaaacuugggcucugcgccacccuggauucaccguuauugcacuguuucucgcccaugcuaucggcacaucgauuacccagaaaggcaucauauucaucuuacugaugcuugugacgccaucaauggccaugagaugcgucgggauuggaagcagggauuuuguggaggguuugaguggcgcgacuuggguagacguugugcuggagcacggguccugugucacaaccauggcaaaggauaagcccacucuagacaucgaacuccugaaaacagaggugaccaacccugccgugcuucggaagcugugcauugaagcuaaaaucucuaauacgaccacagauagccgcuguccaacucaaggagaggccaccuuggucgaagaacaagacgcaaacuucguuugccgaagaacauuuguggauaggggcugggguaauggguguggacucuucggcaagggcucccugauaacuugcgcuaaauuuaagugcguaaccaaguuagaggggaaaauugugcaguacgaaaaccugaaguauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccacggacaggauuggacuucaacgaaaugguccuacugacgaugaaagagaagucuuggcucgugcauaaacagugguuucuggaucuuccgcugcccuggaccuccggcgcaucaacuagccaagagacauggaaucgucaggacuugcucguaaccuucaagacagcucacgccaaaaagcaggaaguugugguccuggguagucaagagggggcuaugcacacugccuuaaccggcgcaacggaaauccagaccucuggaacaacuaccauuuuugccggccaucugaagugccgccuaaaaauggauaagcucacacugaaagggauguccuaugugauguguacugggagcuucaaacuugagaaagaagucgcugagacccagcacgguacgguguugguucagauaaaguacgagggcacagacgcgccuugcaagaucccauucucgacccaagaugaaaaaggggugacucagaacggaagacugauuacagcaaaucccaucguaaccgacaaggagaaaccugucaacauagaagccgagccacccuuuggcgagucuuauauugugaucggugcuggggaaaaggcccucaaacuguccugguucaagaagggcucaaguaucggaaaaauguuugaggcaacugccaggggcgcucggcgaauggccauucuuggggauaccgcaugggacuucggaagcaucgguggcguuuuuacauccguggggaagcugguccaucagauuuucggaacggcguacggcguguuguuuucugguguaagcuggaccaugaaaauagggaucggcgugcuccugacuugguuaggacuaaauucacgcaguacaucccuaagcaugaccuguauugcuguuggccucgucacacuguaccuuggggugauggugcaggccgauucuggaugcgucaucaacuggaagggcagagaauugaaaugugguucagggaucuucguuacuaaugaggugcacaccuggacggaacaauauaaguuucaggcagacaguccgaagaggcugagcgccgcuauuggaaaagccugggaggagggcgugugcgguauacgguccgcaacacgccucgaaaacaucauguggaagcagauuucuaacgagcugaaucauaucuuacuggaaaacgacaugaaauucaccguagucgugggcgauguugcugggauucuugcccagggaaagaaaaugaucagaccucaacccauggagcacaaguacucguggaaaagcuggggcaaggcgaagauaaucggggccgacgugcagaauacuaccuuuauuaucgauggaccaaacacaccugaaugucccgacgaucagagggcuuggaauauuugggaggucgaggacuauggcuucgguaucuuuacuaccaacauaugguugaaacuccgugauuccuacacacaggugugcgaccaccggcugaugucagcagccauuaaggauaguaaagcuguucaugccgacaugggguauuggaucgaaucugagaagaaugaaacguggaaacuagcacgagcgagcuucauugaggugaagaccuguaucuggccaaagucccacacucuguggucaaacggaguacucgaaagcgagaugauaauccccaaaauuuacggcgguccuaucucucaacauaauuauagaccaggcuacuucacacagaccgccgggccguggcaccugggaaaacuugaguuggauuuuaaccugugcgaaggcacuacagucgugguggacgagcacugcgggaauaggggacccuccuuacgcaccacgacugucaccggcaaaauuauccaugaaugguguugccggaguuguacacucccuccacugagauucaggggugaggaugggugcugguacggaauggagauacgccccguuaaggaaaaagaggaaaaccuugugaaguccaugguaucugcuggcuccggugagguggacucauuuagucugggcuugcucuguauuagcaucaugaucgaagaggucaugcgaucgcgguggucccguaagaugcugaugaccgggacucuagccguguucuuucugcucauuaugggacagcugacauggaaugaccuuaucagauugugcauuaugguuggcgcaaacgcuucugauaggauggggaugggaaccacauaucuggccuuaauggcaacuuucaaaaugcgcccuauguuugccgugggccuccuguuccggagacuuaccagcagggagguccugcuacucacgauaggucugucauugguggcuaguguugaacugccaaauuccuuagaggaacucggggacggacuggcgaugggcaucaugauucuuaagcuguugacagauuuucaaucucaccagcucugggccacccugcuaagccugacuuucaucaaaaccacauuuucccuucauuacgcauggaagacuauggcuauggugcucucaauugucagccuguuccccuugugucugaguaccacgucucagaaaacaaccugguuaccgguacuccugggcucccuugggugcaagccucugacuauguuuuugaucgccgagaacaagauauggggacgaaaaagcuggccacucaacgaagguaucauggccgugggcauuguuucgauccugcuaucaucucugcuuaagaaugacgugccccucgcugggccucugauugcaggaggcauguugaucgccuguuaugucauaagugguuccagcgcggauuuaucucuggagaaagcugccgaggugagcugggaagaggaagcagagcacuccggggccucacauaacauucucguagaagugcaggacgauggaacaaugaagaucaaagacgaggagcgcgaugacacccugacuauccuucugaaggcuacauugcuagcagucaguggcguuuacccccugagcauuccagccacccucuucgugugguauuucuggcagaagaagaagcagcggucuggcgugcugugggauacgccuucacccccagaagucgagagagcggugcuugacgaugggauauacaggaucaugcagcguggauuacugggucgcagccagguuggcguagggguguuucaagaaaaugucuuccacacuauguggcacgugacccggggagcuguucucauguaucagggcaaaagauuggagccgaguugggccagcgugaagaaagaccugauuuccuacggugggggauggaggcuccagggcucuuggaacacaggcgaggaaguccaggugaucgcaguagagccugggaagaaucccaaaaacguccaaaccgccccaggaacauuuaagacucccgaaggugaggugggcgcuauugcccuggacuucaagccugggaccucgggaagcccaaucguuaaucgagaaggcaaaauagugggucuuuacgggaacggagucgugacgacaucaggcacuuauguuuccgcaaucgcucaggccaaggcgagucaggagggcccccugccugagauugaagaugagguguuucggaaacgcaauuugaccaucauggaccuacauccggggucuggaaagacaagaagguaccugccagccauuguccgggaagcaaucaaacgaaagcucagaaccuuaauacuggcucccacucgcgugguagccagcgagauggcugaagcacuuaaggguaugccuauuagguaucaaaccacagccgugaaauccgagcacacgggcaaggagaucguugaucugaugugccaugccacuuucaccaugcgucucuugucaccaguccgggugcccaacuacaauaugaucauuauggacgaagcucacuuuacagauccuucuagcaucgcggcaagaggguauauaaguaccagggugggaaugggcgaggccgcugccauuuucaugacugcaacaccgcccgguuccgucgaagccuuuccacagagcaacgcuguaauccaggacgaggaacgcgauauuccugagcgaucuuggaacucaggguacgaguggaucaccgacuuccccggaaaaacggugugguuuguuccauccauaaagaguggcaacgauauugcgaauugucugaggaagaauggcaagcgggugauccagcucagcaggaagacuuucgacacagaauaucagaagaccaagaacaaugauugggacuacgucgugaccacugacaucucggagaugggggccaacuuccgcgcagaucguguuauugacccuagacggugccugaaacccgugauccuuaaggauggaccagaaagggucauucuagcugguccgaugccugugacaguagccucugcagcccagcgccgaggcagaguggggcggaaucauaacaaagagggagaccaguacauauauaugggccagccccugaauaacgaugaggaccacgcucacuggaccgaagccaagauguuguuagauaauaucaacacaccagaggguauuauccccgcgcuguuugaaccugagagggaaaaguccgcagccaucgacggggaguaccgccucagaggcgaggcuaggaaaacuuucguugaacugaugcggcguggagaucuuccagucuggcugagcuauaagguggccucagagggcuuucaauacagugaccgccgauggugcuucgauggggaaagaaauaaccaggugcucgaggaaaauauggacgucgagauuuggacgaaagagggagaaaggaagaaauugcggccccgcuggcuggaugcuagaaccuauucugacccucuagcacugagggaguuuaaggaguucgccgcuggucggcgauccguuagcggcgaccucauacuugagaucgggaaacugccgcagcauuuaacacagagagcccaaaacgcauuggauaaucuggugaugcuccacaacucagaacagggaggccgcgcguacaggcaugccauugaggagcugccagacacuaucgaaacccuuaugcugcucgcuuugauugccguacugacagguggggugaccuuauuuuuccuaaguggccggggacugggcaagacuagcaucgggcuccuuugugucauggcauccucugugcuguuguggauggcuagcguugagccccacuggauagccgcauccaucauucuggaauuuuuccucauggugcugcuuaucccugagcccgaucgucagagaacgccacaggacaaucaacucgccuaugucguaauuggacuguuguuuaugauccugaccguggcugcgaacgagauggguuuacuagaaacaacuaagaaagaucugggcauagggcacguugccguggagaaccaucaccaugcagcuaugcucgacgucgaucuucacccugccucagccuggacccuguacgcaguggcuacaaccauuaucacucccaugaugaggcauacaauugaaaauacgaccgccaacaucucuuugacugcgauagcuaaucaggccgcaauccugaugggacucgacaagggcuggccaauuaguaaaauggauaucggugucccucugcuugccuuagggugcuacucgcaagugaacccgcugacacucaccgcugcaguuuugaugcugguggcccacuaugcgauuaucggccccggacuacaagcuaaggccacccgcgaggcacagaaacggacagccgcuggcauaaugaagaauccaacuguagacgggauuguggccaucgaucuggacccugucguuuacgaugcaaaguucgaaaaacagcucggacagaucaugcuucugauuuuguguacgagccaaauccugcucaugcgaaccacaugggcucugugcgaguccauaacuuuagccaccggcccccuuacaacccugugggaggguucuccagggaaguuuuggaacacuacgauugcggugucaauggccaauaucuucagaggaagcuaucucgcaggcgcuggucuagccuucucccugaugaaaaguuugggcgggggaaggcgcggcacaggggcacagggagaaacccugggcgagaaguggaaacggcagcucaaccagcuuucuaagagcgaauuuaauacuuacaagagaucagguauuauggaggucgaccguuccgaagcuaaagaggggcugaagaggggagagaccacaaaacacgccgugagucggggcacugccaaguugcgcugguucguagaacgaaaccuggugaaaccugaggguaagguuaucgaccucggcugugggagaggaggcuggagcuauuacugcgcgggguuaaagaaagugaccgaagucaagggauauacaaaaggcggucccgggcaugaggaaccgauaccaauggcuacguacggauggaaucuggugaaacuucacucuggcaaagaugucuuuuucaucccucccgagaagugugacacccugcuaugcgauauuggcgaguccucaccaaaccccacuaucgaagaggggaggacacuccgggugcugaaaaugguugaaccuugguugcgcggaaaucaauuuuguauuaagauccugaacccguacaugcccagcguaguggagacccucgagcagaugcagagaaagcaugguggcaugcuugucaggaauccacugucgcgaaacucuacucacgaaauguauugggugaguugcgggacaggaaauauuguuuccgcagugaacaugaccagccggauguuacugaaccguuucacgauggcccacagaaaaccuaccuacgagcgcgacgucgauuugggcgcugguacaaggcauguggccguagaacccgagguggcaaaucucgacaucauagggcagcggauugaaaacaucaagcacgagcauaaaucaacuuggcacuaugaugaggacaauccuuacaagaccugggccuaucauggauccuacgaaguuaaaccaucuggcagcgcuaguuccauggucaacggcguggugaagcugcuaacaaagcccugggaugucaucccuaugguuacucaaauugcgaugaccgacacaaccccauuugggcagcagagaguguucaaagagaagguagauacucgcacgcccaaagccaagaggggaacaacccaaauaauggaagugacugcacgauggcuuugggguuuucugagccggaauaaaaagccgagaaucuguaccagggaggaguucacacgcaagguccguucuaacgcugccauuggcgcaguguuuguugacgagaaucaguggaacucagccaaagaggcuguggaagacgagcgguucugggaucucguccacagagaaagggagcugcacaagcaggggaaaugcgccacgugcguguauaauaugaugggaaagcgcgagaagaaguugggcgaguuugguaaggcgaaagggagucgagcaaucugguacauguggcugggagcccgguuccucgaguucgaagcucuuggcuuuaugaacgaggaccauugguucuccagagaaaauagccugucuggcguagagggggagggauuacacaagcuggguuacauuuugagggauaucucgaaaauaccuggcgggaacauguaugccgacgauaccgcaggaugggacacucgcaucacagaagaugaccuccagaaugaggcuaagauuaccgauaucauggaaccagagcaugcccugcuagcuaaagccauuuuuaaacuuacuuaccaaaacaaaguugugagaguccagcggcccgcaaagaauggcacagugauggacgugaucucaaggcgugaucagcgagguagcgggcaggucggaaccuauggccugaacacauucacuaacauggaagcgcaacucauacgccagauggaguccgagggcauuuuuaguccuucugaacuggagaccccaaauuuggccgaaagaguuuuagacuggcuggagaaguacgggguggaacggcucaaaaggauggcuaucagcggagaugacuguguagugaagcccaucgacgaucgcuucgccacggcacuuaccgcucugaacgacauggguaaagucagaaaggauauuccgcagugggagccuuccaaaggcuggaaugacuggcagcaagugcccuuuugcucacaccacuuccaucagcuaauaaugaaggaugggcgggagaucguugugccauguaggaaccaggacgaacuggucggacgagcccgugugagucagggcgcagguuggucucucagagagacagccugcuugggaaagagcuaugcgcaaauguggcagcugauguacuuucaccgccgggaucuuaggcuggcugccaaugcaauuuguuccgccguaccuguugacugggugcccacuucaagaaccacauggagcauccaugcucaccaucaguggaugacuaccgaagauaugcucucugucuggaaccgcguguggauugaggaaaauccauggauggaggacaaaacgcacaucuccaguugggaggauguucccuauuuaggaaagcgggaagaccaauggugcggcagccugauaggcuugacagccagggcaaccugggcuacuaacauccagguggccauuaaucagguccgaagacugaucgggaacgagaauuaccucgacuacaugacaucgaugaaacgguucaagaacgaauccgauccugagggagcgcuuugguga

SEQ ID NO: 14150 - RNA, 9879 nt, Artificial Sequence
  derived and/or modified CDS sequence (opt3) from DENV-1__KC762623__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuagacaucgaacuccugaagacagaggugaccaacccugccgugcuuaggaaacugugcauugaagcuaagaucucuaauacgaccacagauagccgguguccaacucaaggagaggccaccuuggucgaagagcaggacgcaaacuucguuugccgccgaacauuuguggauagaggcugggguaauggguguggacucuucggcaaaggcucccugauaacuugcgcuaaguuuaagugcguaucaaaauuagaggggaagauugugcaguacgaaaaccugaaauauagugucaucgugaccguucacacaggagaccagcaucaaguggguaaugagagcaccgaacacggcacuacggccacaauuaccccccaggcgccuacuaccgagauccagcucacagacuacggggcccuuacccuggauuguucuccaaggacuggauuggacuucaacgaaaugguccuacugacaaugaaggagaaauccuggcucgugcauaagcagugguuucuggaucuuccgcugcccuggacgucaggcgcaagcaccagucaagagacuuggaaucggcaggacuugcucguaacauucaaaaccgcucacgccaagaagcaggaaguugugguccuggguucucaagagggggcuaugcacacagccuuaacuggcgcaaccgaaauccagacguccggaaccacaacuauuuuugccggccaucugaaaugccgucuaaagauggauaaacucacccugaaggggaugagcuaugugauguguacaggaucguucaaacuugagaaggaagucgcugagacucagcacgguaccguguugguucagauaaaguacgagggcacggacgcgccuugcaaaaucccauucucuacacaagaugaaaagggggugacccagaacggacgccugauuacugcaaaucccaucguaacagacaaagagaagccugucaacauagaagccgagccacccuuuggcgaguccuauauugugaucggugcuggggaaaaagcccucaagcugucaugguucaagaaaggcaguagcaucggaaagauguuugaggcaaccgccagaggcgcuaggcggauggccauucuuggggauacugcaugggacuucggauccaucgguggcguuuuuaccucuguggggaaacugguccaucagauuuucggaacagcguacggcguguuguuuagcgguguaucauggacgaugaagauagggaucggcgugcuccugaccugguuaggacugaauagucgauccacuagccuaucuaugacauguauugcuguuggccucgucacccuguaccuuggggugauggugcaggccgauucaggaugcgucaucaacuggaaaggccgcgaauugaagugugguagugggaucuucguuacaaaugaggugcacacuuggaccgaacaauauaaguuucaggcagacagcccgaaaagacuguccgccgcuauuggaaaggccugggaggagggcgugugcgguauaaggucugcaacgcggcucgaaaacaucauguggaaacagauuucgaacgagcugaaucauaucuuacuggaaaacgacaugaaguucacaguagucgugggcgauguugcugggauucuugcccagggaaaaaagaugauccgcccucaacccauggagcacaaauacagcuggaaguccuggggcaaggcgaaaauaaucggggccgacgugcagaauaccacuuuuauuaucgauggaccaaacaccccugaaugucccgacgaucagagagcuuggaauauuugggaggucgaggacuauggcuucgguaucuuuacaacuaacauaugguugaagcucagggauucauacacccaggugugcgaccaccgucugaugagugcagccauuaaagauucuaaggcuguucaugccgacaugggguauuggaucgaaagcgagaaaaaugaaacauggaagcuagcacgggcguccuucauugaggugaagucauguaucuggccaaaaagccacacgcuguggucuaacggaguacucgaauccgagaugauaauccccaagauuuacggcgguccuaucagucaacauaauuaucgaccaggcuacuucacccagacugccgggccguggcaccugggaaaacuugaguuggauuuugaccugugcgaaggcacaaccgucgugguggaugagcacugcgggaacagaggacccagcuuaaggacuacaaccgucacgggcaagauuauccaugaaugguguugccgcucuuguacucucccuccacugcgguucagaggugaggacgggugcugguacggaauggagauaaggcccguuaaagaaaaggaggaaaaucuugugaaguccaugguaucagcuggcaguggugagguggacagcuuuucgcugggcuugcucuguauuuccaucaugaucgaagaggucaugcgcucucgauggagccggaaaaugcugaugaccgggacacuagccguguucuuucugcucauuaugggacagcugaccuggaacgaucuuauccguuugugcauuaugguuggcgcaaaugcuucagacagaauggggaugggaacuacauaucuggccuuaauggcaaccuucaagaugaggccuauguuugccgugggccuccuguuccgccggcuuacaaguagagagguccugcuacucacuauaggucuguccuugguggcuucuguugaacugccaaacagcuuagaggaacucggggauggacuggcgaugggcaucaugauucuuaaacuguugaccgacuuucaaucccaccagcucugggccacgcugcuaucacugacauucaucaagaccacuuuuagccuucauuacgcauggaaaaccauggcuauggugcucaguauugucucucuguuccccuugugucuguccacaacuagccagaagaccacgugguuaccgguacuccugggcucgcuugggugcaagccucugacaauguuuuugaucgccgagaauaaaauauggggaaggaagucauggccacucaacgaagguaucauggccgugggcauuguuucuauccugcuaaguucccugcuuaaaaacgaugugccccucgcugggccucugauugcaggaggcauguugaucgccuguuaugucauaagcgguucuagcgcggacuuaucccuggagaaggcugccgaggugucaugggaagaggaagcagagcacaguggggccagccauaauauucucguagaagugcaggaugacggaaccaugaaaaucaaggaugaggagcgagacgauacucugacaauccuucugaaagcuaccuugcuagcagucucuggcguuuacccccuguccauuccagccacucucuuccugugguauuucuggcaaaagaagaaacagcgcucaggcgugcuuugggacacaccuagucccccagaaguggagcgggcggucuuagaugacgggauauacagaaucaugcagaggggacugcucggucguagccaggugggcguugggguauuucaagaaaacguguuccacaccauguggcacgucacgcgcggagcuguguugauguaucagggcaagcggcuggagccguccugggccucuguuaaaaaggaccucauuucguacggugggggauggagacugcagggcagcuggaauacuggcgaggaagugcaggucaucgcaguggagccugggaaaaaccccaagaauguacaaaccgccccaggaacauuuaagacccccgaaggugaggucggcgcuauugcccuugauuucaaaccugggacaucaggauccccaaucgugaacagggaaggcaagauaguuggucuguacgggaauggaguggucacuaccaguggcacguaugugucugcaaucgcucaggccaaagcgagccaggagggccccuugccugagauugaagacgagguuuuucgaaagcggaaccuaacaaucauggaucugcauccgggguccggaaaaacucgcagauaccucccagccauugugagggaagcaaucaagcggaaguuacgaacccugauacuugcucccacaagagucguggccucagagauggcugaagcacugaaagguaugccuauucgcuaucaaaccacugccguaaagucugagcacaccggcaaagagaucguggaccucaugugccaugccacauucacgaugagguugcugagcccaguucguguccccaauuacaacaugaucauuauggaugaagcucacuuuacugacccuaguuccaucgcggcacggggguauauaagcaccagagugggaaugggcgaggccgcugccauuuucaugacagcaaccccgcccgguucuguggaagccuuuccacagucaaaugcugucauccaggaugaggaaagggacauuccugagcgcuccuggaacaguggguacgaguggaucacugauuuccccggaaagacaguaugguuugugccaagcauaaaaucgggcaaugacauugcgaacugucuccgaaagaauggcaagagaguuauccagcugucucggaaaaccuucgauacggaauaucaaaagacuaaaaacaacgacugggacuacguggucacaaccgauaucuccgagaugggggccaauuucagggcagaccgcgugauugauccucguagaugccuuaagcccguuauccuaaaagacggaccagaacgggugauucuggcugguccgaugccugucaccguggccagcgcagcccagaggcgcggccgaguagggagaaaccauaauaaggagggagaucaguacauauauaugggccagcccuugaacaaugacgaggaucacgcucacuggacugaagccaagauguuacuggacaacaucaauacaccagaggguauuauccccgcgcucuuugaaccugagcgggaaaaaucagcagccaucgauggggaguacaggcugcgcggcgaggcuagaaagaccuucguggaacuuaugaggcggggagaccugccaguuuggcucaguuauaaagucgccucugagggcuuucaauacuccgaucgucgcuggugcuucgacggggaacgaaacaaucagguguuggaggaaaacauggauguggagauuuggacaaaggagggagaaagaaaaaagcugaggccccgguggcuagacgcucgcacuuauagcgacccucuggcacucagagaguuuaaagaauucgccgcugguaggcggucagucaguggcgaucuuauacuggagaucgggaaguuaccgcagcauuugacgcagcgagcccaaaaugcacuggacaaccucguuaugcugcacaauagcgaacagggaggcagagcguaccgccaugccauggaggagcuuccagauaccauugaaacacugaugcucuuggcucugaucgccguguuaacuggugggguaacccuauuuuuccuguccggcaggggacucggcaagacaucuauugggcuucugugugugauggcaagcuccgucuugcuguggauggcuucaguggagccccacuggaucgccgcaucuauaauccucgaauuuuuccugaugguucuucucauuccugagcccgaccggcagcguaccccacaggauaaccaacuggccuauguggucaucggauugcuguuuaugauuuuaacuguagcugcgaaugagaugggucuacuggaaacgaccaaaaaggaccucggcaucgggcacguggccguugagaaccaucaccaugcagcuaugcuugauguggaccugcacccugccagugccuggacauuguacgcagucgcuacuaccauaauuacacccaugaugagacauaccaucgaaaacacuacagccaauauuucgcugacggcgaucgcuaaccaggccgcaauacucaugggacuggauaaaggcuggccaaucagcaagauggacauuggugugccucuuuuagcccuggggugcuacucccaggucaauccgcucaccuugacugcugcagugcugaugcuaguugcccacuaugcgaucauuggccccggacugcaagcuaaagccacaagggaggcacagaagcgcaccgccgcuggcaucaugaagaacccaaccguggaugggauaguagccauugaccucgauccuguggucuacgacgcaaaauucgaaaagcagcuuggacagaucaugcuguugauccuguguacaucucaaauucuccugaugcggacuacgugggcuuuaugcgagucaaucacccuugccacaggcccccugacuacccucugggaggguagcccagggaaauuuuggaauacaaccauagcgguuuccauggccaacauuuuccgaggaaguuaucuagcaggcgcuggucuggccuucucuuugaugaagagccugggcgggggaagaaggggcacuggggcacagggagaaacgcucggcgagaaauggaagcgccagcuuaaucagcugucaaaguccgaauuuaacacauacaaacggagugguaucauggagguggacagaagcgaagcuaaggagggguugaaacguggagagaccacuaagcacgccgucucuaggggcaccgccaaacugcggugguucguggaacgcaaucucguaaagccugaggguaaggugauugauuuaggcugugggcgaggaggcugguccuauuacugcgcggggcugaaaaagguuacagaagugaaaggauauacuaagggcggucccgggcaugaggaaccgaucccaauggcuaccuacggauggaaccuugucaaacugcacucaggcaaggacguguuuuucauaccucccgagaaaugugauacacuacucugcgacaucggcgagagcucgccaaaucccacgauugaagaggggagaacccugagggucuugaagaugguggaaccuuggcugcggggaaaccaauuuuguaucaagauucucaauccguacaugcccucuguuguagagacucuugagcagaugcagcgcaaacaugguggcaugcuggugagaaacccauuaaguaggaauuccacacacgaaauguauugggucagcugcgggaccggaaacaucgugucagcaguuaauaugacuucccgaaugcuguugaaccgguucacaauggcccaccguaagccuaccuacgagagagauguggaccucggcgcugguacgcgccaugucgccguggaacccgagguagcaaaccuggauauuaucgggcagaggauagaaaauauuaaacacgagcauaagucuaccuggcacuaugacgaggauaacccuuacaaaacaugggccuaucauggaagcuacgaagugaagccaaguggcuccgcuagcucuaugguuaauggcgucgugaagcuacuuacuaaacccugggacgugaucccuauggucacccaaaucgcgaugacagauacuaccccauuugggcagcagcggguuuucaaggagaaaguggacacaagaacccccaaggccaaacgcggaacuacgcaaauuauggaaguaacagcaagguggcugugggguuuucucucacgaaacaagaagccgcggauauguaccagagaggaauucacuaggaaagugcgcaguaaugcugccaucggcgcagucuuuguggacgagaaccaguggaauuccgccaaggaggcuguugaagaugagcguuucugggaccuggugcaccgggaaagagaguugcacaaacaggggaagugcgccaccugcgucuauaacaugaugggaaaaagggaaaagaagcugggcgaguuugguaaagcgaaggggagccgcgcaauuugguacauguggcucggagcccgauuccuugaguucgaagcucugggcuuuaugaaugaggaucauugguucucucgggaaaacucguuaucaggcguggagggggagggacugcacaaauuggguuacauccucagagacauuagcaagaucccuggcgggaauauguaugccgaugacacagcaggaugggauacgaggauaaccgaagacgaucugcagaacgaggcuaaaaucacugacauuauggaaccagagcaugcccuacuugcuaaggccaucuuuaaacugacauaccaaaauaagguaguucgcgugcagagacccgcaaagaacggcaccgucauggaugugauuucccggagggaccagcgugguagugggcaggugggaacuuauggccucaauacauucaccaacauggaagcgcaacugauccgacagauggagucugagggcauauuuagcccuuccgaauuggagacaccaaacuuagccgaacgcguccuggauuggcucgagaaauacgggguugaaagacuuaagcggauggcuauuucaggagacgacugugugguaaaacccaucgaugacagguucgccacugcacugaccgcucuaaaugauauggguaaggugcgcaaagacaucccgcagugggagccuaguaagggcuggaacgauuggcagcaaguccccuuuugcucucaccacuuccaucagcugauuaugaaggacgggagagagauagugguuccaugucggaaucaggaugaacucgugggaagggcccgagucagccagggcgcagguugguccuugcgugagacggccugccuggggaaaucauaugcgcaaauguggcagcuuauguacuuucacagacgcgaccugcggcucgcugccaacgcaaucuguagcgccgugccuguagauuggguucccaccucuaggacaacuugguccauucaugcucaccaucaguggaugaccacagaagacauguuaaguguguggaauagagucuggaucgaggaaaacccauggauggaggauaagacucacauuagcucgugggaggacgugcccuaucugggaaaacgcgaagaccaauggugcggcuccuugaucggccugaccgcccgggcaacgugggcuacaaauauacagguugccaucaaccaggugaggcgacucauugggaaugagaacuaccuugauuacaugaccucuaugaagagauucaaaaaugaaucagacccugagggagcgcugugguga

SEQ ID NO: 14151 - RNA, 9879 nt, Artificial Sequence
  derived and/or modified CDS sequence (opt3) from DENV-1__KC762632__SS-prME
agcgugaccaugcugcucaugcuuaugcccacagcacuggcuuuccacuugacuacgagaggcggggagccucauaugaucgucuccaagcaggaaagaggaaagucuuuacuguuuaagaccucagccgguguuaacaugugcacacugauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagaugcagcggguggaaacuugggcucugcgccacccuggauucaccguuaucgcacuguuucucgcccaugcuauuggcacaucgaucacccagaaaggcauuaucuucauauuacugaugcuugugacgccaucaauggccaugagaugcgucgggaucggaagcagggauuuuguggaggguuugaguggcgcgacuuggguagacguugugcuggagcacggguccugugucacaaccauggcaaaggauaagcccacucuagacauugaacuccugaaaacagaggugaccaacccugccgugcuucggaagcugugcaucgaagcuaaaauuucuaauaucacgaccgauagccgcuguccaacacaaggagaggccacuuuggucgaagaacaagacgcaaacuucguuugccgaagaaccuuuguggauaggggcugggguaauggguguggacucuucggcaagggcucccugauaacaugcgcuaaauuuaagugcguaacuaaguuagaggggaaaauugugcaguacgaaaaccugaaguauucagucaucgugaccguucacacaggagaccagcaucaaguggguaaugagaguaccgaacacggcacuacggccacaauuacuccccaagcgccuaccaccgagauccagcucacagacuacggggcccuuacccuggauuguagcccacggacuggauuggacuucaacgaaaugguccuacugacaaugaaagagaagucuuggcucgugcauaaacagugguuucuggaucuuccgcugcccuggacguccggcgcaucaaccagccaagagacuuggaaucgucaggacuugcucguaacauucaagaccgcucacgccaaaaagcaggaaguugugguccuggguagucaagagggggcuaugcacacagccuuaacuggcgcaaccgaaauccagacgucuggaaccacaacuauuuuugccggccaucugaagugccgccuaaaaauggauaagcucacccugaaagggauguccuaugugauguguacagggucguucaaacuugagaaagaagucgcugagacucagcacgguaccguguugguucagauaaaguacgagggcacggacgcgccuugcaagaucccauucucgacacaagaugaaaaaggggugacccagaacggaagacugauuacugcaaaucccaucguaacagacaaggagaaaccugucaacauagaagccgagccacccuuuggcgagucuuauauugugaucggugcuggggaaaaggcccucaaacuguccugguucaagaagggcucaaguaucggaaaaauguuugaggcaaccgccaggggcgcucggcgaauggccauucuuggggauacugcaugggacuucggaagcaucgguggcguuuuuaccuccguggggaagcugguccaucagauuuucggaacagcguacggcguguuguuuucugguguaagcuggacgaugaaaauagggaucggcgugcuccugaccugguuaggacuaaauucacgcaguacuucccuaagcaugacauguauugcuguuggccucgucacccuguaccuuggggugauggugcaggccgauucuggaugcgucaucaacuggaagggcagagaauugaaaugugguucagggaucuucguuacaaaugaggugcacacuuggaccgaacaauauaaguuucaggcagacaguccgaagaggcugagcgccgcuauuggaaaagccugggaggagggcgugugcgguauacgguccgcaacgcgccucgaaaacaucauguggaagcagauuucuaacgagcugaaucauaucuuacuggaaaacgacaugaaauucacaguagucgugggcgauguugcugggauucuugcccagggaaagaaaaugaucagaccucaacccauggagcacaaguacucguggaaaagcuggggcaaggcgaagauaaucggggccgacgugcagaauaccacuuuuauuaucgauggaccaaacaccccugaaugucccgacgaucagagggcuuggaauauuugggaggucgaggacuauggcuucgguaucuuuacaacuaacauaugguugaaacuccgugauuccuacacccaggugugcgaccaccggcugaugucagcagccauuaaggauaguaaagcuguucaugccgacaugggguauuggaucgaaucugagaagaaugaaacauggaaacuagcacgagcgagcuucauugaggugaagacguguaucuggccaaagucccacacccuguggucaaacggaguacucgaaagcgagaugauaauccccaaaauuuacggcgguccuaucucucaacauaauuauagaccaggcuacuucacucagacagccgggccguggcaccugggaaaacuugaguuggauuuuaaccugugcgaaggcaccacugucgugguggacgagcacugcgggaauaggggacccuccuuacgcacaaccacggucacuggcaaaauuauccaugaaugguguugccggaguuguacccucccuccacugagauucaggggugaggaugggugcugguacggaauggagauacgccccguuaaggaaaaagaggaaaaccuugugaaguccaugguaucugcuggcuccggugagguggacucauuuagucugggcuugcucuguauuagcaucaugaucgaagaggucaugcgaucgcgguggucccguaagaugcugaugacagggacccuagccguguucuuucugcucauuaugggacagcugacuuggaaugaccuuaucagauugugcauuaugguuggcgcaaacgcuucugauaggauggggaugggaacaaccuaucuggccuuaauggcaacauucaaaaugcgcccuauguuugccgugggccuccuguuccggagacuuacuagcagggagguccugcuacucaccauaggucugucauugguggcuaguguugaacugccaaauuccuuagaggaacucggggacggacuggcgaugggcaucaugauucuuaagcuguugacggauuuucaaucucaccagcucugggccacacugcuaagccugaccuucaucaaaacuaccuuuucccuucauuacgcauggaagacaauggcuauggugcucucaauugucagccuguuccccuugugucugaguacuaccucucagaaaacgacaugguuaccgguacuccugggcucccuugggugcaagccucugaccauguuuuugaucgccgagaacaagauauggggacgaaaaagcuggccacucaacgaagguaucauggccgugggcauuguuucgauccugcuaucaucucugcuuaagaaugacgugccccucgcugggccucugauugcaggaggcauguugaucgccuguuaugucauaagugguuccagcgcggauuuaucucuggagaaagcugccgaggugagcugggaagaggaagcagagcacuccggggccucacauaacauucucguagaagugcaggacgauggaacuaugaagaucaaagacgaggagcgcgaugacacacugaccauccuucugaaggcuacuuugcuagcagucaguggcguuuacccccugagcauuccagccacacucuucgugugguauuucuggcagaagaagaagcagcggucuggcgugcugugggauaccccuucacccccagaagucgagagagcggugcuugacgaugggauauacaggaucaugcagcguggauuacugggucgcagccagguuggcguagggguguuucaagaaaaugucuuccacacgauguggcacgugacucggggagcuguucucauguaucagggcaaaagauuggagccgaguugggccagcgugaagaaagaccugauuuccuacggugggggauggaggcuccagggcucuuggaacaccggcgaggaaguccaggugaucgcaguagagccugggaagaaucccaaaaacguccaaacagccccaggaaccuuuaagacacccgaaggugaggugggcgcuauugcccuggacuucaagccugggacuucgggaagcccaaucguuaaucgagaaggcaaaauagugggucuuuacgggaacggagucgugaccacgucaggcacauauguuuccgcaaucgcucaggccaaggcgagucaggagggcccccugccugagauugaagaugagguguuucggaaacgcaauuugacuaucauggaccuacauccggggucuggaaagaccagaagguaccugccagccauuguccgggaagcaaucaaacgaaagcucagaacauuaauacuggcucccacccgcgugguagccagcgagauggcugaagcacuuaaggguaugccuauuagguaucaaacuaccgccgugaaauccgagcacacaggcaaggagaucguugaucugaugugccaugccacguucacuaugcgucucuugucaccaguccgggugcccaacuacaauaugaucauuauggacgaagcucacuuuaccgauccuucuagcaucgcggcaagaggguauauaaguacaagggugggaaugggcgaggccgcugccauuuucaugaccgcaacuccgcccgguuccgucgaagccuuuccacagagcaacgcuguaauccaggacgaggaacgcgauauuccugagcgaucuuggaacucaggguacgaguggaucacagacuuccccggaaaaaccgugugguuuguuccauccauaaagaguggcaacgauauugcgaauugucugaggaagaauggcaagcgggugauccagcucagcaggaagacguucgacacugaauaucagaagacaaagaacaaugauugggacuacgucgugaccaccgacaucucggagaugggggccaacuuccgcgcagaucguguuauugacccuagacggugccugaaacccgugauccuuaaggauggaccagaaagggucauucuagcugguccgaugccugugacuguagccucugcagcccagcgccgaggcagaguggggcggaaucauaacaaagagggagaccaguacauauauaugggccagccccugaauaacgaugaggaccacgcucacuggacagaagccaagauguuguuagauaauaucaacaccccagaggguauuauccccgcgcuguuugaaccugagagggaaaaguccgcagccaucgacggggaguaccgccucagaggcgaggcuaggaaaacauucguugaacugaugcggcguggagaucuuccagucuggcugagcuauaagguggccucagagggcuuucaauacagugaccgccgauggugcuucgauggggaaagaaauaaccaggugcucgaggaaaauauggacgucgagauuuggacuaaagagggagaaaggaagaaauugcggccccgcuggcuggaugcuagaacguauucugacccucuagcacugagggaguuuaaggaguucgccgcuggucggcgauccguuagcggcgaccucauacuugagaucgggaaacugccgcagcauuuaacccagagagcccaaaacgcauuggauaaucuggugaugcuccacaacucagaacagggaggccgcgcguacaggcaugccauggaggagcugccagacacaauugaaacucuuaugcugcucgcuuugaucgccguacugaccgguggggugacauuauuuuuccuaaguggccggggacugggcaagaccagcauugggcuccuuugugucauggcauccucugugcuguuguggauggcuagcguugagccccacuggaucgccgcauccauaauccuggaauuuuuccucauggugcugcuuauuccugagcccgaucgucagagaacuccacaggacaaucaacucgccuaugucguaaucggacuguuguuuaugauucugacgguggcugcgaacgagauggguuuacuagaaaccacaaagaaagaucugggcaucgggcacguugccguggagaaccaucaccaugcagcuaugcucgacgucgaucuucacccugccucagccuggacucuguacgcaguggcuaccacaauaauuacccccaugaugaggcauacuaucgaaaauacaacggccaacauuucuuugaccgcgaucgcuaaucaggccgcaauacugaugggacucgacaagggcuggccaaucaguaaaauggauauuggugucccucugcuugccuuagggugcuacagccaggugaacccgcugacucucacagcugcaguuuugaugcugguggcccacuaugcgaucauuggccccggacuacaagcuaaggccacccgcgaggcacagaaacggaccgccgcuggcaucaugaagaauccaacaguagacgggauaguggccauugaucuggacccugucguuuacgaugcaaaguucgaaaaacagcucggacagaucaugcuucugaucuuguguacuagccaaauucugcucaugcgaacgaccugggcucugugcgaguccaucacauuagccacuggcccccuuaccacacugugggaggguucuccagggaaguuuuggaacaccacuauagcggugucaauggccaauauuuucagaggaagcuaucucgcaggcgcuggucuagccuucucccugaugaaaaguuugggcgggggaaggcgcggcacgggggcacagggagaaacacugggcgagaaguggaaacggcagcucaaccagcuuucuaagagcgaauuuaauaccuacaagagaucagguaucauggaggucgaccguuccgaagcuaaagaggggcugaagaggggagagacuaccaaacacgccgugagucggggcacagccaaguugcgcugguucguagaacgaaaccuggugaaaccugaggguaagguuauugaccucggcugugggagaggaggcuggagcuauuacugcgcgggguuaaagaaagugacugaagucaagggauauaccaaaggcggucccgggcaugaggaaccgaucccaauggcuacauacggauggaaucuggugaaacuucacucuggcaaagaugucuuuuucauaccucccgagaagugugacacgcugcuaugcgauaucggcgaguccucaccaaaccccaccauugaagaggggaggacucuccgggugcugaaaaugguugaaccuugguugcgcggaaaucaauuuuguaucaagauucugaacccguacaugcccagcguaguggagacacucgaccagaugcagagaaagcaugguggcaugcuugucaggaauccacugucgcgaaacucuacccacgagauguauugggugaguugcgggacuggaaauaucguuuccgcagugaacaugacaagccggauguuacugaaccguuucaccauggcccacagaaaaccuacguacgaacgcgaugucgacuugggcgcugguaccaggcauguggccguagagcccgaaguggcaaaucucgauauuaucgggcagcggauagagaacauuaagcacgaacauaaaucaacauggcacuaugacgaggauaauccuuacaagacuugggccuaucauggauccuacgagguuaaaccaucuggcagcgcuaguuccauggucaacggcguggugaagcugcuaaccaagcccugggacgucaucccuaugguuacacaaaucgcgaugacugauaccacaccauuugggcagcagagaguguucaaagaaaagguagacacccgcacucccaaagccaagaggggaacgacacaaauuauggaggugaccgcacgauggcuuugggguuuucugagccggaauaaaaagccgagaauauguacuagggaagaguucacccgcaagguccguucuaacgcugccaucggcgcaguguuuguugacgaaaaucaguggaacucagccaaagaggcuguggaggaugaacgguucugggaccucguccacagagagagggaacugcacaagcaggggaaaugcgccacaugcguguauaauaugaugggaaagcgcgagaaaaaguugggcgaauuugguaaggcgaaagggagucgagcaauuugguacauguggcugggagcccgguuccucgaguucgaggcucuuggcuuuaugaacgaagaucauugguucuccagagagaauagccugucuggcguagaaggggagggauuacacaagcuggguuacaucuugagggacauuucgaaaaucccuggcgggaacauguaugccgaugacacggcaggaugggauacccgcauaacugaggacgaucuccagaaugaagcuaagaucacagacauuauggagccagaacaugcccugcuagcuaaagccaucuuuaaacuuaccuaccaaaacaaaguugugagaguccagcggcccgcaaagaauggcacugugauggaugugauuucaaggcgugaccagcgagguagcgggcaggucggaacauauggccugaacaccuucacaaacauggaggcgcaacucauccgccagauggaauccgagggcauauuuaguccuucugagcuggaaacuccaaauuuggccgagagaguuuuagauuggcuggaaaaguacgggguggagcggcucaaaaggauggcuauuagcggagacgacuguguagugaagcccaucgaugaccgcuucgccaccgcacuuacggcucugaacgauauggguaaagucagaaaggacaucccgcagugggaaccuuccaaaggcuggaaugauuggcagcaagugcccuuuugcucacaccacuuccaucagcuaauuaugaaggacgggcgggagauaguugugccauguaggaaccaggaugagcuggucggacgagcccgugugagucagggcgcagguuggucucucagagaaaccgccugcuugggaaagagcuaugcgcaaauguggcagcugauguacuuucaccgccgggaccuuaggcuggcugccaaugcaaucuguuccgccguaccuguugauugggugcccacaucaagaacuaccuggagcauucaugcucaccaucaguggaugacaacugaggacaugcucucugucuggaaccgcguguggaucgaagagaauccauggauggaagauaaaacccacauuuccaguugggaggacguucccuauuuaggaaagcgggaggaccaauggugcggcagccugaucggcuugacggccagggcaacaugggcuaccaacauacagguggccaucaaucagguccgaagacugauugggaacgaaaauuaccucgauuacaugacuucgaugaaacgguucaagaacgaguccgacccugaaggagcgcuuugguga

SEQ ID NO: 14152 - RNA, 9879 nt, Artificial Sequence
  derived and/or modified CDS sequence (opt3) from DENV-1__KC762637__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacuggaucguucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuaucucucaacauaauuaucgaccaggcuacuucacacagaccgccgggccguggcaccugggaaaacuugaguuggauuuugaccugugcgaaggcacuacagucgugguggaugagcacugcgggaacagaggacccuccuuaaggaccacgacugucaccggcaagauuauccaugaaugguguugccgcaguuguacacucccuccacugcgguucagaggugaggacgggugcugguacggaauggagauaaggcccguuaaagaaaaggaggaaaaucuugugaaguccaugguaucugcuggcuccggugagguggacucauuuagucugggcuugcucuguauuagcaucaugaucgaagaggucaugcgcucgcgauggucccggaaaaugcugaugaccgggacucuagccguguucuuucugcucauuaugggacagcugacauggaacgaucuuauccguuugugcauuaugguuggcgcaaaugcuucugacagaauggggaugggaaccacauaucuggccuuaauggcaacuuucaagaugaggccuauguuugccgugggccuccuguuccgccggcuuaccagcagagagguccugcuacucacgauaggucugucauugguggcuaguguugaacugccaaacuccuuagaggaacucggggauggacuggcgaugggcaucaugauucuuaaacuguugacagacuuucaaucucaccagcucugggccacccugcuaagccugacuuucaucaagaccacauuuucccuucauuacgcauggaaaacuauggcuauggugcucucaauugucagccuguuccccuugugucugaguaccacgucucagaagacaaccugguuaccgguacuccugggcucccuugggugcaagccucugacuauguuuuugaucgccgagaauaaaauauggggaagaaagagcuggccacucaacgaagguaucauggccgugggcauuguuucgauccugcuaucaucucugcuuaaaaacgaugugccccucgcugggccucugauugcaggaggcauguugaucgccuguuaugucauaagugguuccagcgcggacuuaucucuggagaaggcugccgaggugagcugggaagaggaagcagagcacuccggggccucacauaauauucucguagaagugcaggaugacggaacaaugaaaaucaaggaugaggagcgagacgauacccugacuauccuucugaaagcuacauugcuagcagucaguggcguuuacccccugagcauuccagccacccucuucgugugguauuucuggcaaaagaagaaacagcgcucuggcgugcugugggacacgccuucacccccagaagucgagcgggcggugcuugaugacgggauauacagaaucaugcagaggggauuacugggucguagccagguuggcguagggguguuucaagaaaacgucuuccacacuauguggcacgugacccgcggagcuguucucauguaucagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauuuaagacucccgaaggugaggugggcgcuauugcccuggauuucaaaccugggaccucgggaagcccaaucguuaacagggaaggcaagauagugggucuuuacgggaauggagucgugacgacaucaggcacuuauguuuccgcaaucgcucaggccaaagcgagucaggagggcccccugccugagauugaagacgagguguuucgaaagcggaacuugaccaucauggaucuacauccggggucuggaaaaacacgcagauaccugccagccauugucagggaagcaaucaagcggaagcuccgaaccuuaauacuggcucccacuagagugguagccagcgagauggcugaagcacuuaaagguaugccuauucgcuaucaaaccacagccgugaaguccgagcacacgggcaaagagaucguugaccugaugugccaugccacuuucaccaugaggcucuugucaccaguccgugugcccaauuacaacaugaucauuauggaugaagcucacuuuacagacccuucuagcaucgcggcacggggguauauaaguaccagagugggaaugggcgaggccgcugccauuuucaugacugcaacaccgcccgguuccgucgaagccuuuccacagagcaaugcuguaauccaggaugaggaaagggacauuccugagcgcucuuggaacucaggguacgaguggaucaccgauuuccccggaaagacggugugguuuguuccauccauaaaaaguggcaaugacauugcgaacugucugcgaaagaauggcaagagagugauccagcucagccggaaaacuuucgauacagaauaucaaaagaccaaaaacaacgacugggacuacgucgugaccacugauaucucggagaugggggccaauuucagggcagaccgcguuauugauccucguagaugccugaagcccgugauccuuaaagacggaccagaacgggucauucuagcugguccgaugccugugacaguagccucugcagcccagaggcgcggccgaguggggagaaaccauaauaaggagggagaucaguacauauauaugggccagccccugaacaaugacgaggaucacgcucacuggaccgaagccaagauguuguuagacaacaucaauacaccagaggguauuauccccgcgcuguuugaaccugagcgggaaaaauccgcagccaucgauggggaguacaggcuccgcggcgaggcuagaaagacuuucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagauuuggacgaaggagggagaaaggaaaaaguugaggccccgguggcuggacgcucgcaccuauucugacccucuagcacugagagaguuuaaagaguucgccgcugguaggcgguccguuagcggcgaucucauacuugagaucgggaagcugccgcagcauuuaacacagcgagcccaaaaugcauuggacaaccuggugaugcuccacaauucagaacagggaggcagagcguaccgccaugccauggaggagcugccagauacuauugaaacccuuaugcugcucgcuuugaucgccguacugacagguggggugaccuuauuuuuccuaaguggcaggggacugggcaagacuagcauugggcuccuuugugucauggcauccucugugcuguuguggauggcuagcguugagccccacuggaucgccgcauccauaauccuggaauuuuuccucauggugcugcuuauuccugagcccgaccggcagcguacgccacaggauaaccaacucgccuaugucguaaucggacuguuguuuaugauucugaccguggcugcgaaugagauggguuuacuagaaacaacuaaaaaggaccugggcaucgggcacguugccguggagaaccaucaccaugcagcuaugcucgaugucgaccuucacccugccucagccuggacccuguacgcaguggcuacaaccauaauuacucccaugaugagacauacaaucgaaaacacgaccgccaauauuucuuugacugcgaucgcuaaccaggccgcaauacugaugggacucgauaaaggcuggccaaucaguaagauggacauuggugucccucugcuugccuuagggugcuacagccaggugaauccgcugacacucaccgcugcaguuuugaugcugguggcccacuaugcgaucauuggccccggacuacaagcuaaagccaccagggaggcacagaagcgcacagccgcuggcaucaugaagaacccaacuguagaugggauaguggccauugaccuggauccugucguuuacgacgcaaaauucgaaaagcagcucggacagaucaugcuucugaucuuguguacgagccaaauucugcucaugcggaccacaugggcucugugcgaguccaucacuuuagccaccggcccccuuacaacccugugggaggguucuccagggaaauuuuggaauacuacgauagcggugucaauggccaacauuuuccgaggaagcuaucucgcaggcgcuggucuagccuucucccugaugaagaguuugggcgggggaagaaggggcacaggggcacagggagaaacccugggcgagaaauggaagcgccagcucaaucagcuuucuaagagcgaauuuaacacuuacaaacggucagguaucauggaggucgacagauccgaagcuaaggaggggcugaaacguggagagaccacaaagcacgccgugaguaggggcacugccaaauugcggugguucguagaacgcaaucuggugaagccugaggguaagguuauugaucucggcugugggcgaggaggcuggagcuauuacugcgcggggcuaaagaaggugaccgaagucaaaggauauacaaagggcggucccgggcaugaggaaccgaucccaauggcuacguacggauggaaccuggugaaacuucacucuggcaaggacgucuuuuucauaccucccgagaaaugugauacccugcuaugcgacaucggcgaguccucaccaaaucccacuauugaagaggggagaacacucagggugcugaagaugguugaaccuugguugcggggaaaccaauuuuguaucaagauucugaauccguacaugcccagcguaguggagacccucgagcagaugcagcgcaaacaugguggcaugcuugucagaaacccacugucgagaaauucuacucacgaaauguauugggugaguugcgggacaggaaacaucguuuccgcagugaauaugaccagccgaauguuacugaaccgguucacgauggcccaccguaagccuaccuacgagagagaugucgacuugggcgcugguacacgccauguggccguagaacccgagguggcaaaccucgauauuaucgggcagaggauagaaaauauuaaacacgagcauaagucaacuuggcacuaugacgaggauaacccuuacaaaaccugggccuaucauggauccuacgaaguuaagccaucuggcagcgcuaguuccauggucaauggcguggugaagcugcuaacaaaacccugggacgucaucccuaugguuacucaaaucgcgaugaccgauacaaccccauuugggcagcagcggguguucaaggagaaaguagacacuagaacgcccaaggccaaacgcggaacaacccaaauuauggaagugacugcaagguggcuuugggguuuucugagccgaaacaagaagccgcggauauguaccagagaggaguucacaaggaaaguccgcucuaaugcugccaucggcgcaguguuuguugacgagaaccaguggaacucagccaaggaggcuguggaagaugagcguuucugggaccucguccaccgggaaagagagcugcacaaacaggggaagugcgccacgugcguguauaacaugaugggaaaaagggaaaagaaguugggcgaguuugguaaagcgaaggggagucgcgcaauuugguacauguggcugggagcccgauuccucgaguucgaagcucuuggcuuuaugaaugaggaucauugguucucccgggaaaacagccugucuggcguagagggggagggauuacacaaacuggguuacaucuugagagacauuucgaagaucccuggcgggaauauguaugccgaugacaccgcaggaugggauacuaggauaacagaagacgaucuccagaacgaggcuaaaaucaccgacauuauggaaccagagcaugcccugcuagcuaaggccaucuuuaaacuuacuuaccaaaauaagguugugcgcguccagagacccgcaaagaacggcacagugauggaugugauuucacggagggaccagcgugguagcgggcaggucggaaccuauggccugaauacauucacuaacauggaagcgcaacucauccgacagauggaguccgagggcauauuuaguccuucugaacuggagaccccaaacuuggccgaacgcguuuuagauuggcuggagaaauacgggguggaaagacucaagcggauggcuauuagcggagacgacuguguagugaaacccaucgaugacagguucgccacggcacuuaccgcucugaaugauauggguaagguccgcaaagacaucccgcagugggagccuuccaagggcuggaacgauuggcagcaagugcccuuuugcucacaccacuuccaucagcuaauuaugaaggacgggagagagauaguugugccaugucggaaucaggaugaacuggucggaagggcccgagugagucagggcgcagguuggucucuccgugagacagccugcuuggggaaaagcuaugcgcaaauguggcagcugauguacuuucacagacgcgaccuucggcuggcugccaacgcaaucuguuccgccguaccuguugauugggugcccacuucaaggaccacauggagcauucaugcucaccaucaguggaugacuaccgaagacaugcucucugucuggaauagaguguggaucgaggaaaacccauggauggaggauaagacgcacauuuccaguugggaggacguucccuauuuaggaaaacgcgaagaccaauggugcggcagccugaucggcuugacagcccgggcaaccugggcuacuaauauacagguggccaucaaccaggucaggcgacugauugggaaugagaacuaccucgauuacaugacaucgaugaagagauucaaaaaugaauccgacccugagggagcgcuuugguga

SEQ ID NO: 14153 - RNA, 9879 nt, Artificial Sequence
  derived and/or modified CDS sequence (opt3) from DENV-1__KC762620__SS-prME
agcgugaccaugcuguucaugcuccuucccacagcccuggcuuuucacuugacuacgagaggaggggaaccucauaugaucgucuccaagcaggaaagaggaaaaucuuuacuguucaagaccucagccgguguuaacaugugcacacuaauugccauggaccucggcgaacugugugaagauacuaugaccuacaaaugcccacggauaacagagaccgaaccggacgauguggacuguuggugcaaugcgacugagacaugggugaccuaugggacguguagucaaacuggagagcaccgccgagauaagcguagcguggcucuugcaccccaugucggccuggguuuggaaaccagaacagagacuuggauguccucugaaggggcauggaaacagauccagaagguggagaccugggcccucaggcacccuggauuuacaguuauugcucuguuccuggcacaugccaucggcaccucgauuacgcagaagggcaucauauuuauccucuuaaugcuggugacuccaucaauggcuaugcggugcgucgggauuggaaaccgcgacuucguggagggucuuagcggcgccacauggguagauguuguguuggaacacgggaguugugucaccacuauggcgaaagacaagcccacacuggauaucgagcuacucaaaaccgaagugacgaauccugcagugcugcggaaacuuugcauugaggccaaaaucuccaacaccacaacugacucuagguguccaacccaaggagaagcuacacuggucgaggagcaggauacuaauuuuguuugccggcgcaccuucguggaccgaggcugggguaacggguguggauuguuuggcaagggcagccucauaacaugcgccaaguucaaaugcguaaccaagcuggaagggaaaauugugcaguacgagaauuuaaaguauuccgucaucgugacuguucacacgggagaucagcaucaaguggguaacgaaacaauugagcacggcaccacugcaaccaucacaccccaggcuccuaccucagaaauccagcugacugacuacggggcccucacacuugacuguaguccaagaacgggacuggauuuuaaugagauggucuugcuaaccaugaaagaaaagagcuggcuggugcauaaacagugguuccucgaccugccgcuucccuggacuucuggcgcguccacaucacaagaaaccuggaacaggcaggaucuguugguaacauuuaagacugcccacgcaaagaaacaggagguugugguccucgguagccaagaaggggcuaugcacaccgcccugacgggcgcuaccgagauucagacaaguggaacuaccacaauauucgccggccauuuaaagugccggcugaaaauggacaagcuaacucucaaaggggugucuuaugucauguguaccggauccuucaagcuggaaaaggagguggcagagacgcagcacgguacaguucuugugcagguaaaauacgaaggcaccgaugccccuugcaagaucccauuuagcucgcaagacgagcguggggucauucagaauggacgcuugaucacugcuaaccccauagugacagauaaagaaaagccuguuaauauugaggcggagccacccuucggcgaaucuuauaucguggucggugcaggggagaaagcccugaagcucuccugguuuaagaaaggcucaaguaucggaaagauguucgaagcuaccgccagaggcgcaaggcggauggccauucugggggacacugcuugggauuuuggaagcaucgguggcguguucaccuccguagggaaacuugugcaucagauuuuuggaacagccuacggcguucuguucucuggugucagcuggacgaugaagauagggaucggcauuuugcucaccuggcugggauuaaacucacgaaauacaagucuguccaugacauguaucgcagugggcauggugacccuauaccucggggucaugguucaggcggacagcggaugcgugaucaacuggaaaggccgcgagcugaagugugguucugggauuuuugugacaaacgaaguacacacuuggaccgagcaauauaaguuccaggcugauucaccgaaaagacuuagugccgcaauaggaaaggccugggaggaaggcgucugcgguaucaggagcgcuacgcgguuggagaauauuauguggaaacagaucuccaacgaacugaaucauauucuccuggagaacgacaugaaguuuacagugguugugggcgacgucucugggaucuuagcccagggcaagaagaugauacgcccucaacccauggaacacaaauacucguggaaguccuggggcaaggcaaaaaucauuggggcugaugugcagaauaccacuuucaucauugacggaccaaacaccccugagugucccgauaaucagagagccuggaacaucugggagguugaagacuauggcuuugguguguucacaacuaauauauggcugaaacuuagggauuccuacacccagguaugcgaccaccguuugaugucagcggccauuaaagauaguaaggcuguccaugcagacaugggguauuggaucgagucugagaagaaugagacauggaagcucgaacgggccagcuucauugaggugaagacguguaucuggccacgaucccacacccuguggucaaauggagugcuagagagcgaaaugauaauccccaaaacuuacggcgguccugucucucaacauaacuauagaccaggcuacuuuacacagaccgcugggccguggcaccugggaaagcucgagcuggauuucgaccuuugcgaaggcacuacaguugugguagaugagaauugcgggaacaggggacccuccuugcgcaccacgacugugaccggcaaaauuauccacgagugguguugccggaguuguacacugccuccauuaagauuuaagggugaagacgggugcugguacggaauggagauuaggcccgucaaagaaaaggaggaaaaucucguaaagagcaugguuucugccggcuccggugagguggauucauucagucugggccuucuguguaucagcauaaugauugaggaagucaugcgcucgcgaugguccgggaaaauguugaugaccggaacucucgcaguguuucugcuacugacaaugggccagcucaccuggaacgaccugauccggcuuugcaucaugguuggggcgaacgccucugacaugaugggaaugggcacaacuuauuuggcucugauggccaccuuccguaugagaccuauguuugcaguggguuuacucuucaggcgccugacgagccgggagguccuucugcuaacaguagggcucucacuggcugccaguguggaauugccaaauucccuggaggaauuaggagauggccucgcaaugggcauuaugaugcugaaacuucugaccgacuuucaaucucaucaguugugggccacucuccugagccuaaccuucguuaaaacaacuuuuucccugcacuacgcuuggaagaccauggcgaugauccuuucaauugugagccucuucccccuguguuugaguacgacaucucagaaaaccacuuggcugccggucuuacucgggucccugggaugcaagccucuuacaaugcuguugauaaccgagaacaagaucugggguagaaggagcuggccaauuaaugagggcaucauggccauugggaucgugucgauacuccugucaucucuacugaaaaacgauguaccccuugcaggaccucucaucgcuggcgguaugcugauugccuguuaugugaucaguggguccagcgccgacuugucuuuagaaaaggcugcagaggucagcugggaagaugaggccgaacauuccggagcgucacacaauauucugguugaggugcaggacgauggcacuaugaaaaucaaggacgaggaacgagaugacacacucaccauacugcuuaaagcuacgcuguuggccauuaguggcguguaccccaugagcaucccagcaacucuauuugucugguauuucuggcaaaagaaaaagcagcgcucuggggugcugugggauaccccuucacccccagagguugaacgggccguacucgacgauggaaucuaccggauucugcagaggggucuuuuaggccguagccaggugggggucggaguguuccaagagggcguuuuucauacaauguggcacgugacccgcggugcuguccugauguaucaggggaagcggcucgagccgaguugggcaagcgugaaaaaggacuugauauccuacggaggcggcuggagauuccaggggucuuggaacacaggagaagagguacaggucaucgccguggaaccugguaaaaaucccaagaacguucaaacuaccccaggcacguuuaaaacaucggagggggaagugggagcgauugcucuggacuucaagcccggcacuagcgguucaccuaucgucaauagggaggggaagauugugggacucuacggcaacggcguugugaccacauccgggaccuaugucagugccaucgcacaggccaaggcuucucaggagggaccacugcccgaaauagaggaugaaguguuucgaaagcggaaucuuacuaucauggaccugcacccugguagcggcaaaacccgcagauacuugccggccauucuaagggaggcaaucaagcggaaacugcgaacacucguauuagcuccaacgagagugguugccuccgaaauggcggaggcccugaaggggaugcccauucgcuaucaaacuaccgcagucaagucagagcauacaggaaaagaaaucguggaucuuaugugccacgcuaccuucacuaugaggcugcucucuccugugcgugucccaaacuacaauaugauaauuauggacgaggcccauuuuacagaucccgcuagcaucgcagcccggggcuauaucaguaccagaguagguaugggggaagccgcugcgauuuucaugacggcaacuccuccgggauccguggaggccuuuccccagagcaacgcuguuauccaggacgaagagagggauauaccagagcgcucuuggaacucaggcuacgacuggauuacagauuucccuggcaagaccgugugguuuguccccuccaucaaaagugggaacgacauugccaacuguuugcgaaagaauggaaaaagagugguucagcugagccggaagaccuucgauacugaauaucaaaagacuaagaacaaugacugggacuacguggucaccacagauaucucggagaugggugcaaacuucagggccgaccgcgugauagauccacguagaugccucaagccuguaauucugaaagacggccccgaacgggugauccuugcugggccaaugccgguuacugucgcgucugccgcacagaggcgcggacgaaucggcagaaauuccaacaaggagggugaucaguacguguauauggggcagccucuaaauaacgacgaggaucacgcucauuggacggaagccaaaaugcuguuggacaauauuaacacccccgagggcaucauuccagcauuauuugaacccgagcgggaaaagagcgccgcuauagauggagaguacaggcugcgcggcgaggccagaaagacauucguggaacucaugaggagaggggaccugccugucuggcuuucauauaaaguugcgagugagggauuucaauacucugaucgucgcuggugcuucgacggugaacgaaauaaccaggugcuggaggaaaauauggauguagagaucuggacuaaggagggcgaaaggaagaagcucaggccacggugguuggacgcacgcaccuauuccgacccccuggcccuaagagaguuuaaagaguucgcugccgggaggcggagcgugucaggagaucugauucucgagaucggcaaacuuccucagcaccugacacagaaagcucaaaacgcauuagacaauuuggucaugcugcacaacagugaacagggugggaaggccuaccgacaugcuauggaggagcucccggauaccaucgaaacucugaugcuucuggcccucauugcaguguugacgggcggaguuacccuguuuuucuuaagcggcagagggcuaggaaagacauccauaggucugcucugugugauggcgucuagcgcccuucuguggauggcuuccgucgagccacacuggaucgccgcaucaauuaucuuggaauuuuuccugaugguacuccugauucccgagccugaccgccagaggacuccccaggauaaccaacuugcuuaugugguuaucggccuccuguuuaugauauugaccguggccgcaaaugagauggggcuguuagaaacaaccaaaaaggaccuaggaaucggccaugccgcugcggagaaccaccaccaugccgcaaugcuggaugucgaccuccacccagcuucugccuggacucuuuacgccguggcaacaacgauuaucaccccuaugaugcggcauacuauugaaaauacaaccgcuaacaucagucugaccgccauagcgaaucaggcugccauuuugaugggucuggauaaaggguggcccaucucgaagauggacauuggcgucccacuccuggcacuuggaugcuacagccaggugaacccuuuaacacugacugccgcuguucucauguugguggcacacuaugccaucauaggcccggggcugcaagcgaaagcuacgcgugaggcccagaagagaaccgcagccggaaucaugaagaaucccacaguagauggcauuguggcuaucgaccuagauccagucguuuacgacgccaaauucgaaaagcagcugggucagauuaugcuccuuauccuguguacuucccaaauauugcugaugaggaccacaugggcacucugcgagucuauuacccuggcuacugggccuuuaacgacacuuugggagggaucacccggcaaauuuuggaacaccacuaucgccgugagcauggcgaauaucuuccgcgguuccuaucuggccggcgcagggcucgcuuucagucuaaugaagucucugggaggcgggcggcgaggaaccggcgcccagggugaaacauugggggagaaauggaagagacagcugaaccagcucagcaagucagaauuuaauauuuacaaaagguccggaaucauggaggucgaccgcagugaagcaaaggagggccuuaaacggggugagacuaccaagcaugcugugagcagaggcacagccaaacugcguugguucguagaaaggaacuuggugaagccagaggggaagguuauagaucugggauguggcagagggggauggucuuauuacugcgccggccucaaaaaggugacggaagucaaagguuauaccaaagggggaccuggccacgaggaacccgugccgauggcgacuuacggcuggaauuuagucaaacugcacuccgggaaggacguguuuuucacaccaccugagaaaugugauacccuucugugcgacauuggagagucaagccccaacccaacuaucgaagagggucgcacacuacgaguucucaagaugguagaacccuggcugagaggcaaucaauuuuguauuaagaucuugaacccuuacaugccgucgguggucgagacccuggagcagaugcagaggaaacaugggggaaugcucgugcggaauccccuuucucgcaacaguacgcacgaaauguauuggguuuccugcggcaccgguaacauagugagcgcugucaauaugacaucaagaaugcuguuaaacagguucacuauggcacaucgaaagccaaccuacgagaaagauguggaccugggggccggaacacggcacguagcuguggaaccugagguugccaauuuggauaucauuggccagcguaucgaaaacauuaagaaugagcacaaauccacuuggcauuaugacgaggauaaccccuacaagaccugggcauaucacggcucuuacgaagucaagccuagcgggagugccuccagcauggugaauggaguggucagacuccugacaaaaccaugggacguuauccccauggugacccaaauugcuaugacugauacgacaccuuuuggucagcagcgcguauucaaggagaaaguggacaccaggacuccaaaggcgaaacggggcaccgcccaaaucauggaagucacagcaaaguggcuauggggguuucuuucuagaaacaagaaaccccgcauauguacgagggaggaguucacccgaaaggugcggucaaaugcugccauuggagcaguuuuuguggacgagaaccaguggaauagugccaaagaggcugucgaagaugagagauucugggaccuggugcauagggaacgcgagcuccacaagcagggcaaaugcgccacuugcguauauaacaugauggguaagcgugaaaagaaacugggggaguuuggaaaggcgaaaggcucccgggcaaucugguacaugugguugggcgccagauuccuggaguucgaagcucucggguuuaugaaugaggaucauugguucagcagggaaaacucucuuucgggaguugagggugagggccugcacaaguuaggguacauccugcgcgacauuucaaaaauaccgggaggcaauuuguaugccgaugacacagcagguugggauacccgaaucacugaagacgaucuccagaacgaggcuaagauuacagacaucauggaaccugagcacgcccugcuagcuaccagcauuuuuaaacuuacauaccaaaacaaggugguccgggugcagagaccagccaagaaugggacugugauggaugucaucuccaggcgcgaccagagaggaaguggccagguuggcaccuaugggcugaacacguucaccaauauggaagcacaacucauacggcagauggagucugagggaaucuuuagccccuccgaacuggagacaccuaacuuggcgaaaaggguguuagauuggcuggaaaagcaugguauugagcgucucaaacgaauggccaucucaggcgacgacuguguagugaagccaauugaugaccgcuucgcuacugcccuuaccgcacugaaugauauggggaaagucagaaaggacaucccccagugggaaccgaguaagggauggaacgauuggcagcaagugccuuuuugcucucaccauuuccaccagcuaauaaugaaagacggccgggagauuguugugcccuguaggaaucaggaugagcugaucggucgcgcuagagucagccagggggccggauggucccuccgggaaacagcaugcuugggcaagucauacgcccaaauguggcagcugauguauuuucacaggcgagaccuucgucuggcggcuaacgccaucuguagcgcagugccaguagauuggguuccuacuucuagaaccacgugguccauucaugcccaccaucaguggaugacaaccgaggacaugcucaguguguggaaucgcgucuggauagaagagaaccccuggauggaagauaaaacucacgugagcucgugggaggacguuccauacuuaggcaagcgggaggaccaauggugcgggucccugaucggauugacagcuagggccaccugggcaucuaauauucagguggcuaucaaccaggucagacgccugauugguaaugaaaacuaucucgauuacaugacuucaaugaaacgguucaagaaugagagcgaccccgaaggcgcccuuugguga

SEQ ID NO: 14154 - RNA, 9879 nt, Artificial Sequence
  derived and/or modified CDS sequence (opt3) from DENV-1__KC762631__SS-prME
agcgugaccaugcugcucaugcuuaugcccaccgcccuggcuuuccacuugacuacgaggggaggggagccucauaugaccgucuccaagcaggaaaggggaaaaucuuuacuguuuaagacgucagccgguguuaauaugugcacucugaucgccauggaccucggcgagcugugugaagauacccuuacguacaaaugcccacggauuaccgaggcggaaccggacgauguggacuguuggugcaaugcuacugauacauggguaaccuaugggacguguagucaaacuggagagcaccgccgagacaagcguagcguggcccuggcaccccaugucggcuugggucucgagaccagaacagaaacuuggauguccucugagggggccuggaaacagauccagaggguggaaaccugggcucugcggcacccuggauucacaguuaucgcacuguuucucgcccaugcuauuggcaccucgaucacgcagaagggcauuaucuucauauuacugaugcuugugacuccaucaauggccaugcgcugcgucgggaucggaagcagagauuuuguggaggguuugaguggcgcgacauggguagacguugugcuggagcacggguccugugucaccacuauggcaaaggauaaacccacacuagacauugaacuccugaagaccgaggugacgaacccugccgugcuuaggaaacugugcaucgaagcuaagauuucuaauaccacaacugauagccgguguccaacccaaggagaggccacauuggucgaagaacaggacgcaaacuucguuugccgccgaacuuuuguggauagaggcugggguaauggguguggacucuucggcaaaggcucccugauaaccugcgcuaaguuuaagugcguaacaaaauuagaggggaagauagugcaguacgaaaaccugaaauauucagucauugugaccguucacacuggagaccagcaucaaguggguaaugagaguacggaacacggcacaaccgccacuaucacaccccaggcgccuacaaccgagauucagcucacugacuacggggcccuuacacuggauuguagcccaaggacgggauuggacuucaacgaaaugguccuacugaccaugaaggagaaaucuuggcucgugcauaagcagugguuucuggaucuuccgcugcccuggacuuccggcgcaucaacaagccaagagaccuggaaucggcaggacuugcucguaacauucaaaacugcucacgccaagaagcaggaaguugugguccuggguagucaagagggggcuaugcacaccgccuuaacgggcgcaaccgaaauccagacaucuggaacuaccacaaucuuugccggccaucugaaaugccgucuaaagauggauaaacucacucugaaggggauguccuaugugauguguaccgggagcuucaaacuugagaaggaagucgcugagacgcagcacgguacaguguugguucagauuaaguacgagggcaccgacgcgccuugcaaaauaccauucucgacucaagaugaaaagggggugacacagaacggacgccugaucaccgcaaaucccauuguaacugacaaagagaagccugucaacaucgaagccgagccacccuuuggcgagucuuauauagugauuggugcuggggaaaaagcccucaagcuguccugguucaagaaaggcucaaguaucggaaagauguuugaggcaaccgccagaggcgcuaggcggauggccauccuuggggauacagcaugggacuucggaagcauugguggcguuuuuacguccguggggaaacugguccaucagaucuucggaaccgcguacggcguguuguuuucugguguaagcuggacuaugaagauugggauaggcgugcuccugacaugguuaggacuaaauucacgaaguaccucccuaagcaugacauguaucgcuguuggccucgucacucuguaccuuggggugauggugcaggccgauucuggaugcgucauuaacuggaaaggccgcgaauugaagugugguucagggaucuucguuaccaaugaggugcacacguggacagaacaauauaaguuucaggcagacaguccgaaaagacugagcgccgcuaucggaaaggccugggaggagggcgugugcgguauuagguccgcaacccggcucgaaaacauaauguggaaacagaucucuaacgagcugaaucauauuuuacuggaaaacgacaugaaguucacuguagucgugggcgauguugcugggauccuugcccagggcaagaagaugauucgcccucaacccauggagcacaaauacucguggaaaagcuggggcaaggcgaagaucauaggggccgacgugcagaauaccacauuuaucauugauggaccaaacacuccugaaugucccgacgaucagagagcuuggaauaucugggaggucgaggacuauggcuucgguauuuuuaccacaaacaucugguugaagcucagggauuccuacacacaggugugcgaccaccgucugaugucagcagccauaaaagauaguaaggcuguucaugccgacaugggguauuggauugaaucugagaaaaaugaaaccuggaagcuagcacgggcgagcuucaucgaggugaagacuuguauuuggccaaaaucccacacacuguggucaaacggaguacucgaaagcgagaugaucauacccaagaucuacggcgguccuauuucucaacauaauuaucgaccaggcuacuucacccagacugccgggccguggcaccugggaaaacuugaguuggauuuugaccugugcgaaggcacaaccgucgugguggaugagcacugcgggaacagaggacccuccuuaaggacgacuaccgucacaggcaagaucauucaugaaugguguugccgcaguuguacccucccuccacugcgguucagaggugaggacgggugcugguacggaauggagaucaggcccguuaaagaaaaggaggaaaaucuugugaaguccaugguaucugcuggcuccggugagguggacucauuuagucugggcuugcucuguauaagcauuaugaucgaagaggucaugcgcucgcgauggucccggaaaaugcugaugacugggacacuagccguguucuuucugcucaucaugggacagcugaccuggaacgaucuuauucguuugugcaucaugguuggcgcaaaugcuucugacagaauggggaugggaacaacuuaucuggccuuaauggcaaccuucaagaugaggccuauguuugccgugggccuccuguuccgccggcuuacgagcagagagguccugcuacucacaauuggucugucauugguggcuaguguugaacugccaaacuccuuagaggaacucggggauggacuggcgaugggcauaaugauccuuaaacuguugaccgacuuucaaucucaccagcucugggccacucugcuaagccugaccuucauuaagacaacuuuuucccuucauuacgcauggaaaaccauggcuauggugcucucaaucgucagccuguuccccuugugucugaguacgacaucucagaagaccacuugguuaccgguacuccugggcucccuugggugcaagccucugacaauguuuuugauugccgagaauaaaaucuggggaagaaagagcuggccacucaacgaagguauaauggccgugggcaucguuucgauucugcuaucaucucugcuuaaaaacgaugugccccucgcugggccucugaucgcaggaggcauguugauugccuguuaugucaucagugguuccagcgcggacuuaucucuggagaaggcugccgaggugagcugggaagaggaagcagagcacuccggggccucacauaauauacucguagaagugcaggaugacggaaccaugaaaauuaaggaugaggagcgagacgauacucugacaauccuucugaaagcuaccuugcuagcagucaguggcguuuacccccugagcaucccagccacacucuucgugugguauuucuggcaaaagaagaaacagcgcucuggcgugcugugggacacuccuucacccccagaagucgagcgggcggugcuugaugacgggauuuacagaauaaugcagaggggauuacugggucguagccagguuggcguagggguguuucaagaaaaccucuuccacaccauguggcacgucacacgcggagcuguguugauguaucagggcaagcggcuggagccgaguugggccagcguuaaaaaggaccucaucuccuacggugggggauggagacugcagggcucuuggaauaccggcgaggaagugcaggucauugcaguggagccugggaaaaaccccaagaauguacaaacagccccaggaacuuuuaagacccccgaaggugaggucggcgcuaucgcccuugauuucaaaccugggacgucgggaagcccaauugugaacagggaaggcaagaucguuggucuguacgggaauggaguggucacaacuucaggcaccuauguguccgcaauagcucaggccaaagcgagucaggagggccccuugccugagaucgaagacgagguuuuucgaaagcggaaccuaacaauuauggaucugcauccggggucuggaaaaacccgcagauaccucccagccaucgugagggaagcaauuaagcggaaguuacgaacucugauccuugcucccaccagagucguggccagcgagauggcugaagcacugaaagguaugccuauacgcuaucaaacaacggccguaaaguccgagcacacuggcaaagagauuguggaccucaugugccaugccaccuucacaaugagguugcugucaccaguucguguccccaauuacaacaugaucaucauggaugaagcucacuuuaccgacccuucuagcauugcggcacggggguauaucaguacuagagugggaaugggcgaggccgcugccauauucaugacagcaaccccgcccgguuccguggaagccuuuccacagagcaaugcugucauucaggaugaggaaagggacaucccugagcgcucuuggaaccucggguacgaguggauuacggauuuccccggaaagacuguaugguuugugccaucaaucaaauccggcaaugacauagcgaacugucugcgaaagaauggcaagagaguuauucagcuuagucggaaaacauucgauaccgaauaucaaaagaccaaaaacaacgacugggacuacguggucacuacagauaucagcgagaugggggccaauuucagggcagaccgcgugaucgauccucguagaugccuaaagcccguuauucugaaagacggaccagaacgggugaucuuggcugguccgaugccugucaccguggccucggcagcccagaggcgcggccgaguagggagaaaccauaauaaggagggagaucaguacauuuauaugggccagcccuuaaacaaugacgaggaucacgcucacuggacagaagccaagaugcugcucgacaacauaaauacuccagaggguaucauucccgcgcuguuugaaccugagcgggaaaaaucugcagccaucgauggggaguacaggcuucgcggcgaggcuagaaagacguucguggaacugaugaggcggggagaccucccaguuugguuguccuauaaagucgccagcgagggcuuucaauacucagaucgucgcuggugcuucgacggggaacgaaacaaucaggugcuggaggaaaacauggauguggagaucuggaccaaggagggagaaaggaaaaagcuaaggccccgguggcuggacgcucgcacauauagugacccucucgcacuuagagaguuuaaagaguucgccgcugguaggcggucugucuccggcgaucugauuuuagagauagggaaguugccgcagcaucugacucagcgagcccaaaaugcacucgacaaccugguuaugcuucacaauagcgaacagggaggcagagcguaccgccaugccauggaggagcugccagaaaccaucgagacacucauguugcuggcuuuaauugccgugcuaaccggugggguaacucuguuuuuccucucaggcaggggacuuggcaagacgaguaucgggcuguugugugugauggcaagcuccguccugcucuggauggcuucuguggaaccccacuggauugccgcaagcaucauacuggaguuuuuccuuaugguucuccugaucccugagcccgaucggcagcguaccccacaggacaaccaauuggccuauguggucauuggacuguuauuuaugauccuaacaguagcugcgaaugaaaugggucugcucgagacuaccaaaaaggaucuuggcauugggcacguggccguugaaaaccaucaccaugcagcuaugcuggacguggauuugcacccugccuccgccuggacacuguacgcagucgcuaccacuaucauaacacccaugaugagacauacgauugagaacaccacugccaauaucucacucacagcgauugcuaaccaggccgcaauccugaugggacuugacaaaggcuggccaauaucuaagauggauaucggugugccuuuacuggcccucgggugcuacagucaggucaauccguugacccugaccgcugcagugcuaaugcugguugcccacuaugcgauuaucggccccggacuccaagcuaaagccacaagggaagcacagaagcgcacugccgcuggcauuaugaagaacccaacgguggacgggaucguagccauagaucuugacccuguggucuacgaugcaaaauucgagaagcagcugggacagauuauguugcugauccucuguaccucgcaaauccuguuaaugcggacaacuugggcucuuugcgagagcauuacccuggccacaggcccccucaccacucuaugggaagguuccccagggaaauuuuggaauacgacaaucgcgguuucuauggccaacauauuccgaggaucauaucuggcaggcgcugguuuggccuucagccugaugaagucccucggcgggggaagaaggggcaccggggcacagggagagacucuuggcgaaaaauggaagcgccagcugaaucaguugaguaagucugaguuuaacaccuacaaacggagcgguauuauggaaguggacagaucagaggcuaaggaggggcugaaacguggagaaacaacuaagcacgccgucuccaggggcaccgccaaacuccggugguucguggagcgcaauuuaguaaagccugaagguaaggugaucgaccugggcugugggcgaggaggcuggaguuauuacugcgcggggcuuaaaaagguuacagaggugaaaggauauacgaagggcggucccgggcaugaagaaccgauuccaauggcuaccuacggauggaaccuggucaaacuacacagcggcaaggauguguuuuucaucccucccgagaaaugugacacucuccugugcgauauaggcgaaucuuccccaaaucccacaaucgaggaagggagaaccuugaggguccugaagaugguggagccuuggcuccggggaaaccaauuuuguauuaagauccuuaauccguacaugcccucaguuguagagacucuggaacagaugcagcgcaaacaugguggcauguuagugagaaacccacugagcagaaauucgacacacgagauguauugggucucuugcgggaccggaaacauugugagugcaguuaauaugacgucccgaauguugcucaaccgguucaccauggcccaccguaagccuacauacgaaagagacguggaucugggcgcugguacucgccaugucgccguggagcccgaaguagcaaaccuagacaucauugggcagaggaucgagaauauaaaacacgagcauaagagcaccuggcacuaugaugaagacaacccuuacaaaacaugggccuaucauggaucauacgaggugaagccauccggcucugcuagcaguaugguuaauggcgucgugaaacuucugacuaaacccugggaugugauuccuauggucacccaaaucgcgaugacagacaccacuccauuugggcagcagcggguuuucaaggaaaaaguggauacgagaacacccaaggccaaacgcggaaccacucaaaucauggagguaaccgcaagguggcucugggguuuucugucccgaaacaagaagccgcggauuuguacaagagaagaguucacgaggaaagugcgcagcaaugcugccauaggcgcagucuuuguggacgagaaccaguggaacucugccaaggaagcuguugaggacgaacguuucugggaguuggugcaccgggaaagagagcugcacaaacaggggaagugcgcaaccugcgucuauaacaugaugggaaaaagggagaagaagcucggcgaauuugguaaagcgaaggggucacgcgcaaucugguacauguggcuuggagcccgauuccuggaguucgaggcuuuaggcuuuaugaaugaggaucauugguucagucgggagaacucccugagcggcguggaaggggagggauugcacaaacucgguuacauucugagagacaucucuaagauuccuggcgggaauauguaugccgaugacacugcaggaugggauacaaggaucaccgaagacgaucuacagaacgaggcuaaaauaacugacaucauggaaccagagcaugcccuucuggcuaaggccauuuuuaaacucacauaccaaaauaagguaguucgcgugcagagacccgcaaagaacggcaccgucauggaugugaucucgcggagggaccagcgugguucaggacaggugggaacauauggccugaauacuuucaccaacauggaggcgcaauugauucgacagauggaaagcgagggcaucuuuuccccuagugaauuagagacgccaaaccuggccgaacgcguccucgauuggcuugagaaauacgggguugagagacugaagcggauggcuauaucuggagacgauugugugguaaaacccauugacgacagguucgccaccgcacuaacagcucugaaugauauggguaaggugcgcaaagacaucccgcagugggaaccuagcaagggcuggaacgauuggcagcaaguccccuuuugcucccaccacuuccaucagcucaucaugaaggacgggagagagauugugguuccaugucggaaucaggaugaauuggugggaagggcccgagucucacagggcgcagguuggagucugcgugagacugccugccuugggaaaucuuaugcgcaaauguggcagcugauguacuuucacagacgcgaccuccgguuagcugccaacgcaauauguagcgccgugccuguagauuggguucccaccuccaggacaacuuggucaauccaugcucaccaucaguggaugaccacggaagacaugcugagcguguggaauagagucuggauugaggagaacccauggauggaagauaagacacacaucucuuccugggaggacgugcccuauuugggaaaacgcgaagaucaauggugcggcagucugauuggccucaccgcccgggcaacuugggcuacaaauauccagguugccauaaaccaggugaggcgacuuaucgggaaugagaacuaccuggacuacaugaccagcaugaagagauucaaaaaugagucggacccugaaggagcgcuaugguga

SEQ ID NO: 14155 - RNA, 9879 nt, Artificial Sequence
  derived and/or modified CDS sequence (opt3) from DENV-1__KC762621__SS-prME
agcgugaccaugcugcucaugcuuaugcccacggcccuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacuggaucguucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuacaucucaacauaauuaucgaccaggcuacuucacccagacugccgggccguggcaccugggaaaacuugaguuggauuuugaccugugcgaaggcacaaccgucgugguggaugagcacugcgggaacagaggacccuccuuaaggacgacuaccgucacaggcaagaucauucaugaaugguguugccgcaguuguacccucccuccacugcgguucagaggugaggacgggugcugguacggaauggagaucaggcccguuaaagaaaaggaggaaaaucuugugaaguccaugguaucugcuggcuccggugagguggacucauuuagucugggcuugcucuguauaagcauuaugaucgaagaggucaugcgcucgcgauggucccggaaaaugcugaugacugggacacuagccguguucuuucugcucaucaugggacagcugaccuggaacgaucuuauucguuugugcaucaugguuggcgcaaaugcuucugacagaauggggaugggaacaacuuaucuggccuuaauggcaaccuucaagaugaggccuauguuugccgugggccuccuguuccgccggcuuacgagcagagagguccugcuacucacaauuggucugucauugguggcuaguguugaacugccaaacuccuuagaggaacucggggauggacuggcgaugggcauaaugauccuuaaacuguugaccgacuuucaaucucaccagcucugggccacucugcuaagccugaccuucauuaagacaacuuuuucccuucauuacgcauggaaaaccauggcuauggugcucucaaucgucagccuguuccccuugugucugaguacgacaucucagaagaccacuugguuaccgguacuccugggcucccuugggugcaagccucugacaauguuuuugauugccgagaauaaaaucuggggaagaaagagcuggccacucaacgaagguauaauggccgugggcaucguuucgauucugcuaucaucucugcuuaaaaacgaugugccccucgcugggccucugaucgcaggaggcauguugauugccuguuaugucaucagugguuccagcgcggacuuaucucuggagaaggcugccgaggugagcugggaagaggaagcagagcacuccggggccucacauaauauacucguagaagugcaggaugacggaaccaugaaaauuaaggaugaggagcgagacgauacucugacaauccuucugaaagcuaccuugcuagcagucaguggcguuuacccccugagcaucccagccacacucuucgugugguauuucuggcaaaagaagaaacagcgcucuggcgugcugugggacacuccuucacccccagaagucgagcgggcggugcuugaugacgggauuuacagaauaaugcagaggggauuacugggucguagccagguuggcguagggguguuucaagaaaacgucuuccacaccauguggcacgugacacgcggagcuguucucauguaucagggcaagcgguuggagccgaguugggccagcgugaaaaaggaccugaucuccuacggugggggauggagacuccagggcucuuggaauaccggcgaggaaguccaggugauugcaguagagccugggaaaaaccccaagaauguccaaacagccccaggaacuuuuaagacccccgaaggugaggugggcgcuaucgcccuggauuucaaaccugggacgucgggaagcccaauuguuaacagggaaggcaagaucgugggucuuuacgggaauggagucgugacaacuucaggcaccuauguuuccgcaauagcucaggccaaagcgagucaggagggcccccugccugagaucgaagacgagguguuucgaaagcggaacuugacaauuauggaucuacauccggggucuggaaaaacccgcagauaccugccagccaucgucagggaagcaauuaagcggaagcuccgaacuuuaauccuggcucccaccagagugguagccagcgagauggcugaagcacuuaaagguaugccuauacgcuaucaaacaacggccgugaaguccgagcacacuggcaaagagauuguugaccugaugugccaugccaccuucacaaugaggcucuugucaccaguccgugugcccaauuacaacaugaucaucauggaugaagcucacuuuaccgacccuucuagcauugcggcacggggguauaucaguacuagagugggaaugggcgaggccgcugccauauucaugacagcaaccccgcccgguuccgucgaagccuuuccacagagcaaugcuguaauucaggaugaggaaagggacaucccugagcgcucuuggaacucaggguacgaguggauuacggauuuccccggaaagacugugugguuuguuccauccaucaaaaguggcaaugacauagcgaacugucugcgaaagaauggcaagagagugauucagcucagccggaaaacauucgauaccgaauaucaaaagaccaaaaacaacgacugggacuacgucgugacuacagauaucucggagaugggggccaauuucagggcagaccgcguuaucgauccucguagaugccugaagcccgugauucuuaaagacggaccagaacgggucauccuagcugguccgaugccugugaccguagccucugcagcccagaggcgcggccgaguggggagaaaccauaauaaggagggagaucaguacauuuauaugggccagccccugaacaaugacgaggaucacgcucacuggacagaagccaagauguuguuagacaacauaaauacuccagaggguaucauucccgcgcuguuugaaccugagcgggaaaaauccgcagccaucgauggggaguacaggcuccgcggcgaggcuagaaagacguucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagaucuggaccaaggagggagaaaggaaaaaguugaggccccgguggcuggacgcucgcacauauucugacccucuagcacugagagaguuuaaagaguucgccgcugguaggcgguccguuagcggcgaucucauucuugagauagggaagcugccgcagcauuuaacucagcgagcccaaaaugcauuggacaaccuggugaugcuccacaauucagaacagggaggcagagcguaccgccaugccauggaggagcugccagauaccaucgaaacacuuaugcugcucgcuuugauugccguacugaccgguggggugacuuuauuuuuccuaaguggcaggggacugggcaagacgagcaucgggcuccuuugugucauggcauccucugugcuguuguggauggcuagcguugagccccacuggauugccgcauccaucauacuggaauuuuuccucauggugcugcuuaucccugagcccgaccggcagcguaccccacaggauaaccaacucgccuaugucguaauuggacuguuguuuaugauccugacaguggcugcgaaugagauggguuuacuagaaacuaccaaaaaggaccugggcauuggguacguugccguggagaaccaccaucacgcagcuaugcucgaugucgaccuucauccugccucagccuggacacuguacgcaguggcuaccacuaucauaacacccaugaugagacacacgauugaaaacaccacugccaauaucucuuugacagcgauugcuaaccaggccgcaauccugaugggacucgauaaaggcuggccaauaaguaagauggacaucggugucccucugcuugccuuagggugcuauagccaggugaauccgcugacccucaccgcugcaguuuugaugcugguggcccauuacgcgauuaucggccccggacuacaagcuaaagccacaagggaggcacagaagcgcacugccgcuggcauuaugaagaacccaacgguagaugggaucguggccauagaccuggauccugucguuuaugacgcaaaauucgaaaagcagcucggacagauuaugcuucugaucuuguguaccagccaaauccugcucaugcggacaacuugggcucugugcgaguccauuaccuuagccacaggcccccuuaccacucugugggaggguucuccagggaaauuuuggaauacgacaaucgcggugucaauggccaacauauuccgaggaagcuaccucgcaggcgcuggucuagccuucucccugaugaagaguuugggcgggggaagaaggggcaccggggcacagggagaaacucugggcgagaaauggaagcgccagcucaaucagcuuucuaagagcgaauuuaacaccuauaaacggucagguauuauggaggucgacagauccgaagcuaaggaggggcugaaacguggagagacaacuaagcacgccgugaguaggggcaccgccaaauugcggugguucguagaacgcaaucuggugaagccugaggguaagguuaucgaucucggcugugggcgaggaggcuggagcuacuauugcgcggggcuaaagaaggugacagaagucaaaggauacacgaagggcggucccgggcacgaggaaccgauuccaauggcuaccuacggauggaaccuggugaaacuucauucuggcaaggacgucuuuuucaucccucccgagaaaugugauacucugcuaugcgacauaggcgaguccucaccaaaucccacaaucgaagaggggagaacccucagggugcugaagaugguugaaccuugguugcggggaaaccaauuuuguauuaagauccugaauccguauaugcccagcguaguggagacucucgagcagaugcagcgcaaacacgguggcaugcuugucagaaacccacugucgagaaauucuacacaugaaauguacugggugaguugcgggaccggaaacauuguuuccgcagugaauaugacgagccgaauguuacugaaccgguucaccauggcccaccguaagccuacauaugagagagaugucgacuugggcgcugguacucgccacguggccguagaacccgagguggcaaaccucgauaucauugggcagaggaucgaaaauauaaaacaugagcacaagucaaccuggcauuacgacgaggauaacccuuauaaaacaugggccuaccacggauccuaugaaguuaagccaucuggcagcgcuaguuccauggucaauggcguggugaagcugcuaacuaaacccugggacgucauuccuaugguuacccaaaucgcgaugacagauaccacuccauuugggcagcagcggguguucaaggagaaaguagacacgagaacacccaaggccaaacgcggaaccacucaaaucauggaagugaccgcaagguggcuuugggguuuucugagccgaaacaagaagccgcggauuuguacaagagaggaguucacgaggaaaguccgcucuaaugcugccauaggcgcaguguuuguugacgagaaccaguggaacucagccaaggaggcuguggaagaugagcguuucugggaccucguccaucgggaaagagagcugcacaaacaggggaagugcgcaaccugcguguacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcguagagggggagggauuacauaaacuggguuauauuuugagagacaucucgaagauuccuggcgggaauauguacgccgaugacacugcaggaugggauacaaggaucaccgaagacgaucuccagaacgaggcuaaaauaacugacaucauggaaccagagcacgcccugcuagcuaaggccauuuuuaaacuuacauaucaaaauaagguugugcgcguccagagacccgcaaagaacggcaccgugauggaugugaucucacggagggaccagcgugguagcgggcaggucggaacauacggccugaauacuuucaccaacauggaagcgcaacucauucgacagauggaguccgagggcaucuuuaguccuucugaacuggagacgccaaacuuggccgaacgcguuuuagauuggcuggagaaauaugggguggaaagacucaagcggauggcuauaagcggagacgacuguguagugaaacccauugaugacagguucgccaccgcacuuacagcucugaaugauauggguaagguccgcaaagacaucccgcagugggagccuuccaagggcuggaacgauuggcagcaagugcccuuuugcucacaucacuuccaccagcuaaucaugaaggacgggagagagauuguugugccaugucggaaucaggaugaacuggucggaagggcccgagugagucagggcgcagguuggucucuccgugagacugccugcuuggggaaaagcuacgcgcaaauguggcagcugauguauuuucauagacgcgaccuucggcuggcugccaacgcaauauguuccgccguaccuguugauugggugcccaccucaaggacaacuuggagcauccacgcucaucaccaguggaugaccacggaagacaugcucucugucuggaauagaguguggauugaggaaaacccauggauggaggauaagacacauguuuccaguugggaggacgugcccuacuuaggaaaacgcgaagaccaauggugcggcagccugaucggcuugaccgcccgggcaacuugggcuacaaauauucaggucgccaucaaccaggugaggcgacugauagggaaugagaacuaccucgauuauaugaccucgaugaagagauucaaaaaugaauccgacccugagggagcgcuuugguga

SEQ ID NO: 14156 - RNA, 9879 nt, Artificial Sequence
  derived and/or modified CDS sequence (opt3) from DENV-1__KC762643__SS-prME
agcgugaccaugcugcucaugcuuaugcccacagcacuggcuuuccacuugacuacgaggggaggggaaccucauaugaucgucuccaagcaggaaaggggaaaaucuuuacuguucaagaccucagccgguguuaauaugugcacacuaauugccauggaccucggcgagcugugugaagauacucuuaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauggcacuguuucucgcccaugcuauuggcacaucgaucacccagaagggcauuaucuucauauuacugaugcuugugacgccaucaauggccaugcgcugcgucgggaucggaagcagagauuuuguggaggguuugaguggcgcgacuuggguagacguugugcuggagcacggguccugugucacaaccauggcaaaggauaaacccacucuagacauugaacuccugaagacagaggugaccaacccugccgugcuuaggaaacugugcaucgaagcuaagauuucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugaucacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggaucguucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguucugacauccguggggaaauugguccaucagaucuuuggaacggcguacggcguacucuucucugguguaagcuggaccaugaagauugggauaggcgugcuguuaacuuggcugggacuaaauucacgaaguacaucccucagcaugaccuguaucgcuguuggccuggucacacuuuacuugggggugauggugcaggccgauucuggaugcgucauuaacuggaaaggccgcgaacugaagugugguucagggaucuuuguuacuaaugaggugcacaccuggacggaacaauauaaguuccaggcagacaguccgaaaagacucagcgccgcuaucggaaaggccugggaggagggcgugugcgguauuagguccgcaacacggcuggaaaacauaauguggaaacagaucucuaacgaguuaaaucauauucugcuugaaaacgacaugaaguuuaccguagucgugggcgauguugcugggaucuuggcccagggcaaaaagaugauucgcccucaacccauggagcacaaauacucguggaaaagcuggggcaaggcgaagaucauaggggccgacgugcagaauacuaccuucaucauugauggaccaaacacaccugaaugucccgacgaucagagagcuuggaauaucugggaggucgaggacuauggcuuugguauuuucacuaccaacaucuggcucaagcugagggauuccuacacacaggugugcgaccaccgucuaaugucagcagccauaaaagauaguaaggcuguucaugccgacaugggguauuggauugaaucugagaaaaaugaaacguggaagcuggcacgggcgagcuuuaucgaggugaagaccuguauuuggccaaaaucccacacucucuggucaaacggaguacuggaaagcgagaugaucauacccaagaucuacggcgguccuacaucucaacauaauuaucgaccaggcuacuucacccagacugccgggccguggcaccuuggaaaauuggagcuggauuucgacuuaugcgaaggcacaaccgucgugguggaugagcacugcgggaacagaggacccucccucaggacgacuaccgucacaggcaagauuauccaugaaugguguugccgcaguuguacccugccuccacuucgguuuagaggugaggacgggugcugguacggaauggagauuaggcccguuaaagaaaaggaggaaaaucuggugaaguccaugguaucugcuggcuccggugagguggacucauucaguuugggccuccuguguaucagcauaaugauugaagaggucaugcgcucgcgauggucccggaaaaugcuaaugacugggacacuggccguguuuuuccuccugaucaugggacagcuuaccuggaacgauuugauccgucugugcauuaugguuggcgcaaaugcuucugacagaauggggaugggaacaacuuauuuagcccucauggcaaccuuuaagaugaggccuauguucgccgugggccugcuuuuucgccggcugacgagcagagagguccuacuccugacaaucgguuugucacugguggcuaguguugaauuaccaaacucccucgaggaacugggggauggacuugcgaugggcauuaugauacugaaauugcucaccgacuuccaaucucaccagcugugggccacucuacugagccuuaccuuuaucaagacaacuuucucccuccauuacgcauggaaaaccauggcuauggugcugucaauugucagcuuguuuccccuguguuuaaguacgacaucucagaagaccacuuggcucccgguacugcuuggcucccuggggugcaagccuuugacaauguuccucaucgccgagaauaaaauuuggggaagaaagagcuggccacugaacgaagguaucauggccgugggcauaguuucgauccuacugucaucucuucucaaaaacgaugugccccuggcugggccuuugauugcaggaggcauguuaaucgccuguuaugucauuagugguuccagcgcggaccugucucucgagaaggcugccgaggugagcugggaagaggaagcagagcacuccggggccucacauaauauccugguagaagugcaggaugacggaaccaugaaaauaaaggaugaggagcgagacgauacucuuacaauucuguugaaagcuacccuacuggcagucaguggcguuuacccccucagcaucccagccacgcuguuugugugguauuucuggcaaaagaagaaacagcgcucuggcgugcuuugggacacuccuucacccccagaagucgagcgggcgguguuagaugacgggaucuacagaauuaugcagaggggacugcucggucguagccagguuggcguagggguguuccaagaaaacgucuuucacaccauguggcacgugacacgcggagcuguuuugauguaucagggcaagcggcuggagccgaguugggccagcgugaaaaaggaccucauauccuacggugggggauggagacugcagggcucuuggaauaccggcgaggaaguccaggugaucgcaguagagccugggaaaaaccccaagaauguccaaacagccccaggaacuuucaagacccccgaaggugaggugggcgcuauugcccuugauuuuaaaccugggacgucgggaagcccaaucguuaacagggaaggcaagauugugggucuguacgggaauggagucgugacaacuucaggcaccuauguuuccgcaaucgcucaggccaaagcgagucaggagggccccuugccugagauagaagacgagguguuccgaaagcggaaccuaacaaucauggaucugcauccggggucuggaaaaacccgcagauaccucccagccauugucagggaagcaaucaagcggaaguuacgaacucugauucuugcucccaccagagugguagccagcgagauggcugaagcacugaaagguaugccuauccgcuaucaaacaacggccgugaaguccgagcacacuggcaaagagauaguugaccucaugugccaugccaccuuuacaaugagguugcugucaccaguccgugugcccaauuacaacaugauuaucauggaugaagcucacuucaccgacccuucuagcaucgcggcacggggguauauuaguacuagagugggaaugggcgaggccgcugccaucuuuaugacagcaaccccgcccgguuccgucgaagccuucccacagagcaaugcuguaauacaggaugaggaaagggacauuccugagcgcucuuggaacucaggguacgaguggaucacggauuuucccggaaagacugugugguucguuccauccauuaaaaguggcaaugacaucgcgaacugucuccgaaagaauggcaagagagugauacagcugagccggaaaacauuugauaccgaauaucaaaagaccaaaaacaacgacugggacuacgucgugacuacagauauuucggagaugggggccaauuucagggcagaccgcguuaucgauccucguagaugccuuaagcccgugauccuaaaagacggaccagaacgggucauucuggcugguccgaugccugugaccguagccucugcagcccagaggcgcggccgaguggggagaaaccauaauaaggagggagaucaguacaucuauaugggccagcccuugaacaaugacgaggaucacgcucacuggacagaagccaagauguuacuggacaacauuaauacuccagaggguauaauccccgcgcucuuugaaccugagcgggaaaaauccgcagccauugauggggaguacaggcugcgcggcgaggcuagaaagacguuuguugaacuuaugaggcggggagaccugccagucuggcucagcuauaaaguggccucagagggcuuccaauacagugaucgucgcuggugcuuugacggggaacgaaacaaucagguguuggaggaaaacauggaugucgagaucuggaccaaggagggagaaaggaaaaagcugaggccccgguggcuagacgcucgcacauauucugacccucuggcacucagagaguucaaagaauuugccgcugguaggcgguccguuagcggcgaucuuauccuggagauugggaaguuaccgcagcauuugacucagcgagcccaaaaugcacuggacaaccucgugaugcugcacaauucagaacagggaggcagagcguaccgccaugccauggaggagcuuccagauaccauagaaacacugaugcucuuggcucugaucgccguauuaaccgguggggugacucuauucuuucugaguggcaggggacucggcaagacgagcauugggcuucugugugucauggcauccucuguguugcuguggauggcuagcguugagccccacuggaucgccgcauccauuauccucgaguucuuucugauggugcuucucauaccugagcccgaccggcagcguaccccacaggauaaccaacuggccuaugucguaaucggauugcuguucaugauuuuaacaguggcugcgaaugagaugggucuacuggaaacuaccaaaaaggaccucggcaucgggcacguugccguggagaaccaucaccaugcagcuaugcuugaugucgaccugcacccugccucagccuggacauuguacgcaguggcuaccacuauuaucacacccaugaugagacauacgauagaaaacaccacugccaauauuucucugacagcgaucgcuaaccaggccgcaauucucaugggacuggauaaaggcuggccaaucaguaagauggacauaggugucccucuuuuagcccuggggugcuacagccaggugaauccgcucaccuugaccgcugcaguucugaugcuaguggcccacuaugcgaucauuggccccggacugcaagcuaaagccacaagggaggcacagaagcgcacugccgcuggcaucaugaagaacccaacgguagaugggauuguggccaucgaccucgauccugucguuuacgacgcaaaauuugaaaagcagcuuggacagauaaugcuguugauucuguguaccagccaaauccuccugaugcggacaacuugggcuuuaugcgaguccaucacccuugccacaggcccccugaccacucucugggaggguucuccagggaaauucuggaauacgacaauugcggugucaauggccaacaucuuucgaggaagcuaucuagcaggcgcuggucuggccuucuccuugaugaagagucugggcgggggaagaaggggcaccggggcacagggagaaacucucggcgagaaauggaagcgccagcuuaaucagcugucuaagagcgaguucaacaccuacaaacggucagguauaauggaggucgacagauccgaagcuaaggagggguugaaacguggagagacaacuaagcacgccgugaguaggggcaccgccaaacugcggugguuuguagaacgcaaucucgugaagccugaggguaagguuauugauuuaggcugugggcgaggaggcuggagcuauuacugcgcggggcugaaaaaggugacagaagucaaaggauauacgaagggcggucccgggcaugaggaaccgaucccaauggcuaccuacggauggaaccuugugaaacugcacucuggcaaggacgucuucuuuauuccucccgagaaaugugauacucuacucugcgacaucggcgaguccucaccaaaucccacaauagaagaggggagaacccugaggguguugaagaugguugaaccuuggcugcggggaaaccaauucuguaucaagauucucaauccguacaugcccagcguaguggagacucuugagcagaugcagcgcaaacaugguggcaugcuggucagaaacccauuaucgagaaauucuacacacgaaauguauugggugaguugcgggaccggaaacaucguuuccgcagugaauaugacgagccgaaugcuguugaaccgguuuaccauggcccaccguaagccuacauacgagagagaugucgaccucggcgcugguacucgccauguggccguagaacccgagguggcaaaccuggauauuaucgggcagaggauugaaaauaucaaacacgagcauaagucaaccuggcacuaugacgaggauaacccuuacaaaacaugggccuaucauggauccuacgaaguuaagccaucuggcagcgcuaguuccauggucaauggcguggugaagcuacuuacuaaacccugggacgucauaccuaugguuacccaaauugcgaugacagauaccacuccauucgggcagcagcggguguuuaaggagaaaguagacacgagaacacccaaggccaaacgcggaaccacucaaaucauggaagugaccgcaagguggcugugggguuuccucagccgaaacaagaagccgcggaucuguacaagagaggaauuuauuaggaaaguccgcucuaaugcugccauaggcgcaguguucguugacgagaaccaguggaacucagccaaggaggcuguggaagaugagcguuuuugggaccugguccaccgggaaagagaguugcacaaacaggggaagugcgccacgugcguguauaacaugaugggaaaaagggaaaagaagcugggcgaguucgguaaagcgaaggggagucgcgcaaucugguacauguggcucggagcccgauuucuugaguucgaagcucugggcuucaugaaugaggaucauugguuuucccgggaaaacagcuuaucuggcguagagggggagggacugcacaaauuggguuacauucucagagacaucucgaagauuccuggcgggaauauguaugccgaugacaccgcaggaugggauacuaggaucacagaagacgaucugcagaacgaggcuaaaauaaccgacaucauggaaccagagcaugcccuacuugcuaaggccauuuucaaacugacuuaccaaaauaagguugugcgcguccagagacccgcaaagaacggcacagugauggaugugaucucacggagggaccagcgugguagcgggcaggucggaaccuauggccucaauacauuuacuaacauggaagcgcaacugauucgacagauggaguccgagggcaucuucaguccuucugaauuggagaccccaaacuuagccgaacgcguucuggauuggcucgagaaauacgggguggaaagacuuaagcggauggcuauaagcggagacgacuguguagugaaacccauugaugacagguuugccacggcacugaccgcucuaaaugauauggguaagguccgcaaagacaucccgcagugggagccuuccaagggcuggaacgauuggcagcaagugcccuucugcucacaccacuuucaucagcugaucaugaaggacgggagagagauuguugugccaugucggaaucaggaugaacucgucggaagggcccgagugagucagggcgcagguuggucuuugcgugagacagccugccuggggaaaagcuaugcgcaaauguggcagcuuauguacuuccacagacgcgaccugcggcucgcugccaacgcaauauguuccgccguaccuguugauugggugcccacuucaaggaccacauggagcauccaugcucaccaucaguggaugacuaccgaagacauguuaucugucuggaauagaguguggauugaggaaaacccauggauggaggauaaggcccacguuuccaguugggaggacgugcccuaucugggaaaacgcgaagaccaauggugcggcagcuugaucggccugacggcacgggcuacaugggccaccaauauucaggucgcgaucaaccaggugaggcgacucauagggaaugagaacuaccuugauuacaugacuucgaugaagagauuuaaaaaugaauccgacccugagggagcucugugguga

SEQ ID NO: 14157 - RNA, 9879 nt, Artificial Sequence
  derived and/or modified CDS sequence (opt3) from DENV-1__KC762651__SS-prME
agcgugaccaugcuguucaugcuccuucccaccgcccuggcuuuucacuugacuacgcggggaggggaaccucauaugaucguauccaagcaggaaagaggaaaaucuuuacuguucaagaccucagccgguguuaacaugugcacauuaauugccauggaccucggcgaacugugugaagauacuaugaccuacaaaugcccacggauaacagagaccgaaccggacgauguggacuguuggugcaaugcgacugagacauggguaaccuaugggacguguagucaaacuggagagcaccgccgagauaagcguagcguggcucuugcaccccaugucggccuggguuuggaaaccagaacagagacuuggauguccucugaaggggcauggaaacagauccagaagguggagaccugggcccucaggcacccuggauuuacaguuauugcucuguuccuggcacaugccaucggcaccucgauuacgcagaagggcaucauauuuauccucuuaaugcuggugacuccaucaauggcuaugcggugcgucgggauuggaaaccgcgacuucguggagggucuuagcggcgccacauggguagauguuguguuggaacacgggaguugugucaccacuauggcgaaagacaagcccacacuggauaucgagcuacucaaaaccgaagugacgaauccugcagugcugagaaaacuuugcauugaggccaaaaucuccaacaccacaacugacucuagguguccaacccaaggagaagcuacacuggucgaggagcaggauacuaauuuuguuugccggcgcaccuucguggaccgaggcugggguaacggguguggauuguuuggcaagggcagccucauaacaugcgccaaguucaaaugcguaaccaagcuggaagggaaaauugugcaguacgagaauuuaaaguauuccgucaucgugacuguucacacgggagaucagcaucaaguggguaacgaaacaaccgagcacggcacuaccgcaacaauuacaccccaggcuccuacuucagaaauccagcugacagacuacggggcccucacgcuugacuguaguccacggaccggacuggauuuuaaugagauggucuugcuaacuaugaaagaaaagagcuggcuggugcauaaacagugguuccucgaccugccgcuucccuggacaucuggcgcguccaccucacaagaaacauggaacaggcaggaucuguugguaacuuuuaagaccgcccacgcaaagaaacaggagguugugguccucgguagccaagaaggggcuaugcacacggcccugaccggcgcuacagagauccagacaaguggaaccacaacuauuuucgccggccauuuaaagugccggcugaaaauggacaagcuaacccucaaaggggugucuuaugucauguguacgggauccuucaagcuggaaaaggagguggcagagacacagcacgguaccguucuugugcagguaaaauacgaaggcacugaugccccuugcaagauaccauuuagcucgcaagacgagcguggggucauccagaauggacgcuugauuacagcuaaccccaucgugaccgauaaagaaaagccuguuaauauagaggcggagccacccuucggcgaaucuuauauuguggucggugcaggggagaaagcccugaagcucuccugguuuaagaaaggcucaaguaucggaaagauguucgaagcuacugccagaggcgcaaggcggauggccauccugggggacaccgcuugggauuuuggaagcauugguggcguguucacauccguagggaaacuugugcaucagaucuuuggaacggccuacggcguucuguucucuggugucagcuggaccaugaagauugggauaggcaucuugcucacuuggcugggauuaaacucacgaaguacaucccugagcaugaccuguauugcagugggcauggugacacuauaccucggggucaugguucaggcggacucuggaugcgugaucaauuggaaaggccgcgagcugaagugugguucagggaucuuugugacuaacgaaguacacaccuggacggagcaauauaaguuccaggcugauaguccgaaaagacuuagcgccgcaauuggaaaggccugggaggaaggcgucugcgguauaagguccgcuacacgguuggagaacaucauguggaaacagauuucuaaugaacugaaccauauccuccuggagaaugacaugaaguuuaccgugguugugggcgacgucucggggauuuuagcccagggcaagaagaugauccgcccucaacccauggaacacaaauacagcuggaaguccuggggcaaggcaaaaauaaucggggcugaugugcagaacacuaccuucauuaucgacggaccaaauacaccugagugucccgauaaccagagagccuggaauauuugggagguugaagacuauggcuuugguguguucacuaccaacaucuggcugaaacuuagggauucauacacacagguaugcgaccaccguuugaugagugcggccauaaaagauucuaaggcuguccaugcagacaugggguauuggauugagagcgagaagaaugagacguggaagcucgaacgggccuccuucaucgaggugaagaccuguauuuggccacgaucacacacucuguggagcaacggagugcuagagucugaaaugaucauacccaaaacauacggcgguccugucucccaacauaauuauagaccaggcuacuuuacccagacugcugggccguggcaccugggaaagcucgagcuggauuucaaccuuugcgaaggcacaaccguugugguagacgagaauugcgggaacaggggacccaguuugcgcacgacuaccgugacaggcaaaaucauucacgagugguguugccggagcuguacccugccuccauuaagauuuaagggugaagaugggugcugguacggaauggagaucaggcccgucaaagaaaaggaggaaaaucucgugaagucuaugguuuccgccggcucaggugagguggacaguuucagccugggccuucuguguauuucgaucaugauagaggaagucaugcgcucccgauggucugggaaaauguugaugacuggaacacucgcaguguuucugcuacugaccaugggccagcucacauggaacgaucugauucggcuuugcaucaugguuggggcgaacgccagcgacaugaugggaaugggcacuaccuauuuggcucugauggccacguuccguaugagaccuauguuugcaguggguuuacucuucaggcgccugacaucacgggagguccuucugcuaaccguagggcucagucugguggcuuccguugaauugccaaauucucuggaggaauuaggagacggccucgccaugggcaucaugaugcugaaacuucugacugauuuucaaagccaucaguugugggcaacccuccugucccuaacauucgugaaaacugccuuuucacugcacuacgcuuggaagaccauggcgaugauucuuagcaucgucagucucuucccccuguguuugucuacgacaucccagaaaaccacuuggcugccgguguuacucgggagccugggaugcaagccucuuacaaugcuguugauuaccgagaacaagauaugggguagaaggucguggccacucaaugagggcaucauggccauugggaucguaucaauucugcuaucuagucugcuuaaaaacgacgugccccucgcaggaccucugaucgcuggcgguauguugauagccuguuaugucaucuccgggagcucugccgauuuaagccuggaaaaggcugcagagguuuccugggaagacgaggccgaacauucaggagcgagucacaauauucucguggaggugcaggaugacggcacuaugaaaaucaaggaugaggaacgagacgauacacugaccauucuucugaaagcuacguugcuagccaucagcggcgucuaccccaugucuauaccagcaacucuguuugugugguauuucuggcaaaagaaaaagcagcgcuccgggguucucugggacaccccuucacccccagagguagaacgggccgugcuggaugacggaauuuacagaauccuucagagggguuuacugggccguagucaggucggggugggaguuuuccaagagggcguguuucauacaauguggcacgucacccgcggugcugugcucauguaucaggggaagcgguuggagccgagcugggcauccgucaagaaggaucugaucucuuacggaggcggcuggagauuccaggggucguggaacacaggagaagagguccaggugauugccguugaaccugguaaaaaucccaagaacgugcaaacuaccccaggcacguuuaaaacaagcgagggggaagucggagcgauagcucucgacuucaagcccggcacuucagguuccccuaucgugaauagggaggggaagauuguuggacuguacggcaacggcguggucaccacaagugggaccuaugugucugccaucgcacaggccaaagcuagccaggagggaccacuucccgaaauugaggacgaaguauuucgaaagcggaaucugacuaucauggauuugcacccugguuccggcaaaacccgcagauaccuaccggccauacugagggaggcaaucaagcggaaacuccgaacauuagugcuggcuccaacgagaguugucgccucagaaauggcggaggcccuuaaggggaugcccauucgcuaucaaacuaccgcagugaagucugagcauacaggaaaagaaaucguggaccugaugugccacgcuaccuucacuaugaggcucuugagcccuguccguguaccaaacuacaauaugauuaucauggaugaggcccauuuuacagaccccgcuaguauagcagcccggggcuauauuuccaccagaguggguaugggggaagccgcugcgaucuucaugacggcaacuccuccgggaagcguugaggccuuuccccagucuaacgcugugauccaggaugaagagagggacauuccagagcgcucauggaacuccggcuacgauuggaucacagacuucccuggcaagaccgucugguuugugcccaguauaaaaagcgggaacgauauugccaacugucugcgaaagaauggaaaaagaguugugcagcucucgcggaagaccuucgacacugaauaucaaaagacuaagaauaaugauugggacuacgucgugaccacagacaucucugagaugggugcaaacuucagggccgaucgcguaauugacccacguagaugccugaagccugugauccuuaaagauggccccgaacggguuauacuagcugggccaaugccggucacuguggcguccgccgcacagaggcgcggacgaauuggcagaaauccuaacaaggagggugaccaguacguguauauggggcagccccugaauaacgaugaggaccacgcucauuggacggaagccaaaauguuguuagauaauaucaacaccccagagggcaucauucccgcacuguuugaaccugagcgggaaaagagcgccgcuaucgacggagaguacaggcuccgcggcgaggccagaaagacauucgucgaacugaugaggagaggggaucuuccaguuuggcugucauauaaaguggcgagugagggauuucaauacucugaccgucgcuggugcuucgauggugaacgaaauaaccagguacucgaggaaaauauggacguggagauuuggacuaaggagggcgaaaggaaaaaguugaggccccgguggcuggaugcacgcaccuauuccgacccucuagcccugagagaguuuaaagaguucgcugccgggaggcggagcgucucaggagaccucauacuugagaucggcaagcugccgcagcacuuaacacagaaagcucaaaacgcauuggauaaucuggugaugcuccacaacagugaacagggugggaaggccuaccgacaugcuauggaggagcugccagacaccauugaaacucuuaugcugcucgccuugaucgcaguucugacgggcggagugaccuuauuuuuccuaagcggcagagggcugggaaagacauccaucggucuccuuugugucauggcgucuagcgcccuguuguggauggcuuccguagagccccacuggauugccgcaucaauaauccuggaauuuuuccucauggugcugcuuauuccugagcccgaucgccagaggacuccacaggacaaccaacucgcuuauguugugaucggccuguuguuuaugauucugaccgucgccgcaaaugagaugggguuacuagaaacaaccaaaaaggaucugggaaucggccaugccgcugcggagaaccaccaccaugccgcaaugcucgacguggaucuucacccugcuucugccuggacucuguacgccgucgcaacaacgauaaucacccccaugaugcggcauacuauugaaaauacaaccgcuaacaucaguuugaccgccauugcgaaucaggcugccauccugaugggucucgacaaaggguggccaauaucgaagauggauauuggcgugccucugcuugcauuaggaugcuacagccagguuaacccgcugacacucacugccgcuguguugaugcugguagcacacuaugccaucauuggccccgggcuacaagcgaaagcuacgcgugaggcccagaagagaaccgcagccggaaucaugaagaauccaacaguggacggcauagucgcuaucgaucuggacccuguuguguacgaugccaaauucgaaaagcagcucggucagauuaugcuucugaucuuguguacuucccaaauucugcucaugaggaccacaugggcacugugcgagucuaucaccuuagcuacugggccccuuacgacacugugggagggaucaccaggcaaauuuuggaacaccacuauagccgucagcauggcgaauauuuuccgcgguuccuaucucgccggcgcagggcuagcuuucagucugaugaagucuuugggaggcgggcggcgaggaaccggcgcccagggugaaacacugggggagaaauggaagagacagcucaaccagcuuagcaagucagaauuuaauaucuacaaaagguccggaaucauggagguggaccgcagugaagcaaaggagggccugaaacggggugagacuaccaagcaugcuguaagcagaggcacagccaaauugcguugguucguggaaaggaaccugguuaagccugaggggaaggugauugaccucggauguggcagagggggauggucuuauuacugcgccggccugaaaaaggucacggaagugaaagguuauaccaaagggggacccggccacgaggaaccggucccaauggcgacuuacggcuggaaucuagugaaacuucacuccgggaaggauguauuuuucacaccucccgagaaaugugacacccugcuaugcgauaucggagagucaagcccaaaccccacuauagaagagggucgcacacuccgaguucugaagaugguggaaccuugguugagaggcaaucaauuuuguauuaagauccugaacccguacaugcccucggucguggagacccucgagcagaugcagaggaaacaugggggaaugcuuguucggaauccacugucucgcaacaguacgcacgaaauguauuggguguccugcggcaccgguaacauugucagcgcugugaauaugacaucaagaauguuacugaacagguucacuauggcacaucgaaagccuaccuacgagcgggacguagauuugggggccggaacacgucacguggcuguugaacccgaggucgccaaucucgacaucauaggccagagaaucgaaaacauuaaaaaugagcacaaguccacuuggcauuaugaugaggacaacccuuacaaaaccugggcauaucacggcucuuacgaagugaagccaagcgggagugccuccagcauggugaauggagucguucgccugcuaacaaagcccugggaugugaucccuaugguaacccaaauugcuaugacugacacgacaccauuuggucagcagaggguguucaaagagaaggucgauacccggacucccaaagcgaagagaggcaccgcccaaaucauggaagugacagcaaaauggcuuuggggguuucugucucgcaacaagaagccgaggauuuguacgcgagaggaguucacccggaaaguuagaucaaaugcugccaucggagcaguguuugucgacgagaaccaguggaauagugccaaggaggcuguggaagacgagagguucugggaucucguacaucgcgaacgugagcugcacaaacagggcaagugcgccacuugcguuuauaacaugauggguaaacgggaaaagaaguugggggaguuuggaaaagcgaagggcuccagagcaauaugguacauguggcugggcgccagguuccucgaguucgaagcucuuggguuuaugaaugaggaccauugguucagccgcgaaaacucucugucgggaguggagggugagggcuuacacaaacugggguacauuuugcgagauaucucaaagaucccuggaggcaaucucuaugccgacgauacagcagguugggacacccggauuacugaagaugaccugcagaacgaggcuaaaauaacagauaucauggaaccagagcacgcccuacuugcuaccagcauuuuuaagcugacauaccaaaacaaagucgugagagugcagaggcccgccaagaaugggacugucauggacguuaucucccgcagagaucagcggggaaguggccaggugggcaccuaugggcucaacacguucaccaauauggaagcacaacugauuaggcagauggagucugagggaaucuuuagcccuuccgaauuggagacaccaaacuuagcgaagcguguacuggacuggcucgaaaaacaugguauagagcgacuuaagcgcauggccaucucaggcgaugacuguguggucaaacccauugacgauagauucgcuacugcccugaccgcacuaaaugacauggggaaggugcggaaagauaucccgcagugggaaccuaguaagggauggaacgacuggcagcaaguucccuuuugcucucaccauuuccaccagcugauuaugaaggauggcagggagaucguggucccaugucgcaaucaggacgagcucauagguagagcucgggugagccagggggccggaugguccuugagggaaacagcaugccugggcaaaucauacgcccaaauguggcagcuuauguauuuucaccgacgugaucugagacucgcggcuaacgccauuuguagcgcaguaccuguugacugggugcccacuucucgcaccacgugguccauccaugcccaccaucaguggaugacaaccgaggauauguuaagugucuggaaucggguguggaucgaagagaacccauggauggaagacaagacucacguuagcucgugggaggaugugcccuaccugggcaaaagggaggaccaauggugcggguccuugauuggacugacagcuagagccaccugggcaucuaauauacaggucgcuaucaaccaggugcgccggcucauugguaaugaaaacuaucuugacuacaugacuucaaugaagagguucaaaaaugagagcgauccugaaggcgcccugugguga

SEQ ID NO: 14158 - RNA, 9879 nt, Artificial Sequence
  derived and/or modified CDS sequence (opt3) from DENV-1__KC762653__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagagaccgaaccggacgauguggacuguuggugcaaugcgacugagacauggguaaccuaugggacguguuaccaaacuggagagcaccgccgagauaagcguaguguggcucuggccccccaugucggcuugggucucgaaaccagaacagagacuuggaugagcuccgaaggggcauggaggcagauccagaaaguggagaccugggcccugcggcacccuggauucacaguuauugcucuguuucucgcacaugccaucggcaccucuauuacgcagaagggcaucauauucaucuuacugaugcuugugacuccaucgauggcuaugcgcugcgucgggauuggaaacagagacuuuguggaggguuugucaggcgccacauggguagauguugugcuggaacacgggagcugugucaccacuauggcgaaggacaaacccacacuagauaucgagcuccugaagaccgaagugacgaauccugcagugcuuaggaaacugugcauugaggccaagaucaguaacaccacaacugacucccgguguccaacccaaggagaagcuacauuggucgaggagcaggauacuaauuucguuugccgccgaaccuuuguggacagaggcugggguaacggguguggacucuucggcaaaggcucucugauaacaugcgccaaguuuaagugcguaaccaaauuagaagggaagauugugcaguaugagaaucugaaauacagcgucaucgugacuguucacacgggagaucagcaucaaguggguaacgaaacaaccgagcacggcacuaccgcaacaauuaccccccaggcuccuacuuccgaaauccagcucacagacuauggggcccuuacgcuggacuguucaccaaggaccggauuggauuucaaugagaugguccuacugacuaugaaggagaaaaguuggcucgugcauaagcagugguuucuggaccuuccgcugcccuggacaagcggcgcgucuaccucccaagaaacauggaaccggcaggauuugcucguaacuuucaaaaccgcccacgcaaagaagcaggagguugugguccuggguucacaagaaggggcuaugcacacggccuuaaccggcgcuacagagauccagacuagcggaaccacaacuauuuuugccggccaucugaaaugccgucuaaagauggacaaacucacccugaaggggaugaguuacgugauguguacgggaucuuucaaacuugaaaaggaggucgcagagacacagcacgguaccguguugguucaggugaaguaugaaggcacugaugccccuugcaaaauaccauucuccagccaagacgagaaggggguaacacagaauggacgccugaucaccgcuaaccccauugucacugauaaagaaaagccugugaauaucgaggcggagccacccuuuggcgaaucguaccucguugugggugcaggggagaaagcccugaagcuuucuugguucaagaaaggcuccucaauaggaaagauguuugaagcuaccgccagaggcgcaaggcggauggccauucugggggacacagcuugggauuucggaaguaucgguggcgucuuuacgagcguggggaaauugauccaucagauuuucggaaccgccuacggcguacucuuuuccggugugucuuggacuaugaagaucgggauuggcauacuguuaacauggcugggacuaaacagccgaucaaccagucucuccaugacauguaucgcaguuggcaugauuacucuguaucuuggggucauggugcaggcggacagcggaugcgugaucaauuggaaaggccgcgaguugaagugugguucugggaucuucgucaccaacgaaguucacacguggacagagcaauacaaguuucaggcugauucaccgaaaagacugagugccgcaauuggaaaggccugggaggaaggcgugugcgguauaaggagcgcuacccggcucgagaacaucauguggaaacagauuuccaaugaacugaaccauaucuuacuggagaaugacaugaaguucacugugguagucggcgaagugaacgggauucuugcccagggaaaaaagaugauccgcccucaacccauggagcacaaauauucuuggaagucguggggcaaggcaaaaguuauaggggcugacgugcagaauaccacauuuaucauugauggaccaaacacuccugagugucccgacaaucagagagccuggaacaucugggaagucgaggauuacggcuucgguauuuuuaccacaaauaucugguugaagcucagggacagcuauacgcaggugugcgaucaccgucugauguccgcggccauaaaagacucaaaggcuguucaugcagauaugggguacuggauugaaagugagaaaaacgaaaccuggaagcuagcccgggcuucuuucaucgaggugaagacuuguauuuggccaaaaagccacacacugugguccaauggaguacucgagucagaaaugaucauacccaagaucuauggcgguccuauuagccaacauaacuaccgaccaggcuacuucacccagacugccgggccguggcaccugggaaaacuugaguuggacuuugaacugugcgagggcacaaccgucgugguggaugagcacugcgggaauagaggacccucuuuaaggacgacuaccgucacaggcaagaucauucaugaaugguguugccgcuccuguacccucccuccacugcgguucaaaggugaggacgggugcugguauggaauggaaaucagacccguuaaggagaaggaagagaaccuugugaaaaguaugguaagcgcaggcucuggugagguggauuccuuuucacugggcuugcucuguauaaguauuaugaucgaagaggucaugaggagccgcuggucgcgaaagaugcugaugacugggacacuagcgguguuccugcuccugaccaugggacagcuuacauggaaugacuugauccggcugugcauuaugguuggcgccaacgcuuccgauaaaauggggaugggaacuaccuacuuagcccucauggcaacguuucguaugagaccuaugcuggcugugggccuucuguucaggcgccuaacaucucgggaaguccuccuguugaccgugggucugagcuuaguugccucaguggagcucccaaacagucuggaagagcuuggggacggacuggcaaugggcaucaugauguugaagcuccugacugacuuucaaucccaccagcuaugggccgcucugcuuucucucaccuucgucaaaacaacucugagcuugcauuaugcguggaagaccauggccaugauucuguccauaguaucauuauuuccccucugucugagcacgacaagucagaagaccacuuggcuuccggugcuguugggcucucucgggugcaaaccucugacaauguuccuaaucaccgagaauaagauuuggggaagaaaauccuggccacugaacgaagguaucauggcaguuggcauugugagcauccuucucucgucacuguugaagaaugauguccccuuagcugggccucugauagccggaggcaugcucaucgccuguuacgugauuucugguaguuccgcugaccugagccuugagaaagcagccgaaguaucuugggaggaagaggcggagcacagcggggcuucccauaacauccugguggaaguccaggaugacggaacuaugaagauuaaagaugaggaaagggacgauacauugaccauccuacugaaggccacgcuccuggcaauaucaggcguuuaucccaugaguauuccagccacucuuuuugugugguacuucuggcaaaagaaaaagcagcgaagcggcguguuaugggacaccccuucucccccagaggucgagaaagcugugcuggaugacgggaucuaucgcauccuccagcggggauugcuggguaagucccagguuggcguagggguguuucaagaaggagucuuccacacaauguggcacgugaccagaggcgcaguucucauguaccaggguaaaaggcuggagccgucaugggccagugugaagaaggaucuuauuagcuacgggggaggcuggcguuuccagggcuccuggaauacaggggaagagguccaggugauagcgguagaaccuggaaaaaaccccaagaauguccaaacugcuccagguaccuuuaaaacgcccgagggcgaggugggggccaucgcacuggacuucaagccuggaacaucuggcucgccaauuguuaaccgcgaagguaaaaucgugggguuguauggaaauggcgucgugacuaccagcggcacauacguuucagccauugcucaggccaaggcaucccaggaggggccccuaccugaaaucgaggaugaaguguuucggaagagaaaccugaccauaauggaccuccauccgggaagugguaaaacuaggcgauauuuaccagcuaucguccgggaggccauuaagcgcaaacugagaacccuugugcuggcgcccacaaggguaguggccucugagauggcagaagcucucaagggcaugccuauccgguaccaaacgacugccguuaaaagcgagcacaccgggaaggaaauugucgacuugaugugccaugcuacauucaccaugcgacugcucuccccagugagagugcccaauuauaacaugaucauaauggaugaggcacacuuuacugacccugccucaauugccgcucgcggauacaucucuacaagggucggcaugggugaagcggcagccaucuucaugaccgcuacgccgcccgggagcauggaggccuuuccacagaguaaugcagccauucaggaugaggaacgugacaucccugagcgguccuggaacagcggauaugauuggauaacugacuuccccggcaagacaguaugguuugugccaucuauuaaaucaggcaaugauaucgcuaacugucugagaaagaacgggaaaaggguuauucagcuuucccgcaagaccuucgacaccgaauaccaaaaaacuaagaauaacgauugggacuacguggucacaaccgauaucagugagaugggagcgaauuuucgagccgacagagugauagacccucggaggugccuaaagcccguuauucugaaagaugguccagagcgcgugaucuuggcaggcccgaugccugucacaguggcuagcgccgcacagcguagagggcggaucggaaggaaccagaauaaggaaggcgaccaguauauuuacaugggucaacccuuaaacaaugaugaggaccaugcccacuggacugaagcuaaaaugcugcucgauaacaucaauacgccagaggggauuauacccgcccuguucgaaccugagcgcgagaagucggcggcaaucgacggcgaauaucgacuuagaggagaggcccggaaaaccuucguagaacugaugaggcgcggcgaucucccagugugguugucuuacaagguugcuuccgagggguuucaguauagcgacagaagguggugcuucgauggagaacggaacaaucagguccuggaggagaacauggacguggaaauuuggacaaaagagggugaacguaagaagcuacgcccccgauggcuggaugccagaacuuacucagacccucucgcucuuagggaguuuaaagaauucgcagccggccggcgcagugugucuggggaucugaucuuagagaucggaaaguugccgcagcaccugacccaaagagcucagaaugcccucgacaaccuggucaugcuucauaauuccgagcagggcgguaaagcauauaggcacgcgauggaagagcugccagacacaauugaaacccucauguugcuggccuuaauagcuguucuaacugggggcgugacgcuguuuuuccucagcggacggggccuugggaagaccucaaucggacuguuguguguaauggccaguagcgcacugcucuggauggcuuccguggagccccauuggauugccgcaucuaucauucuggaguuuuuccuuaugguccuccugaucccugaacccgaucgacagagaacaccacaagacaaccaguuggccuacgugguuauaggucuguuauuuaugauccuaacuguggcugcgaacgagaugggccugcucgaaaccacaaaaaaggaucuugggauuggacacgccgcagcugagaaucaccaucacgccgccaugcuggacgucgauuugcauccugcaagcgcuuggacccuguacgccguagcgacuacaaucauuacgcccaugaugcgccacaccaucgaaaacacuacagcuaauauaucccucaccgccauugcaaaccaggccgcuauccugaugggccuugacaaggguuggccaauuucaaaaauggauaucggggugccuuuacuggcacucggcugcuauucucaaguuaauccguugacccugacagccgcggugcuaaugcuggucgcucauuacgccauaaucggacccggccuccaggcaaaggccacuagggaggcucagaaacggacggccgcagggauuaugaagaacccaaccguggacggaaucgucgcuauugaucuugacccugugguuuaugaugccaaauucgagaagcagcugggccaaaucauguugcugauacucuguacaagucagauucuguuaaugcguacuaccugggcgcuuugcgaaucgaucacacuggccaccgguccccucacuacgcuaugggaggggagcccaggaaaguuuuggaauacaaccaucgcaguguccauggcuaacauuuucagaggcucuuaccuggccggugcaggcuuggcuuuuucacugaugaaaagccucgggggaggcaggcgcgggacuggagcccagggcgaaacccuuggugagaaguggaaacggcagcugaaucaauuguccaagagugaauucaacacauauaaacgaucugggaucauggagguagacagaagcgaggccaaggaaggacugaagaggggcgagacuaccaaacacgcggugucacgcgguacagcuaagcuccggugguucgucgaaagaaauuuaguuaaaccugagggcaaggugauagaucugggguguggacguggcgggugguccuacuauugcgcaggacuuaaaaaggucacggaagugaaaggcuacaccaagggugggcccggacacgaggagccgauuccaauggccacuuacggcuggaaccugguaaagcuacauaguggcaaagacguguuuuucacaccucccgaaaagugugacacccuccugugcgauaucggggagagcucuccaaaucccacuauugaagagggaaggacauugcggguucugaaaaugguggagccuuggcuccgcgguaaccaguuuuguaucaagguccuuaauccguauaugcccuccgugauagaaacccuggagcagaugcagcgaaaacacggcgggauguuagucagaaacccacugucaaggaauagcacgcaugaaauguacugggugucgugcggaaccggcaacaucguuucugcuguaaacaugacaagucggauguugcucaaucgcuucacuauggcccacagaaagccuaccuaugagagggacguggaucugggugcagggacacgacacgucgccguggaacccgagguugcuaaccuagacauuaucggacaacggauugagaauaucaagaacgaacauaaauccacuuggcacuacgaugaggacaauccuuauaagaccugggcguaccauggcagcuaugaagugaaaccaucaggcuccgccucuagcauggucaacggggugguacgucuucugacaaagcccugggaugugauuccuaugguuacccagaucgcaaugacugacacgacaccauuuggacagcaaagagucuucaaagagaagguggauacccgcacucccaaggcuaaaagggguaccgcccagauaauggaagugacagcacgguggcucuggggcuuucugaguagaaauaagaaaccgcgcauuuguacgagggaggaguucacccgaaagguccgguccaacgccgcuaucggggccguuuuuguggacgaaaaucaguggaacagcgcgaaagaggcaguagaagaugagagauucugggacuuggugcacagggaacgcgagcugcauaagcagggaaagugcgccacuugcgucuacaauaugaugggcaaacgugagaagaaacucggugaauuugggaaggcuaaaggaucucgggccaucugguacauguggcuuggcgcaagauuccuggaguuugaagcuuuaggcuucaugaacgaggaccacugguucucaagggagaauagucuguccgggguggaaggagaggguuugcacaagcucggcuauauucugcgcgauauaagcaaaaucccugggggaaacauguacgccgacgauacagcuggcugggacacccgaauuacugaagaugaccuacaaaaugaggccaagaucacagauauuauggaaccagagcaugcacuucuggcgaccucuaucuuuaagcucacauaucagaacaaaguugugcggguccagagacccgccaagaacgguacugugauggacguaauaucgaggcgcgaucagagagggucaggacaaguuggcaccuacggccugaauacguucaccaacauggaggcucaguugauccggcagauggaaagcgaggggauuuuuacaccuuccgaauuagagacuccaaaucuggccgaaagggugcucgacuggcuugagaaacacggaaucgagcgucugaagcgaauggcaauuaguggugaugacugugucgugaaacccaucgaugaccgcuucgcuaccgcccuaacagcacugaacgacaugggcaaggugagaaaggauauaccgcagugggaaccuucuaaaggguggaaugacuggcaacagguccccuuuugcagccaucacuuccaccagcucauuaugaaggauggacgggagaucguugugccauguaggaaccaggacgaauugguaggccgcgccagagugucccaaggugcgggguggucacugcgggagacugcuugccuuggaaaaaguuaugcccagauguggcagcugauguacuuucauaggcgagaucuccguuuagcagccaaugcuaucuguucugccgucccuguggacuggguucccaccagcagaacgacaugguccauucacgcacaucaccaauggaugaccacugaagauaugcugucaguguggaaccgcgucuggauagaggagaauccauggauggaagacaagacacaugugagcucuugggaggauguacccuauuugggcaaacgggaagaccaguggugcggcucccugaucgggcucaccgcuagggccacuugggcgaccaacauucagguugcuaucaaucaggugagacgccuuauuggaaacgagaauuaccuggauuacaugacaaguaugaagcgguucaagaacgagagcgacccugaaggugcccuaugguga

SEQ ID NO: 14159 - RNA, 9879 nt, Artificial Sequence
  derived and/or modified CDS sequence (opt3) from DENV-1__KC762640__SS-prME
uccgugaccaugcugcucaugcuucugcccacggccuuggcuuuccacuuaacuacgcggggaggggaaccucauaugaucgucuccaagcaggaaaggggaaaaucucugcuguuuaagaccucagccgguguuaacaugugcacacucauugccauggaccugggagagcuuugugaagauacuaugaccuacaaaugcccacggauaacagagaccgaaccggacgauguggacuguuggugcaaugcgacugagacauggguaaccuaugggacguguagucaaacuggagagcaccgccgagauaagcguagcguggcucuggcaccccaugucggcuugggucucgaaaccagaacagagacuuggauguccucugaaggggcauggaggcagauccagaaaguggagaccugggcccugcggcacccuggauucacaguuauugcucuguuucucgcacaugccaucggcaccucgauuacgcagaagggcaucauauucaucuuacugaugcuugugacuccaucaauggcuaugcgcugcgucgggauuggaaacagagacuuuguggaggguuugagcggcgccacauggguagauguugugcuggaacacgggaguugugucaccacuauggcgaaggacaaacccacacuagauaucgagcuccugaagaccgaagugacgaauccugcagugcuuaggaaacugugcauugaggccaagaucuccaacaccacaacugacucucgguguccaacccaaggagaagcuacauuggucgaggagcaggauacuaauuucguuugccgccgaaccuuuguggacagaggcugggguaacggguguggacucuucggcaaaggcagccugauaacaugcgccaaguuuaagugcguaaccaaauuagaagggaagauugugcaguacgagaaucugaaauauuccgucaucgugacuguucacacgggagaucagcaucaaguggguaacgaaacaaccgagcacggcacuaccgcaacaauuacuccccaagcuccuaccucagaaauccagcucacagacuacggggcccuuacgcuggacuguaguccaaggaccggauuggauuucaaugagaugguccuacugacuaugaaggagaaaagcuggcucgugcauaagcagugguuucuggaccuuccgcugcccuggacaucuggcgcguccaccucacaagaaacauggaaccggcaggauuugcucguaacuuucaaaaccgcccacgcaaagaagcaggagguugugguccuggguagccaagaaggggcuaugcacacggccuuaaccggcgcuacagagauccagacaaguggaaccacaacuauuuuugccggccaucugaaaugccgucuaaagauggacaaacucacccugaagggggugucuuaugucauguguacgggauccuucaaacuugaaaaggagguggcagagacacagcacgguaccguuuuggugcagguaaaguacgaaggcacugaugccccuugcaaaauaccauucagcucgcaagacgagaagggggucacacagaauggacgccugaucaccgcuaaccccauugugacugauaaagaaaagccuguuaauaucgaggcggagccacccuuuggcgaaucuuaucucguggucggugcaggggagaaagcccugaaacuuuccugguucaagaaaggcucaaguauaggaaagauguuugaagcuaccgccagaggcgcaaggcggauggccauucugggggacacagcuugggauuucggaagcaucgguggcguguuuacguccguagggaaauugauccaucagauuuucggaaccgccuacggcgugcucuuuucugguguuagcuggacuaugaagaucgggauuggcauacuguuaacauggcugggacuaaacucacgaaguaccucccucagcaugacauguaucgcagucggcauggugacucuguaccuuggggugaugguccaggcggacucuggaugcguuauuaauuggaaaggccgcgaguugaagugugguucagggaucuucgugaccaacgaagugcacacguggacagagcaauauaaguuucaggcugauaguccgaaaagacugagcgccgcaaucggaaaggccugggaggaaggcguaugcgguauuagguccgcuacccggcucgagaacauaauguggaaacagaucucuaaugaacugaaccauauuuuacuggagaaugacaugaaguucacugucgugguuggcgaagugaacgggauccuugcccagggcaagaagaugauucgcccucaacccauggagcacaaauacucguggaaaagcuggggcaaggcaaaggucaucggggcugacgugcagaauaccacauuuauaaucgauggaccaaacacuccugagugucccgacaaucagagagccuggaacauuugggaaguugaggauuauggcuucgguaucuuuaccacaaauauuugguugaagcucagggacuccuacacacaggugugcgaucaccgucugaugucagcggccaucaaagacaguaaggcuguacaugcagauaugggguauuggauagaaucugagaaaaacgaaaccuggaagcuagcccgggcuagcuucauugaggucaagacuuguaucuggccaaaaucccacacacuguggucaaauggagugcucgagagcgaaaugauuauccccaagauauacggcgguccuaucucucaacauaacuaucgaccaggcuacuucacccagacugccgggccguggcaccugggaaaacuugaguuggacuuugaacugugcgagggcacaaccguggucguugaugagcacugcgggaauagaggacccuccuuaaggacgacuaccgugacaggcaagauuauccaugaaugguguugccgcaguuguacccucccuccacugcgguucaaaggugaggacgggugcugguacggaauggaaauuagacccguaaaggagaaggaagagaaccuugugaaaagcauggucucugcaggcuccggugagguggauucauuuagucugggcuugcucuguaucagcauaaugauugaagagguuaugaggucgcgcuggucccgaaagaugcugaugacugggacacuagcgguguuccugcuccugaccaugggacagcuuacauggaaugacuugauccggcugugcaucauggucggcgccaacgcuucugauaaaauggggaugggaacuaccuauuuagcccucauggcaacguuucguaugagaccuauguucgcugugggccugcuuuuuaggcgccugacaagccgggaaguucuacuccugaccguggguuugucacuggucgccaguguagaguuaccaaacucccucgaagaacugggggacggacuugcaaugggcauuaugaugcugaaguugcucacugacuuccaaucucaccagcugugggccgcucuacugagccuuaccuuugugaaaacaacucucucccugcauuacgcguggaagaccauggccaugaucuugucaauuguuagccuguuccccuuaugucucaguacgacaucucagaagaccacuuggcugccggugcuucugggcuccuuggggugcaaaccucucacaauguuucugauaaccgagaauaagaucuggggaagaaaaagcuggccacuaaacgaagguauuauggcagucggcaucgugucgauucugcuuucaucucuccugaagaaugauguacccuuggcugggccuuuaaucgccggaggcaugcugauagccuguuaugugaucagugguuccagcgcugaccucucucuggagaaagcagccgaagucagcugggaggaagaggcggagcacuccggggcuucacauaacauucuuguugaagugcaggaugacggaacuaugaagaucaaagaugaggaaagggacgauacacugaccauuuugcuaaaggccacgcugcucgcaaucaguggcguguaccccaugagcauaccagccacucuguucgucugguauuuuuggcaaaagaaaaagcagcgaucuggcgugcuuugggacaccccuucacccccagagguugagaaagcuguauuagaugacgggauuuaccgcauccugcagcggggacucuuggguaagagccaggugggcgucgggguguuccaagaaggaguuuuccacacaauguggcacgugaccagaggcgcaguccugauguaucaggguaaaaggcucgagccgaguugggccagcgugaagaaggaucugaucuccuacgggggaggcuggcguuuucagggcucuuggaauacaggggaagagguacaggucauugcgguggaaccuggcaaaaaccccaagaauguucaaacugcuccagguaccuucaaaacgcccgagggcgaggugggggccauagcacuugacuuuaagccuggaacaucgggcagcccaaucgucaaccgcgaagguaaaauuguggggcuguacggaaauggcguugugacuaccucaggcacauaugucuccgccaucgcucaggccaaggcaagucaggaggggcccuugccugaaauugaggaugaaguguuccggaagagaaaccuaaccaucauggaccugcauccgggaucugguaaaacuaggcgauaccucccagcuauaguacgggaggccaucaagcgcaaauuaagaacccuggugcuugcgcccacaaggguugucgccagcgagauggcagaagcucugaagggcaugccuauucgguaucaaacgacugccgugaaauccgagcacaccgggaaggaaaucguggaccucaugugccaugcuacauuuaccaugcgauugcugucaccagucagaguacccaauuacaacaugauuaucauggaugaggcacacuucacugacccugccucuauagccgcucgcggauauauuagcacaagggugggcaugggugaagcggcagccaucuuuaugaccgcuacgccgcccgggaguauggaggccuucccacaguccaaugcagccauccaggaugaggaacgugacauuccugagcggagcuggaacucuggauacgauuggaucacugacuuucccggcaagacaguuugguucgugccaucaauaaaauccggcaaugauauugcuaacugucucagaaagaacgggaaaagggucauccagcugagucgcaagaccuuugacaccgaauaucagaaaacuaagaauaacgauugggacuacgugguuacaaccgauauuagcgagaugggagcgaauuuccgagccgacagagugaucgacccucggaggugccuuaagcccgucauacuaaaagaugguccagagcgcgugauucuggcaggcccgaugccuguaacaguggcuucggccgcacagcguagagggcggaucggaaggaaccagaauaaggaaggcgaccaguacaucuauaugggucaacccuugaacaaugaugaggaccaugcccacuggacugaagcuaaaauguuacuggauaacauuaauacgccagaggggaucauucccgcccucuucgaaccugagcgcgagaagucugcggcaauagacggcgaauaccgacugagaggagaggcccggaaaaccuuuguugaacuuaugaggcgcggcgaucugccagucuggcucuccuauaagguggcuagcgagggguuccaguacucagacagaagguggugcuuugauggagaacggaacaaucagguguuggaggagaacauggacgucgaaaucuggacaaaagagggugaacguaagaagcugcgcccccgauggcuagaugccagaacuuauagugacccucuggcucucagggaguucaaagaauuugcagccggccggcgcucuguuuccggggaucuuauucuggagaucggaaaguuaccgcagcacuugacccaaagagcucagaaugcccuggacaaccucgugaugcugcauaauagcgagcagggcgguaaagcauacaggcacgcgauggaagaacuuccagacacaaucgaaacccugaugcucuuggcccugauugcuguauuaacugggggcgugacgcuauucuuucugucaggacggggccucgggaagaccaguauaggacuucugugugucauggccagcuccgcauugcuguggauggcuucuguggagccccauuggaucgccgcaagcauuauccucgaguucuuucugaugguucuucucauuccugaacccgaucgacagagaacaccacaagacaaccagcuggccuauguggucaucgguuugcuguucaugauauuaacuguagcugcgaacgagaugggccuacuggaaaccacuaaaaaggaucucgggaucggacacgccgcagcugagaaucaccaucacgccgccaugcuugacguggaucugcauccugcauccgcuuggaccuuguacgccguugcgacuacaauuaucacgcccaugaugcgccacaccauugaaaacacuacagcuaauaucucacugaccgccauagcaaaccaggccgcuauucucaugggccuggacaaggguuggccaaucucuaaaauggauauuggggugccucuuuuagcacugggcugcuacagucaagucaauccgcucaccuugacagccgcggugcugaugcuagucgcucauuaugccaucauaggacccggccugcaggcaaaggccacuagggaggcucagaaacggacggccgcagggaucaugaagaacccaaccguggacggaauuguugcuaucgaucucgacccugugguauacgaugccaaauuugagaagcagcuuggccaaauuaugcuguugauccuguguacaucgcagauacuccugaugcguacuaccugggcguuaugcgaaagcauuacacuugccaccgguccccugacuacgcucugggagggguccccaggaaaguucuggaauacaaccaucgcagugucuauggcuaacaucuuuagaggcucauaucuagccggugcaggccuggcuuucagcuugaugaaaucccuagggggaggcaggcgcgggacuggagcccagggcgaaacccucggugagaaguggaaacggcagcuuaaucaacugaguaagucugaguucaacacauacaaacgaagcgggauuauggaggucgacagaucagaggccaaggaaggauugaagaggggcgagacuaccaaacacgcgguuucccgcgguacagcuaagcugcggugguuuguggaaagaaaucucgucaaaccugagggcaaggugaucgauuuaggguguggacguggcggguggaguuauuacugcgcaggacugaaaaagguaacggaagugaaaggcuauaccaagggugggcccggacacgaggagccgauaccaauggccacuuacggcuggaaccuuguuaagcuguacagcggcaaagacguguucuuuacaccucccgaaaagugugacacccuacucugcgauauuggggagucuuccccaaaucccacuaucgaagagggaaggacacugcgggucuugcgcaugguggagccuuggcugcgagguaaccaguucuguauuaaaguccucaauccguauaugcccucagugaucgaaacccuugagcagaugcagagaaagcauggcgggaugcugguuaggaacccauuaagcagaaauucgacgcacgaaauguacuggguaucuugcggaaccggcaacauagugagugcugucaacaugacaucccgcaugcuguugaauagauuuacuauggcccauaggaaaccuaccuaugagcgagacguggaucucggugcagggacacggcacguugccguggaacccgaggucgcuaaccuggagaucauuggacaacguaucgaaaauauuaagaacgagcacaagagcacuuggcauuacgacgaagauaauccuuauaaaaccugggcguaccacggcucauaugaggugaagccauccggcucugccagcaguaugguaaacggggugguuagacuacuuacaaaacccugggacgucaucccuauggugacccagauugcaaugacugauacgacaccauucggacagcaacgcguguuuaaggaaaaagucgacaccaggacucccaaggcuaagcgggguaccgcccagaucauggagguuacagcaagauggcuguggggcuuccucucccgcaauaaaaagccgaggauauguacgcgagaggaauuuacccggaaagugagaagcaacgccgcuauuggggccguauucguggaugagaaucaguggaacucugcgaaggaagcagucgaggacgaaagguuuugggaucuggugcaucgcgagcgugaguugcacaaacagggaaagugcgccacuugcguuuacaauaugaugggcaagcgggagaaaaagcugggugaguucgggaaagcuaagggaucaagagccaucugguacauguggcucggcgcaagguuucuugaguucgaggcucugggcuucaugaacgaggaccauugguuuagucgcgaaaauuccuuaagcgggguggagggagaaggucugcacaaauugggcuauauccuccgagacauuucuaagauaccugggggaaacauguacgccgaugacacagcuggcugggauacccggaucacugaggacgaucugcaaaaugaagccaaaauuacagacaucauggagccagagcacgcacuacuugcgaccucgauuuucaagcugacauaucagaacaaggucgugagaguacagaggcccgccaaaaacgguacuguuauggaugugaucucacgcagagaccagcgggggagcggacaagucggcaccuacggccucaauacguuuaccaacauggaagcucagcugauaaggcagauggaguccgaagggaucuucacaccuagugaguuggaaacuccaaauuuagccgagcgugugcuggauuggcucgagaagcauggaauugaacgacuuaaacgcauggcaaucucuggugacgauuguguggucaagcccauugacgauagauuugcuaccgcccugacagcacuaaacgacaugggcaaaguucggaaggacaucccgcagugggagccuagcaagggguggaaugauuggcaacaggugcccuucugcucccaccauuuucaccagcugauaaugaaagacggaagggaaauuguagugccaugucgcaaccaggaugagcucgucggcagagcccgggugucacaaggugcgggguggaguuugagggaaacugcuugccugggaaagucuuaugcccagauguggcagcuuauguacuuccaccgacgugaccugagacucgcagccaaugcuaucuguagcgccguuccuguggauuggguccccaccucccgcacgacauggucaauccaugcacaccaucaauggaugaccacugaggacauguuaagcguguggaaccggguauggauugaggaaaauccauggauggaggauaaaacacacguuucuuccugggaagacgugcccuaucugggcaagagggaggaucaguggugcggcaguuugauagggcugaccgcuagagccacuugggcgaccaacauccaggucgcuauuaaucaggugcgccggcucaucggaaacgagaauuaccuugacuacaugacaagcaugaaaagguuuaagaacgaaucggauccugagggugcccugugguga

SEQ ID NO: 14160 - RNA, 9879 nt, Artificial Sequence
  derived and/or modified CDS sequence (opt3) from DENV-1__KC762645__SS-prME
agcgugaccaugcugcucaugcuuaugcccacagcacuggcuuuccacuugacuacgagaggcggggagccucauaugaucgucuccaagcaagaaagaggaaagucuuuacuguuuaagaccucagccgguguuaacaugugcacacugauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagcggguggaaacuugggcucugcgccacccuggauucaccguuauugcacuguuucucgcccaugcuaucggcacaucgauuacccagaaaggcaucauauucaucuuacugaugcuugugacgccaucaauggccaugagaugcgucgggauuggaagcagggauuuuguggaggguuugaguggcgcgacuuggguagacguugugcuggagcacggguccugugucacaaccauggcaaaggauaagcccacucuagacaucgaacuccugaaaacagaggugaccaacccugccgugcuucggaagcugugcauugaagcuaaaaucucuaauacgaccacagauagccgcuguccaacucaaggagaggccaccuuggucgaagaacaagacgcaaacuucguuugccgaagaacauuuguggauaggggcugggguaauggguguggacucuucggcaagggcucccugauaacuugcgcuaaauuuaagugcguaaccaaguuagaggggaaaauugugcaguacgaaaaccugaaguauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccacggacaggauuggacuucaacgaaaugguccuacugacgaugaaagagaagucuuggcucgugcauaaacagugguuucuggaucuuccgcugcccuggaccuccggcgcaucaacuagccaagagacauggaaucgucaggacuugcucguaaccuucaagacagcucacgccaaaaagcaggaaguugugguccuggguagucaagagggggcuaugcacacugccuuaaccggcgcaacggaaauccagaccucuggaacaacuaccauuuuugccggccaucugaagugccgccuaaaaauggauaagcucacacugaaagggauguccuaugugauguguacugggagcuucaaacuugagaaagaagucgcugagacccagcacgguacgguguugguucagauaaaguacgagggcacagacgcgccuugcaagaucccauucucgacccaagaugaaaaaggggugacucagaacggaagacugauuacagcaaaucccaucguaaccgacaaggagaaaccugucaacauagaagccgagccacccuuuggcgagucuuauauugugaucggugcuggggaaaaggcccucaaacuguccugguucaagaagggcucaaguaucggaaaaauguuugaggcaacugccaggggcgcucggcgaauggccauucuuggggauaccgcaugggacuucggaagcaucgguggcguuuuuacauccguggggaagcugguccaucagauuuucggaacggcguacggcguguuguuuucugguguaagcuggaccaugaaaauagggaucggcgugcuccugacuugguuaggacuaaauucacgcaguacaucccuaagcaugaccuguauugcuguuggccucgucacacuguaccuuggggugauggugcaggccgauucuggaugcgucaucaacuggaagggcagagaauugaaaugugguucagggaucuucguuacuaaugaggugcacaccuggacggaacaauauaaguuucaggcagacaguccgaagaggcugagcgccgcuauuggaaaagccugggaggagggcgugugcgguauacgguccgcaacacgccucgaaaacaucauguggaagcagauuucuaacgagcugaaucauaucuuacuggaaaacgacaugaaauucaccguagucgugggcgauguugcugggauucuugcccagggaaagaaaaugaucagaccucaacccauggagcacaaguacucguggaaaagcuggggcaaggcgaagauaaucggggccgacgugcagaauacuaccuuuauuaucgauggaccaaacacaccugaaugucccgacgaucagagggcuuggaauauuugggaggucgaggacuauggcuucgguaucuuuacuaccaacauaugguugaaacuccgugauuccuacacacaggugugcgaccaccggcugaugucagcagccauuaaggauaguaaagcuguucaugccgacaugggguauuggaucgaaucugagaagaaugaaacguggaaacuagcacgagcgagcuucauugaggugaagaccuguaucuggccaaagucccacacucuguggucaaacggaguacucgaaagcgagaugauaauccccaaaauuuacggcgguccuaucucucaacauaauuauagaccaggcuacuucacacagaccgccgggccguggcaccugggaaaacuugaguuggauuuuaaccugugcgaaggcacuacagucgugguggacgagcacugcgggaauaggggacccuccuuacgcaccacgacugucaccggcaaaauuauccaugaaugguguugccggaguuguacacucccuccacugagauucaggggugaggaugggugcugguacggaauggagauacgccccguuaaggaaaaagaggaaaaccuugugaaguccaugguaucugcuggcuccggugagguggacucauuuagucugggcuugcucuguauuagcaucaugaucgaagaggucaugcgaucgcgguggucccguaagaugcugaugaccgggacucuagccguguucuuucugcucauuaugggacagcugacauggaaugaccuuaucagauugugcauuaugguuggcgcaaacgcuucugauaggauggggaugggaaccacauaucuggccuuaauggcaacuuucaaaaugcgcccuauguuugccgugggccuccuguuccggagacuuaccagcagggagguccugcuacucacgauaggucugucauugguggcuaguguugaacugccaaauuccuuagaggaacucggggacggacuggcgaugggcaucaugauucuuaagcuguugacagauuuucaaucucaccagcucugggccacccugcuaagccugacuuucaucaaaaccacauuuucccuucauuacgcauggaagacuauggcuauggugcucucaauugucagccuguuccccuugugucugaguaccacgucucagaaaacaaccugguuaccgguacuccugggcucccuugggugcaagccucugacuauguuuuugaucgccgagaacaagauauggggacgaaaaagcuggccacucaacgaagguaucauggccgugggcauuguuucgauccugcuaucaucucugcuuaagaaugacgugccccucgcugggccucugauugcaggaggcauguugaucgccuguuaugucauaagugguuccagcgcggauuuaucucuggagaaagcugccgaggugagcugggaagaggaagcagagcacuccggggccucacauaacauucucguagaagugcaggacgauggaacaaugaagaucaaagacgaggagcgcgaugacacccugacuauccuucugaaggcuacauugcuagcagucaguggcguuuacccccugagcauuccagccacccucuucgugugguauuucuggcagaagaagaagcagcggucuggcgugcugugggauacgccuucacccccagaagucgagagagcggugcuugacgaugggauauacaggaucaugcagcguggauuacugggucgcagccagguuggcguagggguguuucaagaaaaugucuuccacacuauguggcacgugacccggggagcuguucucauguaucagggcaaaagauuggagccgaguugggccagcgugaagaaagaccugauuuccuacggugggggauggaggcuccagggcucuuggaacacaggcgaggaaguccaggugaucgcaguagagccugggaagaaucccaaaaacguccaaaccgccccaggaacauuuaagacucccgaaggugaggugggcgcuauugcccuggacuucaagccugggaccucgggaagcccaaucguuaaucgagaaggcaaaauagugggucuuuacgggaacggagucgugacgacaucaggcacuuauguuuccgcaaucgcucaggccaaggcgagucaggagggcccccugccugagauugaagaugagguguuucggaaacgcaauuugaccaucauggaccuacauccggggucuggaaagacaagaagguaccugccagccauuguccgggaagcaaucaaacgaaagcucagaaccuuaauacuggcucccacucgcgugguagccagcgagauggcugaagcacuuaaggguaugccuauuagguaucaaaccacagccgugaaauccgagcacacgggcaaggagaucguugaucugaugugccaugccacuuucaccaugcgucucuugucaccaguccgggugcccaacuacaauaugaucauuauggacgaagcucacuuuacagauccuucuagcaucgcggcaagaggguauauaaguaccagggugggaaugggcgaggccgcugccauuuucaugacugcaacaccgcccgguuccgucgaagccuuuccacagagcaacgcuguaauccaggacgaggaacgcgauauuccugagcgaucuuggaacucaggguacgaguggaucaccgacuuccccggaaaaacggugugguuuguuccauccauaaagaguggcaacgauauugcgaauugucugaggaagaauggcaagcgggugauccagcucagcaggaagacuuucgacacagaauaucagaagaccaagaacaaugauugggacuacgucgugaccacugacaucucggagaugggggccaacuuccgcgcagaucguguuauugacccuagacggugccugaaacccgugauccuuaaggauggaccagaaagggucauucuagcugguccgaugccugugacaguagccucugcagcccagcgccgaggcagaguggggcggaaucauaacaaagagggagaccaguacauauauaugggccagccccugaauaacgaugaggaccacgcucacuggaccgaagccaagauguuguuagauaauaucaacacaccagaggguauuauccccgcgcuguuugaaccugagagggaaaaguccgcagccaucgacggggaguaccgccucagaggcgaggcuaggaaaacuuucguugaacugaugcggcguggagaucuuccagucuggcugagcuauaagguggccucagagggcuuucaauacagugaccgccgauggugcuucgauggggaaagaaauaaccaggugcucgaggaaaauauggacgucgagauuuggacgaaagagggagaaaggaagaaauugcggccccgcuggcuggaugcuagaaccuauucugacccucuagcacugagggaguuuaaggaguucgccgcuggucggcgauccguuagcggcgaccucauacuugagaucgggaaacugccgcagcauuuaacacagagagcccaaaacgcauuggauaaucuggugaugcuccacaacucagaacagggaggccgcgcguacaggcaugccauggaggagcugccagacacuauugaaacccuuaugcugcucgcuuugaucgccguacugacagguggggugaccuuauuuuuccuaaguggccggggacugggcaagacuagcauugggcuccuuugugucauggcauccucugugcuguuguggauggcuagcguucagccccacuggaucgccgcauccauaauccuggaguuuuuccucauggugcugcuuauuccugaacccgaucgucagagaacgccacaagacaaucagcucgccuaugucguaaucggacuguuguuuaugauucugaccguggcugcgaacgagauggguuuacuagagacaacuaagaaagaucugggcaucgggcacguugccguggaaaaccaucaccaugcagcuaugcucgacgucgaucuucacccugccucagccuggacccuguacgcaguggcuacaaccauaauuacucccaugaugaggcauacaaucgagaauacgaccgccaacauuucuuugacugcgaucgcuaaucaggccgcaauacugaugggacucgacaagggcuggccaaucaguaaaauggauauuggugucccucugcuugccuuagggugcuacucgcaagugaacccgcugacacucaccgcugcaguuuugaugcugguggcccacuaugcgaucauuggccccggacuacaggcuaaggccacccgcgaagcacagaaacggacagccgcuggcaucaugaagaauccaacuguagacgggauaguggccauugaucuggacccugucguuuacgaugcaaaguucgagaaacagcucggacaaaucaugcuucugaucuuguguacgagccagauucugcucaugcgaaccacaugggcucugugcgaauccaucacuuuagccaccggcccccuuacaacccugugggaggguucuccagggaaguuuuggaacacuacgauagcggugucaauggccaauauuuucagaggaagcuaucucgcaggcgcuggucuagccuucucccugaugaaaaguuugggcgggggaaggcgcggcacaggggcacagggagagacccugggcgaaaaguggaaacggcagcucaaccaacuuucuaagagcgaguuuaauacuuacaagagaucagguaucauggaagucgaccguuccgaggcuaaagaagggcugaagaggggagagaccacaaaacacgccgugagucggggcacugccaaguugcgcugguucguagagcgaaaccuggugaaaccugaagguaagguuauugaccucggcugugggagaggaggcuggagcuauuacugcgcgggguuaaagaaagugaccgaggucaagggauauacaaaaggcggucccgggcaugaggaaccgaucccaauggcuacguacggauggaaucuggugaaacuucacucuggcaaagaugucuuuuucauaccucccgaaaagugugacacccugcuaugcgauaucggcgaguccucaccaaaccccacuauugaggaagggaggacacuccgggugcugaaaaugguugagccuugguugcgcggaaaucaguuuuguaucaagauucugaacccguacaugcccagcguaguggaaacccucgagcagaugcagagaaagcaugguggcaugcuugucaggaauccacugucgcgaaacucuacucacgagauguauugggugaguugcgggacaggaaauaucguuuccgcagugaacaugaccagccggauguuacugaaccguuucacgauggcccacagaaaaccuaccuacgaacgcgacgucgauuugggcgcugguacaaggcauguggccguagagcccgaaguggcaaaucucgacauuaucgggcaacggauagagaacauuaagcacgaacauaaaucaacuuggcacuaugaugaggacaauccuuacaagaccugggccuaucauggauccuacgagguuaaaccaucuggcagcgcuaguuccauggucaacggcguggugaagcugcuaacaaagcccugggaugucaucccuaugguuacucagaucgcgaugaccgacacaaccccauuugggcagcaaagaguguucaaagaaaagguagauacucgcacgcccaaagccaagaggggaacaacccagauuauggaggugacugcacgauggcuuugggguuuucugagccggaauaaaaagccgagaauauguaccagggaagaguucacacgcaagguccguucuaacgcugccaucggcgcaguguuuguugacgaaaaucaguggaacucagccaaagaggcuguggaggacgaacgguucugggaucucguccacagagagagggaacugcacaagcaggggaaaugcgccacgugcguguauaauaugaugggaaagcgcgagaaaaaguugggcgaauuugguaaggcgaaagggagucgagcaauuugguacauguggcugggagcccgguuccucgaguucgaggcucuuggcuuuaugaacgaagaccauugguucuccagagagaauagccugucuggcguagaaggggagggauuacacaagcuggguuacaucuugagggauauuucgaaaaucccuggcgggaacauguaugccgacgauaccgcaggaugggacacucgcauaacagaggaugaccuccaaaaugaagcuaagaucaccgauauuauggagccagaacaugcccugcuagcuaaagccaucuuuaaacuuacuuaccagaacaaaguugugagaguccagcggcccgcaaagaauggcacagugauggacgugauuucaaggcgugaucagcgagguagcgggcaagucggaaccuauggccugaacacauucacuaacauggaggcgcagcucauccgccagauggaauccgagggcauauuuaguccuucugagcuggaaaccccaaauuuggccgagagaguuuuagacuggcuggaaaaguacgggguggagcggcucaaaaggauggcuauuagcggagaugacuguguagugaagcccaucgacgaucgcuucgccacggcacuuaccgcucugaacgacauggguaaagucagaaaggauaucccgcagugggaaccuuccaaaggcuggaaugacuggcaacaggugcccuuuugcucacaccacuuccaucagcuaauuaugaaggaugggcgggagauaguugugccauguaggaaccaggacgagcuggucggacgagcccgugugagucaaggcgcagguuggucucucagagaaacagccugcuugggaaagagcuaugcgcagauguggcagcugauguacuuucaccgccgggaucuuaggcuggcugccaaugcaaucuguuccgccguaccuguugacugggugcccacuucaagaaccacauggagcauucaugcucaccaucaauggaugacuaccgaggauaugcucucugucuggaaccgcguguggaucgaagagaauccauggauggaagacaaaacgcacauuuccaguugggaggauguucccuauuuaggaaagcgggaggaccaguggugcggcagccugaucggcuugacagccagggcaaccugggcuacuaacauacagguggccaucaaucagguccgaagacugauugggaacgaaaauuaccucgacuacaugacaucgaugaaacgguucaagaacgaguccgauccugaaggagcgcuuugguga

SEQ ID NO: 14161 - RNA, 9879 nt, Artificial Sequence
  derived and/or modified CDS sequence (opt3) from DENV-1__KC762628__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagagaccgaaccggacgauguggacuguuggugcaaugcgacugagacauggguaaccuaugggacguguagucaaacuggagagcaccgccgagauaagcguagcguggcucuggccccccaugucggcuugggucucgaaaccagaacagagacuuggauguccucugaaggggcauggaggcagauccagaaaguggagaccugggcccugcggcacccuggauucacaguuauugcucuguuucucgcacaugccaucggcaccucgauuacgcagaagggcaucauauucaucuuacugaugcuugugacuccaucaauggcuaugcgcugcgucgggauuggaaacagagacuuuguggaggguuugagcggcgccacauggguagauguugugcuggaacacgggaguugugucaccacuauggcgaaggacaaacccacacuagauaucgagcuccugaagaccgaagugacgaauccugcagugcuuaggaaacugugcauugaggccaagaucuccaacaccacaacugacucucgguguccaacccaaggagaagcuacauuggucgaggagcaggauacuaauuucguuugccgccgaaccuuuguggacagaggcugggguaacggguguggacucuucggcaaaggcagccugauaacaugcgccaaguuuaagugcguaaccaaauuagaagggaagauugugcaguacgagaaucugaaauauuccgucaucgugacuguucacacgggagaucagcaucaaguggguaacgaaacaaccgagcacggcacuaccgcaacaauuaccccccaggcuccuacuucagaaauccagcucacagacuacggggcccuuacgcuggacuguaguccaaggaccggauuggauuucaaugagaugguccuacugacuaugaaggagaaaagcuggcucgugcauaagcagugguuucuggaccuuccgcugcccuggacaucuggcgcguccaccucacaagaaacauggaaccggcaggauuugcucguaacuuucaaaaccgcccacgcaaagaagcaggagguugugguccuggguagccaagaaggggcuaugcacacggccuuaaccggcgcuacagagauccagacuaguggaaccacaacuauuuuugccggccaucugaaaugccgucuaaagauggacaaacucacccugaagggggugucuuaugucauguguacgggauccuucaaacuugaaaaggagguggcagagacacagcacgguaccguuuuggugcagguaaaguacgaaggcacugaugccccuugcaaaauaccauucagcucgcaagacgagaagggggucacacagaauggacgccugaucaccgcuaaccccauugugacugauaaagaaaagccuguuaauaucgaggcggagccacccuuuggcgaaucuuaucucguggucggugcaggggagaaagcccugaagcuuuccugguucaagaaaggcucaaguauaggaaagauguuugaagcuaccgccagaggcgcaaggcggauggccauucugggggacacagcuugggauuucggaagcaucgguggcguguuuacguccguagggaaauugauccaucagauuuucggaaccgccuacggcgugcucuuuucugguguuagcuggacuaugaagaucgggauuggcauacuguuaacauggcugggacuaaacucacgaaguaccucccucagcaugacauguaucgcagucggcauggugacucuguaccuuggggugaugguccaggcggacucuggaugcguuauuaauuggaaaggccgcgaguugaagugugguucagggaucuucgugaccaacgaagugcacacguggacagagcaauauaaguuucaggcugauaguccgaaaagacugagcgccgcaaucggaaaggccugggaggaaggcguaugcgguauuagguccgcuacccggcucgagaacauaauguggaaacagaucucuaaugaacugaaccauauuuuacuggagaaugacaugaaguucacugucgugguuggcgaagugaacgggauccuugcccagggaaaaaagaugauucgcccucaacccauggagcacaaauacucguggaagagcuggggcaaggcaaaagucaucggggcugacgugcagaauaccacauuuauaaucgauggaccaaacacuccugagugucccgacaaucagagagccuggaacauuugggaaguugaggauuauggcuucgguaucuuuaccacaaauauuugguugaagcucagggacuccuacacgcaggugugcgaucaccgucugaugucagcggccaucaaagacaguaaggcuguacaugcagauaugggguauuggauagaaucugagaaaaacgaaaccuggaagcuagcccgggcuagcuucauugaggucaagacuuguaucuggccaaaaucccacacacuguggucaaauggagugcucgagagcgaaaugauuauccccaagauauacggcgguccuaucucucaacauaacuaucgaccaggcuacuucacccagacugccgggccguggcaccugggaaaacuugaguuggacuuugaacugugcgagggcacaaccguggucguugaugagcacugcggguccagaggacccaguuuaaggacgacuaccgugacaggcaagauuauccaugaaugguguugccgcagcuguacccucccuccacugcgguucaaaggugaggacgggugcugguacggaauggaaauuagacccguaaaggagaaggaagagaaucuugugaaaucuauggucuccgcaggcucaggugagguggauaguuuuagccugggcuugcucuguaugucgaucaugauagaagagguuaugaggucccgcuggucucgaaagaugcugaugacugggacacuagcgguguuccugcuccugaccaugggacagcuuacauggaacgacuugauucggcugugcaucauggucggcgccaaugcuagcgauaaaauggggaugggaacuacccacuuagcccucauggcaacguuucguaugagaccuauguucgcugugggccugcuuuuuaggcgccugacaucacgggaaguucuacuccugaccguggguuugagucuggucgccuccguagaguuaccaaacucucucgaagagcugggggacggacuugcaaugggcaucaugaugcugaaguugcucacugacuuccaaagccaucagcugugggccgcucuacugucccuuaccuuugugaaaacaacucucucacugcacuaugcguggaagaccauggccaugauuuugagcaucguuagucuguuccccuuaugucucucuacgacaucccagaagaccacuuggcugccggugcuucugggcagcuuggggugcaaaccucucacaauguuucugauuaccgagaacaagauauggggaagaaaaucguggccacuaaaugaagguaucauggcagucggcauugugucaauccugcuuucuagucuccugaagaacgauguacccuuggcugggccuuuaauugccggaggcaugcugaucgccuguuacgugauauccgguagcucugcugaccucagccuggagaaagcagccgaagucuccugggaggaagaggcggagcauucaggggcuagucacaauauccuuguugaagugcaggaugacggaacuaugaagauuaaagaugaggaaagggacgauacacugaccaucuugcuaaaggccacgcugcucgcaauuagcggcguguaucccaugucuaucccagccacucuguucgucugguacuuuuggcaaaagaaaaagcagcgauccggcgugcuuugggacaccccuucacccccagagguugagcgcgcuguauuagaugacgggauauaucggauucugcagagaggacucuuggguaaaagucaggugggcgucgggguguuccaagaaggaguuuuccacacaauguggcaugugaccaggggcgcaguccugauguaccaggguaagcgucucgagccgagcugggccuccgugaaaaaggaucugaucucuuaugggggaggcuggcgcuuucagggcucguggaacacaggggaagagguacaggucaucgcgguggaaccuggaaagaaucccaaaaacguucaaacugcuccagguaccuucaagacgcccgagggcgaggugggggccauugcacuugacuuuaaaccuggaacaagcggcucaccaauagucaaucgggaagguaagaucguggggcuguacggaaacggcguugugacuaccuccggcacauacgucagugccauugcucaggccaaagcaucucaggaggggcccuugccugaaaucgaggaugaaguguucagaaagaggaaucuaaccauuauggaccugcacccgggaagcgguaagacucgacgguaucucccagcuaucguacgcgaggccauaaaaagaaaguuaaggacccuggugcuugcgcccacacggguugucgccuccgagauggcagaagcucugaaaggcaugccuauccgauaccaaacgacugccgugaagucagagcauaccgggaaagaaauuguggaccucaugugccacgcuacauuuaccaugagauugcugucuccaguccgcguacccaacuauaauaugaucauuauggaugaggcacauuucacugacccugccagcaucgccgcuaggggauacauaaguacacgugugggcaugggugaagcggcagccauuuuuaugaccgcuacgccgcccggguccaucgaggccuucccacagagcaacgcagccauccaggaugaggaacgggacauuccugagagaucuuggaauucaggauaugauuggaucacugacuuucccggcaagacaguuugguucgugccauccauaaagaguggcaacgauauugcuaauugucucaggaaaaacgggaagcgcgucauccagcugagccgaaaaaccuuugacaccgaauaccaaaagacuaaaaacaaugauugggacuaugugguuacaaccgauauuucggagaugggagcgaacuucagagccgaccgggugaucgacccuaggcgcugccuuaagcccgucauacuaaaggaugguccagagcgugugauucuggcaggcccgaugccuguaacaguggcuucugccgcacagagacgggggaggaucggacgcaaucagaacaaagaaggcgaccaguacaucuacaugggucaacccuugaauaacgaugaggaccacgcccacuggacugaagcuaagauguuacuggauaauauuaacacgccagaggggaucauucccgcccucuucgaaccugagcgagagaaauccgcggcaauagacggcgaauauagacugcggggagaggccaggaagaccuuuguugaacuuaugcgcagaggcgaucugccagucuggcucagcuacaaaguggcuucagagggguuccaguauagugacaggcgguggugcuuugauggagaacguaauaaccagguguuggaggagaauauggacgucgaaaucuggacaaaggagggugaacgcaaaaagcugcgacccagauggcuagaugccaggacuuacucugacccucuggcucuccgggaguucaaggaauuugcagccggccgcagauccguuagcggggaucuuauucuggagaucggaaaauuaccgcagcauuugacccaaagggcucagaacgcccuggacaaucucgugaugcugcacaacucagagcagggcgguaaggcauaucggcaugcgauggaagagcuuccagacacaaucgaaacccugaugcucuuggcccugauugcuguauuaacugggggcgugacgcuauucuuucugaguggacgaggccucgggaaaaccagcauaggacuucugugugucauggccuccucugcauugcuguggauggcuagcguggagccccacuggaucgccgcauccauuauccucgaguucuuucugaugguucuucucauuccugaacccgauagacagcgcacaccacaagacaaucagcuggccuacguggucaucgguuugcuguucaugauauuaacuguagcugcgaacgagaugggccuacuggaaaccacaaagaaagaucucgggaucggacacgccgcagcugagaaccaucaccaugccgccaugcuugacguggaucugcacccugcaucagcuuggaccuuguaugccguugcgacuacaauuaucacgcccaugaugaggcauaccauugaaaauacuacagcuaacaucucucugaccgccauagcaaaucaggccgcuauucucaugggccuggacaaggguuggccaaucaguaagauggauauuggggugccucuuuuagcacugggcugcuacucgcaagucaacccgcucaccuugacagccgcggugcugaugcuagucgcucacuacgccaucauaggacccggccugcaggcaaaagccacucgggaggcucagaagcguacggccgcagggaucaugaaaaauccaaccguggacggaauuguugcuaucgaucucgacccugugguauaugaugccaaguuugagaaacagcuuggccaaauuaugcuguugauccuguguacaagccagauacuccugaugagaacuaccugggcguuaugcgaauccauuacacuugccaccgguccccugacuacgcucugggaggggucuccaggaaaguucuggaacacaaccaucgcagugucaauggcuaauaucuuuaggggcagcuaccuagccggugcaggccuggcuuucuccuugaugaagagucuggggggaggccgccgggggacuggagcccagggcgaaacccucggugagaaauggaagcgacagcuuaaccaacugucuaaaagcgaauucaauacauauaagagaucagggauuauggaggucgacagguccgaggccaaagaaggauugaagcgcggcgagacuaccaagcacgcgguuagucgggguacagcuaaacugagaugguuuguggaacguaaccucgucaagccugagggcaaagugaucgauuuaggguguggaaggggcggguggagcuacuauugcgcaggacugaagaaaguaacggaagugaagggcuacaccaaaggugggcccggacaugaggagccgauaccaauggccacuuauggcuggaaucuuguuaagcugcacucuggcaaggacguguucuuuacaccucccgaaaaaugugacacccuacucugcgauauuggggaguccucaccaaaccccacuaucgaagagggacggacacugcgcgucuugcgaaugguggagccuuggcugagagguaaucaguucuguauuaagguccucaacccguacaugcccagcgugaucgaaacccuugagcagaugcagaggaaacauggcgggaugcugguucggaauccauuaucgcgcaacucuacgcacgaaauguacuggguaaguugcggaaccggcaauauaguguccgcugucaacaugacaagcagaaugcuguugaacagguuuacuauggcccaccgaaagccuaccuaugagcgggacguggaucucggugcagggacacgucauguugccguggaacccgaggucgcuaaucuggacaucauuggacaaagaaucgagaacauuaaaaaugaacacaagucaacuuggcauuacgaugaggacaacccuuauaagaccugggcguaccacggcuccuaugaagugaaaccaucuggcagcgccaguuccaugguaaauggggugguucgccuacuuacaaagcccugggaugucaucccuauggugacccagauugcaaugacugacacgacaccauucggacagcaaaggguguuuaaagagaaggucgauacccggacucccaaagcuaagagagguaccgcccagaucauggaaguuacagcacgcuggcuguggggcuuccucagcaggaacaagaaaccgcgaauauguacgcgggaggaguuuaccagaaaggugaggucuaaugccgcuauuggggccguauucguggacgaaaaccaguggaauucagcgaaagaggcagucgaagaugagcgcuuuugggaccuggugcaucgugaacgggaguugcacaagcagggaaaaugcgccacuugcguuuacaacaugaugggcaagagagagaagaaacugggugaauucgggaaggcuaaaggaaguagggccaucugguauauguggcucggcgcacgcuuucuugaguucgaagcucugggcuucaugaaugaggaccacugguuuucccgagagaacagcuuaucugggguggaaggagagggucugcauaaguugggcuacauccuccgggauauuucgaaaauaccugggggaaauauguacgccgacgauacagcuggcugggacaccagaaucacugaagaugaccugcaaaacgaggccaagauuacagauaucauggaaccagagcacgcacuacuugcgaccucaauuuucaaacugacauaucagaauaaggucgugaggguacagcgccccgccaagaacgguacuguuauggacgugaucagcagacgggaucagaggggguccggacaagucggcaccuacggccucaacacguuuaccaauauggaggcucagcugauacgucagauggaaagugaggggaucuucacaccuucugaauuggagacuccaaacuuagccgaacgagugcuggacuggcucgagaaacauggaauugagcgccuuaagagaauggcaaucagcggugaugacuguguggucaaacccauugaugaccgguuugcuaccgcccugacagcacuaaaugacaugggcaagguuaggaaagauaucccgcagugggaaccuuccaagggguggaacgacuggcaacaggugcccuucugcucacaccacuuucaucagcugauaaugaaggauggacgcgagauuguagugccauguagaaaucaggacgaacucgucggccgggccagggugagucaaggugcgggguggucuuugcgagagacugcuugccugggaaaaagcuaugcccagauguggcagcuuauguacuuccaccguagagaucugcgccucgcagccaacgcuaucuguuccgccguuccuguggacuggguccccaccucacggacgacauggagcauccaugcacaccaucaauggaugaccacugaagauauguuaucuguguggaauaggguauggauugaggagaacccauggauggaagacaagacacacguuuccaguugggaggaugugcccuaucugggcaaaagagaagaccaguggugcggcagcuugauagggcugaccgcucgcgccacuugggcgaccaauauccaggucgcuauuaaccaggugcggaggcucaucggaaaugagaacuaccuugauuauaugacaucgaugaagcgauuuaaaaaugaguccgacccugaaggugcccugugguga

SEQ ID NO: 14162 - RNA, 9879 nt, Artificial Sequence
  derived and/or modified CDS sequence (opt3) from DENV-1__KC762624__SS-prME
agcgugaccaugcugcucaugcuuaugcccacggcccuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacuggaucguucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuacaucucaacauaauuaucgaccaggcuacuucacccagacugccgggccguggcaccugggaaaacuugaguuggauuuugaccugugcgaaggcacaaccgucgugguggaugagcacugcgggaacagaggacccuccuuaaggacgacuaccgucacaggcaagaucauucaugaaugguguugccgcaguuguacccucccuccacugcgguucagaggugaggacgggugcugguacggaauggagaucaggcccguuaaagaaaaggaggaaaaucuugugaaguccaugguaucugcuggcuccggugagguggacucauuuagucugggcuugcucuguauaagcauuaugaucgaagaggucaugcgcucgcgauggucccggaaaaugcugaugacugggacacuagccguguucuuucugcucaucaugggacagcugaccuggaacgaucuuauucguuugugcaucaugguuggcgcaaaugcuucugacagaauggggaugggaacaacuuaucuggccuuaauggcaaccuucaagaugaggccuauguuugccgugggccuccuguuccgccggcuuacgagcagagagguccugcuacucacaauuggucugucauugguggcuaguguugaacugccaaacuccuuagaggaacucggggauggacuggcgaugggcauaaugauccuuaaacuguugaccgacuuucaaucucaccagcucugggccacucugcuaagccugaccuucauuaagacaacuuuuucccuucauuacgcauggaaaaccauggcuauggugcucucaaucgucagccuguuccccuugugucugaguacgacaucucagaagaccacuugguuaccgguacuccugggcucccuugggugcaagccucugacaauguuuuugauugccgagaauaaaaucuggggaagaaagagcuggccacucaacgaagguauaauggccgugggcaucguuucgauucugcuaucaucucugcuuaaaaacgaugugccccucgcugggccucugaucgcaggaggcauguugauugccuguuaugucaucagugguuccagcgcggacuuaucucuggagaaggcugccgaggugagcugggaagaggaagcagagcacuccggggccucacauaauauacucguagaagugcaggaugacggaaccaugaaaauuaaggaugaggagcgagacgauacucugacaauccuucugaaagcuaccuugcuagcagucaguggcguuuacccccugagcaucccagccacacucuucgugugguauuucuggcaaaagaagaaacagcgcucuggcgugcugugggacacuccuucacccccagaagucgagcgggcggugcuugaugacgggauuuacagaauaaugcagaggggauuacugggucguagccagguuggcguagggguguuucaagaaaacgucuuccacaccauguggcacgugacacgcggagcuguucucauguaucagggcaagcgguuggagccgaguugggccagcgugaaaaaggaccugaucuccuacggugggggauggagacuccagggcucuuggaauaccggcgaggaaguccaggugauugcaguagagccugggaaaaaccccaagaauguccaaacagccccaggaacuuuuaagacccccgaaggugaggugggcgcuaucgcccuggauuucaaaccugggacgucgggaagcccaauuguuaacagggaaggcaagaucgugggucuuuacgggaauggagucgugacaacuucaggcaccuauguuuccgcaauagcucaggccaaagcgagucaggagggcccccugccugagaucgaagacgagguguuucgaaagcggaacuugacaauuauggaucuacauccggggucuggaaaaacccgcagauaccugccagccaucgucagggaagcaauuaagcggaagcuccgaacuuuaauccuggcucccaccagagugguagccagcgagauggcugaagcacuuaaagguaugccuauacgcuaucaaacaacggccgugaaguccgagcacacuggcaaagagauuguugaccugaugugccaugccaccuucacaaugaggcucuugucaccaguccgugugcccaauuacaacaugaucaucauggaugaagcucacuuuaccgacccuucuagcauugcggcacggggguauaucaguacuagagugggaaugggcgaggccgcugccauauucaugacagcaaccccgcccgguuccgucgaagccuuuccacagagcaaugcuguaauucaggaugaggaaagggacaucccugagcgcucuuggaacucaggguacgaguggauuacggauuuccccggaaagacugugugguuuguuccauccaucaaaaguggcaaugacauagcgaacugucugcgaaagaauggcaagagagugauucagcucagccggaaaacauucgauaccgaauaucaaaagaccaaaaacaacgacugggacuacgucgugacuacagauaucucggagaugggggccaauuucagggcagaccgcguuaucgauccucguagaugccugaagcccgugauucuuaaagacggaccagaacgggucauccuagcugguccgaugccugugaccguagccucugcagcccagaggcgcggccgaguggggagaaaccauaauaaggagggagaucaguacauuuauaugggccagccccugaacaaugacgaggaucacgcucacuggacagaagccaagauguuguuagacaacauaaauacuccagaggguaucauucccgcgcuguuugaaccugagcgggaaaaauccgcagccaucgauggggaguacaggcuccgcggcgaggcuagaaagacguucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagaucuggaccaaggagggagaaaggaaaaaguugaggccccgguggcuggacgcucgcacauauucugacccucuagcacugagagaguuuaaagaguucgccgcugguaggcgguccguuagcggcgaucucauucuugagauagggaagcugccgcagcauuuaacucagcgagcccaaaaugcauuggacaaccuggugaugcuccacaauucagaacagggaggcagagcguaccgccaugccauggaggagcugccagauaccaucgaaacacuuaugcugcucgcuuugauugccguacugaccgguggggugacuuuauuuuuccuaaguggcaggggacugggcaagacgagcaucgggcuccuuugugucauggcauccucugugcuguuguggauggcuagcguugagccccacuggauugccgcauccaucauacuggaauuuuuccucauggugcugcuuaucccugagcccgaccggcagcguaccccacaggauaaccaacucgccuaugucguaauuggacuguuguuuaugauccugacaguggcugcgaaugagauggguuuacuagaaacuaccaaaaaggaccugggcauugggcacguugccguggagaaccaucaccaugcagcuaugcucgaugucgaccuucacccugccucagccuggacacuguacgcaguggcuaccacuaucauaacacccaugaugagacauacgauugaaaacaccacugccaauaucucuuugacagcgauugcuaaccaggccgcaauccugaugggacucgauaaaggcuggccaauaaguaagauggacaucggugucccucugcuugccuuagggugcuacagccaggugaauccgcugacccucaccgcugcaguuuugaugcugguggcccacuaugcgauuaucggccccggacuacaagcuaaagccacaagggaggcacagaagcgcacugccgcuggcauuaugaagaacccaacgguagaugggaucguggccauagaccuggauccugucguuuacgacgcaaaauucgaaaagcagcucggacagauuaugcuucugaucuuguguaccagccaaauccugcucaugcggacaacuugggcucugugcgaguccauuaccuuagccacaggcccccuuaccacucugugggaggguucuccagggaaauuuuggaauacgacaaucgcggugucaauggccaacauauuccgaggaagcuaucucgcaggcgcuggucuagccuucucccugaugaagaguuugggcgggggaagaaggggcaccggggcacagggagaaacucugggcgagaaauggaagcgccagcucaaucagcuuucuaagagcgaauuuaacaccuacaaacggucagguauuauggaggucgacagauccgaagcuaaggaggggcugaaacguggagagacaacuaagcacgccgugaguaggggcaccgccaaauugcggugguucguagaacgcaaucuggugaagccugaggguaagguuaucgaucucggcugugggcgaggaggcuggagcuauuacugcgcggggcuaaagaaggugacagaagucaaaggauauacgaagggcggucccgggcaugaggaaccgauuccaauggcuaccuacggauggaaccuggugaaacuucacucuggcaaggacgucuuuuucaucccucccgagaaaugugauacucugcuaugcgacauaggcgaguccucaccaaaucccacaaucgaagaggggagaacccucagggugcugaagaugguugaaccuugguugcggggaaaccaauuuuguauuaagauccugaauccguacaugcccagcguaguggagacucucgagcagaugcagcgcaaacaugguggcaugcuugucagaaacccacugucgagaaauucuacacacgaaauguauugggugaguugcgggaccggaaacauuguuuccgcagugaauaugacgagccgaauguuacugaaccgguucaccauggcccaccguaagccuacauacgagagagaugucgacuugggcgcugguacucgccauguggccguagaacccgagguggcaaaccucgauaucauugggcagaggaucgaaaauauaaaacacgagcauaagucaaccuggcacuaugacgaggauaacccuuacaaaacaugggccuaucauggauccuacgaaguuaagccaucuggcagcgcuaguuccauggucaauggcguggugaagcugcuaacuaaacccugggacgucauuccuaugguuacccaaaucgcgaugacagauaccacuccauuugggcagcagcggguguucaaggagaaaguagacacgagaacacccaaggccaaacgcggaaccacucaaaucauggaagugaccgcaagguggcuuugggguuuucugagccgaaacaagaagccgcggauuuguacaagagaggaguucacgaggaaaguccgcucuaaugcugccauaggcgcaguguuuguugacgagaaccaguggaacucagccaaggaggcuguggaagaugagcguuucugggaccucguccaccgggaaagagagcugcacaaacaggggaagugcgcaaccugcguguauaacaugaugggaaaaagggaaaagaaguugggcgaguuugguaaagcgaaggggagucgcgcaaucugguacauguggcugggagcccgauuccucgaguucgaagcucuuggcuuuaugaaugaggaucauugguucucccgggaaaacagccugucuggcguagagggggagggauuacacaaacuggguuacauuuugagagacaucucgaagauuccuggcgggaauauguaugccgaugacacugcaggaugggauacaaggaucaccgaagacgaucuccagaacgaggcuaaaauaacugacaucauggaaccagagcaugcccugcuagcuaaggccauuuuuaaacuuacauaccaaaauaagguugugcgcguccagagacccgcaaagaacggcaccgugauggaugugaucucacggagggaccagcgugguagcgggcaggucggaacauauggccugaauacuuucaccaacauggaagcgcaacucauucgacagauggaguccgagggcaucuuuaguccuucugaacuggagacgccaaacuuggccgaacgcguuuuagauuggcuggagaaauacgggguggaaagacucaagcggauggcuauaagcggagacgacuguguagugaaacccauugaugacagguucgccaccgcacuuacagcucugaaugauauggguaagguccgcaaagacaucccgcagugggagccuuccaagggcuggaacgauuggcagcaagugcccuuuugcucacaccacuuccaucagcuaaucaugaaggacgggagagagauuguugugccaugucggaaucaggaugaacuggucggaagggcccgagugagucagggcgcagguuggucucuccgugagacugccugcuuggggaaaagcuaugcgcaaauguggcagcugauguacuuucacagacgcgaccuucggcuggcugccaacgcaauauguuccgccguaccuguugauugggugcccaccucaaggacaacuuggagcauccaugcucaccaucaguggaugaccacggaagacaugcucucugucuggaauagaguguggauugaggaaaacccauggauggaggauaagacacacguuuccaguugggaggacgugcccuauuuaggaaaacgcgaagaccaauggugcggcagccugaucggcuugaccgcccgggcaacuugggcuacaaauauucaggucgccaucaaccaggugaggcgacugauagggaaugagaacuaccucgauuacaugaccucgaugaagagauucaaaaaugaauccgacccugagggagcgcuuugguga

SEQ ID NO: 14163 - RNA, 9879 nt, Artificial Sequence
  derived and/or modified CDS sequence (opt3) from DENV-1__KC762644__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacugggucguucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuaucucucaacauaauuaucgaccaggcuacuucacacagaccgccgggccguggcaccugggaaaacuugaguuggauuuugaccugugcgaaggcacuacagucgugguggaugagcacugcgggaacagaggacccuccuuaaggaccacgacugucaccggcaagauuauccaugaaugguguugccgcaguuguacacucccuccacugcgguucagaggugaggacgggugcugguacggaauggagauaaggcccguuaaagaaaaggaggaaaaucuugugaaguccaugguaucugcuggcuccggugagguggacucauuuagucugggcuugcucuguauuagcaucaugaucgaagaggucaugcgcucgcgauggucccggaaaaugcugaugaccgggacucuagccguguucuuucugcucauuaugggacagcugacauggaacgaucuuauccguuugugcauuaugguuggcgcaaaugcuucugacagaauggggaugggaaccacauaucuggccuuaauggcaacuuucaagaugaggccuauguuugccgugggccuccuguuccgccggcuuaccagcagagagguccugcuacucacgauaggucugucauugguggcuaguguugaacugccaaacuccuuagaggaacucggggauggacuggcgaugggcaucaugauucuuaaacuguugacagacuuucaaucucaccagcucugggccacccugcuaagccugacuuucaucaagaccacauuuucccuucauuacgcauggaaaacuauggcuauggugcucucaauugucagccuguuccccuugugucugaguaccacgucucagaagacaaccugguuaccgguacuccugggcucccuugggugcaagccucugacuauguuuuugaucgccgagaauaaaauauggggaagaaagagcuggccacucaacgaagguaucauggccgugggcauuguuucgauccugcuaucaucucugcuuaaaaacgaugugccccucgcugggccucugauugcaggaggcauguugaucgccuguuaugucauaagugguuccagcgcggacuuaucucuggagaaggcugccgaggugagcugggaagaggaagcagagcacuccggggccucacauaauauucucguagaagugcaggaugacggaacaaugaaaaucaaggaugaggagcgagacgauacccugacuauccuucugaaagcuacauugcuagcagucaguggcguuuacccccugagcauuccagccacccucuucgugugguauuucuggcaaaagaagaaacagcgcucuggcgugcugugggacacgccuucacccccagaagucgagcgggcggugcuugaugacgggauauacagaaucaugcagaggggauuacugggucguagccagguuggcguagggguguuucaagaaaacgucuuccacacuauguggcacgugacccgcggagcuguucucauguaucagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauuuaagacucccgaaggugaggugggcgcuauugcccuggauuucaaaccugggaccucgggaagcccaaucguuaacagggaaggcaagauagugggucuuuacgggaauggagucgugacgacaucaggcacuuauguuuccgcaaucgcucaggccaaagcgagucaggagggcccccugccugagauugaagacgagguguuucgaaagcggaacuugaccaucauggaucuacauccggggucuggaaaaacacgcagauaccugccagccauugucagggaagcaaucaagcggaagcuccgaaccuuaauacuggcucccacuagagugguagccagcgagauggcugaagcacuuaaagguaugccuauucgcuaucaaaccacagccgugaaguccgagcacacgggcaaagagaucguugaccugaugugccaugccacuuucaccaugaggcucuugucaccaguccgugugcccaauuacaacaugaucauuauggaugaagcucacuuuacagacccuucuagcaucgcggcacggggguauauaaguaccagagugggaaugggcgaggccgcugccauuuucaugacugcaacaccgcccgguuccgucgaagccuuuccacagagcaaugcuguaauccaggaugaggaaagggacauuccugagcgcucuuggaacucaggguacgaguggaucaccgauuuccccggaaagacggugugguuuguuccauccauaaaaaguggcaaugacauugcgaacugucugcgaaagaauggcaagagagugauccagcucagccggaaaacuuucgauacagaauaucaaaagaccaaaaacaacgacugggacuacgucgugaccacugauaucucggagaugggggccaauuucagggcagaccgcguuauugauccucguagaugccugaagcccgugauccuuaaagacggaccagaacgggucauucuagcugguccgaugccugugacaguagccucugcagcccagaggcgcggccgaguggggagaaaccauaauaaggagggagaucaguacauauauaugggccagccccugaacaaugacgaggaucacgcucacuggaccgaagccaagauguuguuagacaacaucaauacaccagaggguauuauccccgcgcuguuugaaccugagcgggaaaaauccgcagccaucgauggggaguacaggcuccgcggcgaggcuagaaagacuuucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagauuuggacgaaggagggagaaaggaaaaaguugaggccccgguggcuggacgcucgcaccuauucugacccucuagcacugagagaguuuaaagaguucgccgcugguaggcgguccguuagcggcgaucucauacuugagaucgggaagcugccgcagcauuuaacacagcgagcccaaaaugcauuggacaaccuggugaugcuccacaauucagaacagggaggcagagcguaccgccaugccauggaggagcugccagauacuauugaaacccuuaugcugcucgcuuugaucgccguacugacagguggggugaccuuauuuuuccuaaguggcaggggacugggcaagacuagcauugggcuccuuugugucauggcauccucugugcuguuguggauggcuagcguugagccccacuggaucgccgcauccauaauccuggaauuuuuccucauggugcugcuuauuccugagcccgaccggcagcguacgccacaggauaaccaacucgccuaugucguaaucggacuguuguuuaugauucugaccguggcugcgaaugagauggguuuacuagaaacaacuaaaaaggaccugggcaucgggcacguugccguggagaaccaucaccaugcagcuaugcucgaugucgaccuucacccugccucagccuggacccuguacgcaguggcuacaaccauaauuacucccaugaugagacauacaaucgaaaacacgaccgccaauauuucuuugacugcgaucgcuaaccaggccgcaauacugaugggacucgauaaaggcuggccaaucaguaagauggacauuggugucccucugcuugccuuagggugcuacagccaggugaauccgcugacacucaccgcugcaguuuugaugcugguggcccacuaugcgaucauuggccccggacuacaagcuaaagccaccagggaggcacagaagcgcacagccgcuggcaucaugaagaacccaacuguagaugggauaguggccauugaccuggauccugucguuuacgacgcaaaauucgaaaagcagcucggacagaucaugcuucugaucuuguguacgagccaaauucugcucaugcggaccacaugggcucugugcgaguccaucacuuuagccaccggcccccuuacaacccugugggaggguucuccagggaaauuuuggaauacuacgauagcggugucaauggccaacauuuuccgaggaagcuaucucgcaggcgcuggucuagccuucucccugaugaagaguuugggcgggggaagaaggggcacaggggcacagggagaaacccugggcgagaaauggaagcgccagcucaaucagcuuucuaagagcgaauuuaacacuuacaaacggucagguaucauggaggucgacagauccgaagcuaaggaggggcugaaacguggagagaccacaaagcacgccgugaguaggggcacugccaaauugcggugguucguagaacgcaaucuggugaagccugaggguaagguuauugaucucggcugugggcgaggaggcuggagcuauuacugcgcggggcuaaagaaggugaccgaagucaaaggauauacaaagggcggucccgggcaugaggaaccgaucccaauggcuacguacggauggaaccuggugaaacuucacucuggcaaggacgucuuuuucauaccucccgagaaaugugauacccugcuaugcgacaucggcgaguccucaccaaaucccacuauugaagaggggagaacacucagggugcugaagaugguugaaccuugguugcggggaaaccaauuuuguaucaagauucugaauccguacaugcccagcguaguggagacccucgagcagaugcagcgcaaacaugguggcaugcuugucagaaacccacugucgagaaauucuacucacgaaauguauugggugaguugcgggacaggaaacaucguuuccgcagugaauaugaccagccgaauguuacugaaccgguucacgauggcccaccguaagccuaccuacgagagagaugucgacuugggcgcugguacacgccauguggccguagaacccgagguggcaaaccucgauauuaucgggcagaggauagaaaauauuaaacacgagcauaagucaacuuggcacuaugacgaggauaacccuuacaaaaccugggccuaucauggauccuacgaaguuaagccaucuggcagcgcuaguuccauggucaauggcguggugaagcugcuaacaaaacccugggacgucaucccuaugguuacucaaaucgcgaugaccgauacaaccccauuugggcagcagcggguguucaaggagaaaguagacacuagaacgcccaaggccaaacgcggaacaacccaaauuauggaagugacugcaagguggcuuugggguuuucugagccgaaacaagaagccgcggauauguaccagagaggaguucacaaggaaaguccgcucuaaugcugccaucggcgcaguguuuguugacgagaaccaguggaacucagccaaggaggcuguggaagaugagcguuucugggaccucguccaccgggaaagagagcugcacaaacaggggaagugcgccacgugcguguauaacaugaugggaaaaagggaaaagaaguugggcgaguuugguaaagcgaaggggagucgcgcaauuugguacauguggcugggagcccgauuccucgaguucgaagcucuuggcuuuaugaaugaggaucauugguucucccgggaaaacagccugucuggcguagagggggagggauuacacaaacuggguuacaucuugagagacauuucgaagaucccuggcgggaauauguaugccgaugacaccgcaggaugggauacuaggauaacagaagacgaucuccagaacgaggcuaaaaucaccgacauuauggaaccagagcaugcccugcuagcuaaggccaucuuugaacuuacuuaccaaaauaaaguugugcgcguccagagacccgcaaagaacggcacagugauggaugugauuucacggagggaccagcgugguagcgggcaggucggaaccuauggccugaauacauucacuaacauggaggcgcaacucauccgacagauggaguccgaaggcauauuuaguccuucugagcuggaaaccccaaacuuggccgagcgcguuuuagauuggcuggaaaaguacgggguggagagacucaaacggauggcuauuagcggagacgacuguguagugaagcccaucgaugacagguucgccacggcacuuaccgcucugaaugauauggguaaaguccgcaaggacaucccgcagugggagccuuccaaaggcuggaacgauuggcagcaagugcccuuuugcucacaccacuuccaucagcuaauuaugaaggacgggagagaaauaguugugccaugucggaaucaggaugagcuggucggaagggcccgagugagucagggcgcagguuggucucuccgugaaacagccugcuugggaaagagcuaugcgcaaauguggcagcugauguacuuucacagacgcgaccuucggcuggcugccaacgcaaucuguuccgccguaccuguugauugggugcccacuucaaggaccacauggagcauucaugcucaccaucaguggaugacuaccgaggacaugcucucugucuggaauagaguguggaucgaagagaacccauggauggaggauaaaacgcacauuuccaguugggaagacguucccuauuuaggaaagcgcgaggaccaauggugcggcagccugaucggcuugacagcccgggcaaccugggcuacuaauauacagguggccaucaaccaggucaggcgacugauugggaaugaaaacuaccucgauuacaugacaucgaugaaaagauucaagaaugaguccgacccugagggagcgcuuugguga

SEQ ID NO: 14164 - RNA, 9879 nt, Artificial Sequence
  derived and/or modified CDS sequence (opt3) from DENV-1__KC762630__SS-prME
agcgugacaguacuguucaugcuccuucccacagcccuggcuuuucacuugacuacgcgaggcggggaaccucauaugaucguuuccaagcaggaaaggggaaaaucuuuacuguucaagaccucagccggugugaacaugugcacacugauugccauggaccucggcgagcugugugaagauacuaugaccuacaaaugcccacggauaacagagaccgaaccggacgauguagacuguuggugcaaugcgacugagacaugggugaccuaugggacguguagucagacuggagagcaccgccgagauaagcguagcgucgcucuugcaccccaugugggccuggguuuggaaaccagaacagagacuuggauguccucugaaggggcauggaaacagauccagaagguugagaccugggcccucaggcacccuggauuuacagugauugcucuguuccuggcacaugccaucggcaccucgauuacgcagaagggcaucauauuuauccucuuaaugcuggucacuccaucaauggcuaugcggugcguggggauuggaaaccgcgacuucguagagggucuuagcggcgccacauggguugauguggucuuggaacacgggaguugugugaccacuauggcgaaaaauaagcccacacuggacaucgagcuacucaaaaccgaagugacgaacccugcaauucugagaaaacuuugcaucgaggccaaaauauccaauaccacaacugauucuagguguccaacccaaggagaagcuacacuggucgaggagcaggacacuaacuuuguuugccggcgcaccuucguggaucgaggcugggguaauggguguggauuguuuggcaagggcagccucauuacaugcgccaaguucaaaugcguaaccaagcuggaagggaaaaucgugcaguacgagaacuuaaaguauuccgucauugugacuguucacacgggagaccagcaucaaguggguaaugaaacaaccgagcacggcacuaccgcaaucaucacaccccaggcuccuaccucagaaauucagcugacugauuacggggcccucacacuugacuguaguccaagaacgggacuggacuuuaacgagauggucuugcuaaccaugaaagagaaaagcuggcuggugcauaaacagugguuccucgaucugccgcuucccuggacuucuggcgcguccacaucacaagaaaccuggaauaggcaggaccuguugguaacauuuaagacugcccacgcaaagaaacaggaaguugugguccucgguagccaagaaggggcuaugcacaccgcccugacgggcgcuaccgagauacagacaaguggaacuaccacaaucuucgccggccauuuaaagugccggcugaaaauggauaagcuaacucucaaaggggugucuuaugucauguguaccggauccuucaagcuggaaaaggagguggcagagacgcagcacgguacaguucuugugcagguaaaauacgaaggcaccgacgccccuugcaagauuccauuuagcucgcaagaugagaaaggggucauccagaacggacguuugauaacugcuaaucccauugugacagacaaggaaaaaccuguuaacaucgaggcggagccacccuucggcgaaucuuauaucguggucggugcaggggagaaggcccugaagcucuccugguuuaaaaagggcucaaguauuggaaaaauguucgaagcuaccgcccgcggcgcaagaaggauggccauccugggggauacugcuugggacuuuggaagcauugguggcguguucaccuccguagggaaacuugugcaucagauauuuggaacagccuacggcguucuguucucuggugucagcuggacgaugaaaaucgggauuggcaucuugcucaccuggcugggauuaaauucacggaguacuucccugagcaugacauguaucgcagugggcauggugacccuauaccucggggucaugguucaggcggauucuggaugcgugauuaacuggaagggccgagagcugaagugugguucagggauauuugugacaaacgaaguacacacuuggaccgagcaauauaaauuccaggcugacaguccgaagcgccuuagcgccgcaaucggaaaagccugggaggaaggcgucugcgguauuagauccgcuacgagguuggagaauaucauguggaagcagauuucuaacgaacugaaucauauccuccuggagaacgauaugaaauuuacagugguugugggcgacgucucggggauauuagcccagggaaagaaaaugauccggccucaacccauggaacacaaguacagcuggaaguccuggggcaaagcaaagauuaucggggcugacgugcagaauaccacuuucauuaucgauggaccaaacaccccugagugucccgacaaucagcgcgccuggaacauaugggagguugaagauuauggcuuugguauuuucacaacuaauaucuggcugaaacuuagagacucauacacccaggugugcgaucacagguugaugagugcggccauuaaggacucuaaagcuguacaugcagauaugggguauuggaucgagagcgaaaagaacgagacauggaagcucgcccgugcuuccuucauagaagucaaaacguguaucuggccaaagucacacacccuguggagcaauggagugcuagagucugagaugauuauccccaaaauuuacggcgguccugugucccaacauaacuaucggccaggcuacuuuacucagacagccgggccguggcaccugggaaagcucgaacuggacuucgaucuuugcgagggcaccacugucguuguggacgaaaauugcgggaaccgaggacccaguuugagaacaaccacgguaacuggcaaaaccauccacgagugguguugcaggagcuguacacugccuccauuacgcuuuaagggugaggaugggugcugguacggaauggaaauacggcccgugaaggagaaagaagagaaucucgucaagucuaugguguccgcaggcucaggugaaguugacaguuucagccugggccuucuguguauuucgaucaugaucgaggaggugaugagauccagguggucucgcaaaauguugaugaccgggacucucgcggucuuucugcuacugacaaugggacagcucaccuggaacgaucugauucgacuuugcaucauggugggcgccaacgcuagcgacaugauggggaugggaacaacuuauuuggcccugauggcaaccuuccggaugcguccuauguuugcuguuggcuuacucuucagaaggcugacgucacgcgaaauucuucugcuaacagugggucucagucuggucgccuccguagaguugccaaauucucuggaagaguuaggggacggacucgcaaugggcauaaugaugcugaaacuucugaccgauuuucaaccccaucaguugugggccacucuccugagccuaaccuucgugaaaacaacucugucccuucacuacgcuuggaagaccauggcgaugauccucucaauuguuagccuguugccgcuguguuuaaguacgacaucucagaagaccacuuggcucccugugcugcuuggcucccuggggugcaaaccauugacaauguuucucaucaccgaaaacaagauuuggggacggagaagcuggccccugaaugaggguaucauggccauaggcaucgucucgauucuacugucaucucuucucaaaaacgacgugccucuggcagggcccuugaucgcuggaggcauguuaauugccuguuauguaaucagugguuccagcgccgaucugucucucgagaaggcugcagaagugagcugggaggacgaagccgagcauuccggggcgucacacaauauacuggucgaaguucaggaugacggaacuaugaaaauuaaggaugaggagagggacgauacacuuaccauccuguugaaagcuacgcuacuggugaucaguggcguguacccaaugagcgucccugccacucucuucgugugguauuuuuggcaaaagaagaaacagcgaucuggcguucugugggacacccccuccccaccggaaguagagcgcgcagugcuugauaacgggauuuaccggauauuacagagaggacugcucgguaggucacaggucggcguggggguuuuccaagaaggaguguuccauacaauguggcacgucacccguggcgccguguugauguaucaggguaagcgccuggagccuaguugggcuagcgucaagaaggaccucaucuccuacgggggaggcuggcgguuucagggcucuuggaauacaggggaggaaguccaggugauugcaguugagcccggcaagaacccaaagaaugugcaaacuacccccgguacguucaagacaccugaaggcgagaucggggccauugcgcuggauuuuaaaccaggaacuucgggcagccccaucgucaacagagaagguaagauaguggggcuuuacggaaauggcguugugaccacaucaggcaccuaugucuccgcuaucgcccaggcaaaagugagucaggaggggccucugccggagauugaagacgagguauucaggaagcgaaacuugacuaucauggaccuacacccaggaucugguaaaacccggcgcuaccugcccgccauugugagagaagcuaucaagaggaagcuccggacauuaguucuggccccuacgcgagucguggcaagcgagauggcugaagcccuuaaaggcaugccaauaagauaucaaacuaccgcggugaaguccgagcauacagggaaagagauugucgaucugaugugccacgccaccuuuacuaugcgccucuugucacccguaagggugccuaauuacaacaugaucaucauggacgaagcacauuucacagauccggcuucuauugccgcucguggauauaucagcacccggguuggcaugggugaggcagccgccauauuuaugacggcuacucccccagggaguguggaagcguucccucaguccaaugcagucauucaggacgaggaaagagauauccccgagaggagcuggaacucuggauacgaguggauuacagacuuuccaggcaagaccgugugguucguuccuucaaucaaauccggcaacgauauagccaauugucugcgcaagaacgggaagcgagugguccagcucaguagaaaaaccuuugacacugaauaucaaaagaccaagaauaacgauugggacuacgugguaaccacagauauuagcgagaugggagcuaauuuccgggccgacagggugaucgacccccgccguugccugaagccaguuauccuuaaagaugguccggaaagagucauucuagcaggcccuaugcccgugacuguggccucggcugcgcagcggagggggcgcaucggacgaaacccaaauaaggagggcgaccaguacgucuauaugggucagccccugaacaaugaugaggaccacgcccauuggacggaagcaaagauguuguuagauaacauuaauaccccugaggggauaaucccagcucuguucgaacccgagagagaaaaaucugccgcaauugacggcgaguaccggcucaggggagaggcccgcaagacauuuguugaacugaugagaaggggcgaucuuccuguguggcuguccuauaaaguagcuagcgagggguuccaauacucagaccggcguuggugcuuugauggagaacgcaacaaucaggugcucgaggaaaacauggacgucgagaucuggacuaaggagggugaaaggaaaaaguugagaccgagauggcuggaugcccggaccuauagugacccacuagcgcugcgcgaguucaaagaauuugcagccggcagaaggucuguguccggggaucucauccuugagauuggaaagcugccccagcacuuaacauugaaggcucagaaugcccuggacaaccucguuaugcugcacaacagcgaacaaggcgguaaggcuuaccggcaugcaauggaggagcuuccugacaccauagaaacucugaugcucuuggcccugaucgcuguguuaaccgggggagucacgcuauucuuucugucaggacgaggccucgggaagacaaguauuggacuucuguguguaauggccagcuccgcauugcuguggauggcgucuguggagccccacuggaucgccgcuagcauuauccucgaguucuuucugaugguucuucucauaccagagccugauagacagcgcacuccccaggacaaucagcuggccuauguggucaucgguuugcuguucaugauuuuaaccguggcagcuaacgagaugggccuacuggaaacaaccaaaaaggaucucgggaucggacaugccgcagccgagaaucaccaccaugcugcgaugcuugacgucgaucugcacccagccuccgcauggacuuuguacgcuguggccacaacgauuaucaccccuaugaugaggcauacuauagaaaacacaaccgccaauauuucacugaccgcaaucgcuaaccaagccgcgauucucaugggccuggacaaagguuggccgaucucuaagauggauauagggguuccccuuuuagcucugggcugcuacagucaggugaauccacucacauugacugccgcaguacugaugcuaguggcccacuaugcuaucauuggaccuggccugcaggcaaaggccacgcgggaggcgcaaaaacguaccgcugccgggaucaugaagaaccccacagucgacggaauuguugcaaucgaucucgacccagugauauacgaugccaaauuugaaaagcagcuuggccagauuaugcuguugauccuguguacuucgcagauccuccugaugagaaccacaugggcuuuaugcgagagcauuacccuugccacugguccucugacgacacucugggaggggucccccggaaaauucuggaauaccacuaucgcagucucuauggcuaacauauuuaggggcucauaucuagccggugcgggccuggccuucagcuugaugaagucccuagggggaggccgccgggggaccggagcacaaggcgaaacacucggugagaaguggaaacgacagcuuaaucagcugaguaagucugaguucaacauuuacaaaagaagcgggaucauugagguggacaggucagaagcuaaggagggauugaaacgcggcgagacuaccaagcaugccguaucccgggguacagcaaagcugagaugguuuguggaacguaaucucguuaaaccggagggcaaggugaucgauuuaggguguggaaggggcggguggaguuauuacugcgcuggacugaaaaaggucacggaagugaaaggcuauaccaagggugggccaggacacgaggaaccuauacccauggccacuuacggcuggaaccuugucaaacugcacagcggcaaggacguguucuuuacaccacccgagaagugugacacccuacucugcgauaucggggagucuuccccuaauccgacuauugaagagggacggacacugcgcguuuugaaaaugguagaacccuggcugcgagguaaccaguucuguaucaagauucucaauccauacaugccuucaguggucgagacccuugagcaaaugcagagaaaacauggcgggaugcuggugaggaaccccuuaagccggaacucgacgcacgaaauguauuggguuucuugcggaaccggcaauaucgugagugccgucaacaugacaucccgcaugcuguugaauagauuuacuauggcgcauaggaagccuaccuacgagcgagacguggaucucggugcugggacacggcacguagcaguggaaccagagguugccaaccuggacauuaucggacagcguauagaaaauauuaaaaacgagcacaagagcacuuggcauuaugaugaggacaaucccuacaagaccugggcuuaucacggcucauacgaagucaaaccuuccggcucugccagcaguauggugaacgggguggucagacuacuuacaaagccaugggauguuauccccauggugacccagaucgcaaugacugacacgacaccguucggacaacagcgcguauuuaaagagaagguggauaccaggacuccuaaagccaagcgggguaccgcucagauuauggaagucacagcgagauggcuguggggcuuccucucccgcaauaagaaaccaaggauauguacgcgagaggaauuuacccggaaggugagaagcaacgccgcaaucggggcuguuuucguggacgagaaucaauggaacucugccaaagaggcagucgaagaugagagguuuugggaccuggugcaucgcgaacgugaguugcacaagcagggaaaaugcgccacuugcguauauaauaugaugggcaagcgggaaaagaaacugggugaguucgggaaggcuaaaggaucaagagccauuugguacauguggcucggcgcgagguuucuugaguucgaagcacugggcuucaugaacgaggaccauugguuuagucgcgaaaauuccuuaagcgggguugagggagagggucugcacaaguugggcuacauccuccgagauauuucuaaaauccccgggggaaacauguaugccgacgauacagcuggcugggacacccggauaacugaagaugaccugcagaacgaggccaagaucacagauauuauggaaccugagcacgcacuacuugcuaccucgaucuucaaacugacauaccagaauaagguggucagagugcaaaggccagguaagaacgggacugugauggacgucauuucacgcagagaucagcggggaagcggccagguuggcaccuaugggcucaauacguuuaccaacauggaagcccagcugaucaggcaaauggaguccgagggaauauucagucccucugaauuggagacaccgaauuuagcugaacguguguuugacuggcuggagaaacaugguauugaacgacucaagcgcauggccaucagcggcgaugacuguguagugaaaccuaucgaugacagauucgcaacugcgcuuaccgcccugaacgacauggggaagguccggaaagauauuccccagugggagccauccaagggauggaaugacuggcaacaggugccuuuuugcucacaccauuuccaccaacuaauaaugaaggauggcagggagaucguugugcccugucgcaaccaggacgaacuggucgguagagcucgggugagucagggggccggauggucucucagggagacagcaugcuugggcaaaagcuacgcucagauguggcaacugauguauuuucaccgacgugaucuuagacuggccgcaaaugccauuuguuccgcgguaccaguugacugggugcccacuucacgcaccacguggagcauccaugcucaccaucaguggaugacaaccgaagauaugcucucugucuggaaccggguguggauugaggaaaauccuuggauggaggacaagacucacguuuccaguugggaggaugugccauacuuaggcaaaagggaagaccaguggugcgggagccugaucggauugacagccagagcaaccugggccacuaacauacaagucgcuaucaaucaggugcgccggcugauugguaacgagaauuaucucgauuacaugaccucgaugaagagguucaaaaacgaauccgacccggagggcgcccuuugguga

SEQ ID NO: 14165 - RNA, 9879 nt, Artificial Sequence
  derived and/or modified CDS sequence (opt3) from DENV-1__KC762641__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacuggaucguucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuaucucucaacauaauuaucgaccaggcuacuucacacagaccgccgggccguggcaccugggaaaacuugaguuggauuuugaccugugcgaaggcacuacagucgugguggaugagcacugcgggaacagaggacccuccuuaaggaccacgacugucaccggcaagauuauccaugaaugguguugccgcaguuguacacucccuccacugcgguucagaggugaggacgggugcugguacggaauggagauaaggcccguuaaagaaaaggaggaaaaucuugugaaguccaugguaucugcuggcuccggugagguggacucauuuagucugggcuugcucuguauuagcaucaugaucgaagaggucaugcgcucgcgauggucccggaaaaugcugaugaccgggacucuagccguguucuuucugcucauuaugggacagcugacauggaacgaucuuauccguuugugcauuaugguuggcgcaaaugcuucugacagaauggggaugggaaccacauaucuggccuuaauggcaacuuucaagaugaggccuauguuugccgugggccuccuguuccgccggcuuaccagcagagagguccugcuacucacgauaggucugucauugguggcuaguguugaacugccaaacuccuuagaggaacucggggauggacuggcgaugggcaucaugauucuuaaacuguugacagacuuucaaucucaccagcucugggccacccugcuaagccugacuuucaucaagaccacauuuucccuucauuacgcauggaaaacuauggcuauggugcucucaauugucagccuguuccccuugugucugaguaccacgucucagaagacaaccugguuaccgguacuccugggcucccuugggugcaagccucugacuauguuuuugaucgccgagaauaaaauauggggaagaaagagcuggccacucaacgaagguaucauggccgugggcauuguuucgauccugcuaucaucucugcuuaaaaacgaugugccccucgcugggccucugauugcaggaggcauguugaucgccuguuaugucauaagugguuccagcgcggacuuaucucuggagaaggcugccgaggugagcugggaagaggaagcagagcacuccggggccucacauaauauucucguagaagugcaggaugacggaacaaugaaaaucaaggaugaggagcgagacgauacccugacuauccuucugaaagcuacauugcuagcagucaguggcguuuacccccugagcauuccagccacccucuucgugugguauuucuggcaaaagaagaaacagcgcucuggcgugcugugggacacgccuucacccccagaagucgagcgggcggugcuugaugacgggauauacagaaucaugcagaggggauuacugggucguagccagguuggcguagggguguuucaagaaaacgucuuccacacuauguggcacgugacccgcggagcuguucucauguaucagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauuuaagacucccgaaggugaggugggcgcuauugcccuggauuucaaaccugggaccucgggaagcccaaucguuaacagggaaggcaagauagugggucuuuacgggaauggagucgugacgacaucaggcacuuauguuuccgcaaucgcucaggccaaagcgagucaggagggcccccugccugagauugaagacgagguguuucgaaagcggaacuugaccaucauggaucuacauccggggucuggaaaaacacgcagauaccugccagccauugucagggaagcaaucaagcggaagcuccgaaccuuaauacuggcucccacuagagugguagccagcgagauggcugaagcacuuaaagguaugccuauucgcuaucaaaccacagccgugaaguccgagcacacgggcaaagagaucguugaccugaugugccaugccacuuucaccaugaggcucuugucaccaguccgugugcccaauuacaacaugaucauuauggaugaagcucacuuuacagacccuucuagcaucgcggcacggggguauauaaguaccagagugggaaugggcgaggccgcugccauuuucaugacugcaacaccgcccgguuccgucgaagccuuuccacagagcaaugcuguaauccaggaugaggaaagggacauuccugagcgcucuuggaacucaggguacgaguggaucaccgauuuccccggaaagacggugugguuuguuccauccauaaaaaguggcaaugacauugcgaacugucugcgaaagaauggcaagagagugauccagcucagccggaaaacuuucgauacagaauaucaaaagaccaaaaacaacgacugggacuacgucgugaccacugauaucucggagaugggggccaauuucagggcagaccgcguuauugauccucguagaugccugaagcccgugauccuuaaagacggaccagaacgggucauucuagcugguccgaugccugugacaguagccucugcagcccagaggcgcggccgaguggggagaaaccauaauaaggagggagaucaguacauauauaugggccagccccugaacaaugacgaggaucacgcucacuggaccgaagccaagauguuguuagacaacaucaauacaccagaggguauuauccccgcgcuguuugaaccugagcgggaaaaauccgcagccaucgauggggaguacaggcuccgcggcgaggcuagaaagacuuucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagauuuggacgaaggagggagaaaggaaaaaguugaggccccgguggcuggacgcucgcaccuauucugacccucuagcacugagagaguuuaaagaguucgccgcugguaggcgguccguuagcggcgaucucauacuugagaucgggaagcugccgcagcauuuaacacagcgagcccaaaaugcauuggacaaccuggugaugcuccacaauucagaacagggaggcagagcguaccgccaugccauggaggagcugccagauacuauugaaacccuuaugcugcucgcuuugaucgccguacugacagguggggugaccuuauuuuuccuaaguggcaggggacugggcaagacuagcauugggcuccuuugugucauggcauccucugugcuguuguggauggcuagcguugagccccacuggaucgccgcauccauaauccuggaauuuuuccucauggugcugcuuauuccugagcccgaccggcagcguacgccacaggauaaccaacucgccuaugucguaaucggacuguuguuuaugauucugaccgugacagcuaaugagauggguuuacuagaaacuaccaaaaaggaccugggcaucgggcacguugcgguggagaaccaucaccaugccgcaaugcucgaugucgaccuucacccugcuucagccuggacacuguacgccguggcaaccacuauaauuacacccaugaugagacauacgaucgaaaacaccacugcuaauauuucuuugacagccaucgcgaaccaggcugccauacugaugggacucgauaaaggcuggccaaucaguaagauggacauuggugucccucugcuugcauuagggugcuacagccaggugaauccgcugacccucaccgccgcuguuuugaugcugguggcacacuaugccaucauuggccccggacuacaagcgaaagcuacaagggaggcccagaagcgcacugcagccggcaucaugaagaacccaacgguagaugggauaguggcuauugaccuggauccugucguuuacgacgccaaauucgaaaagcagcucggacagaucaugcuucugaucuuguguaccagccaaauucugcucaugcggacaacuugggcacugugcgaguccaucaccuuagcuacaggcccccuuaccacucugugggaggguucuccagggaaauuuuggaauacgacaauagccgugucaauggcgaacauuuuccgaggaagcuaucucgccggcgcaggucuagcuuucucccugaugaagaguuugggcgggggaagaaggggcaccggggcccagggagaaacucugggcgagaaauggaagcgccagcucaaucagcuuucuaagagcgaauuuaacaccuacaaacggucagguaucauggaggucgacagauccgaagcaaaggaggggcugaaacguggagagacaacuaagcacgcugugaguaggggcaccgccaaauugcggugguucguagaacgcaaucuggugaagccugaggguaagguuauugaucucggcugugggcgaggaggcuggagcuauuacugcgccgggcuaaagaaggugacagaagucaaaggauauacgaagggcggucccgggcaugaggaaccgaucccaauggcgaccuacggauggaaccuggugaaacuucacucuggcaaggacgucuuuuucauaccucccgagaaaugugauacucugcuaugcgacaucggcgaguccucaccaaaucccacaauugaagaggggagaacccucagggugcugaagaugguugaaccuugguugcggggaaaccaauuuuguaucaagauucugaauccguacaugcccagcguaguggagacucucgagcagaugcagcgcaaacaugguggcaugcuugucagaaacccacugucgagaaauucuacacacgaaauguauugggugaguugcgggaccggaaacaucguuuccgcugugaauaugacgagccgaauguuacugaaccgguucaccauggcacaccguaagccuacauacgagagagaugucgacuugggcgccgguacucgccauguggcuguagaacccgagguggccaaccucgauauuaucgggcagaggauagaaaauauuaaacacgagcauaagucaaccuggcacuaugacgaggauaacccuuacaaaacaugggcauaucauggauccuacgaaguuaagccaucuggcagcgccaguuccauggucaauggcguggugaagcugcuaacuaaacccugggacgucaucccuaugguuacccaaaucgcuaugacagauaccacuccauuugggcagcagcggguguucaaggagaaaguagacacgagaacacccaaggcgaaacgcggaaccacucaaauuauggaagugaccgccagguggcuuugggguuuucugagccgaaacaagaagccgcggauauguacaagagaggaguucacgaggaaaguccgcucuaaugcagcuaucggcgccguguuuguugacgagaaccaguggaacucagcaaaggaggccguggaagaugagcguuucugggaccucguccaccgggaaagagagcugcacaaacaggggaagugcgcuaccugcguguauaacaugaugggaaaaagggaaaagaaguugggcgaguuugguaaagccaaggggagucgcgcgauuugguacauguggcugggagcacgauuccucgaguucgaagcccuuggcuuuaugaaugaggaucauugguucucccgggaaaacagccugucuggcguagagggggagggauuacacaaacuggguuacaucuugagagacauuucgaagaucccuggcgggaauauguaugcugaugacacugccggaugggauacaaggauaaccgaagacgaucuccagaacgaggcaaaaaucacugacauuauggaaccagagcaugcucugcuagccaaggcuaucuuuaaacuuacauaccaaaauaagguugugcgcguccagagacccgccaagaacggcaccgugauggaugugauuucacggagggaccagcgugguagcgggcaggucggaacauauggccugaauacuuucaccaacauggaagcacaacucauccgacagauggaguccgagggcauauuuaguccuucugaacuggagacgccaaacuuggcggaacgcguuuuagauuggcuggagaaauacgggguggaaagacucaagcggauggccauuagcggagacgacuguguagugaaacccaucgaugacagguucgcuaccgcccuuacagcacugaaugauauggguaagguccgcaaagacaucccgcagugggagccuuccaagggcuggaacgauuggcagcaagugcccuuuugcucacaccacuuccaucagcuaauuaugaaggacgggagagagauaguugugccaugucggaaucaggaugaacuggucggaagggcucgagugagucagggcgccgguuggucucuccgugagacugcaugcuuggggaaaagcuaugcccaaauguggcagcugauguacuuucacagacgcgaccuucggcuggcggcuaacgccaucuguuccgcaguaccuguugauugggugcccaccucaaggacaacuuggagcauucaugcccaccaucaguggaugaccacggaagacaugcucucugucuggaauagaguguggaucgaggaaaacccauggauggaggauaagacacacauuuccaguugggaggacguucccuauuuaggaaaacgcgaagaccaauggugcggcagccugaucggcuugaccgcucgggccacuugggcaacaaauauacagguggcuaucaaccaggucaggcgacugauugggaaugagaacuaccucgauuacaugaccucgaugaagagauucaaaaaugaauccgacccugagggagcccuuugguga

SEQ ID NO: 14166 - RNA, 9879 nt, Artificial Sequence
  derived and/or modified CDS sequence (opt3) from DENV-1__KC762648__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacugggagcuucaaacuugagaaggaagucgcugagacccagcacgguacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugguccaucagauuuucggaacggcguacggcguguuguuuucugguguaagcuggaccaugaagauagggaucggcgugcuccugacuugguuaggacuaaauucacgaaguacaucccuaagcaugaccuguauugcuguuggccucgucacacuguaccuuggggugauggugcaggccgauucuggaugcgucaucaacuggaaaggccgcgaauugaagugugguucagggaucuucguuacuaaugaggugcacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccguagucgugggcgauguugcugggauucuugcccagggcaaaaagaugauccgcccucaacccauggagcacaaauacucguggaaaagcuggggcaaggcgaaaauaaucggggccgacgugcagaauacuaccuuuauuaucgauggaccaaacacaccugaaugucccgacgaucagagagcuuggaauauuugggaggucgaggacuauggcuucgguaucuuuacuaccaacauaugguugaagcucagggauuccuacacacaggugugcgaccaccgucugaugucagcagccauuaaagauaguaaggcuguucaugccgacaugggguauuggaucgaaucugagaaaaaugaaacguggaagcuagcacgggcgagcuucauugaggugaagaccuguaucuggccaaaaucccacacucuguggucaaacggaguacucgaaagcgagaugauaauccccaagauuuacggcgguccuaucucucaacauaauuaucgaccaggcuacuucacacagaccgccgggccguggcaccugggaaaacuugaguuggauuuugaccugugcgaaggcacuacagucgugguggaugagcacugcgggaacagaggacccuccuuaaggaccacgacugucaccggcaagauuauccaugaaugguguugccgcaguuguacacucccuccacugcgguucagaggugaggacgggugcugguacggaauggagauaaggcccguuaaagaaaaggaggaaaaucuugugaaguccaugguaucugcuggcuccggugagguggacucauuuagucugggcuugcucuguauuagcaucaugaucgaagaggucaugcgcucgcgauggucccggaaaaugcugaugaccgggacucuagccguguucuuucugcucauuaugggacagcugacauggaacgaucuuauccguuugugcauuaugguuggcgcaaaugcuucugacagaauggggaugggaaccacauaucuggccuuaauggcaacuuucaagaugaggccuauguuugccgugggccuccuguuccgccggcuuaccagcagagagguccugcuacucacgauaggucugucauugguggcuaguguugaacugccaaacuccuuagaggaacucggggauggacuggcgaugggcaucaugauucuuaaacuguugacagacuuucaaucucaccagcucugggccacccugcuaagccugacuuucaucaagaccacauuuucccuucauuacgcauggaaaacuauggcuauggugcucucaauugucagccuguuccccuugugucugaguaccacgucucagaagacaaccugguuaccgguacuccugggcucccuugggugcaagccucugacuauguuuuugaucgccgagaauaaaauauggggaagaaagagcuggccacucaacgaagguaucauggccgugggcauuguuucgauccugcuaucaucucugcuuaaaaacgaugugccccucgcugggccucugauugcaggaggcauguugaucgccuguuaugucauaagugguuccagcgcggacuuaucucuggagaaggcugccgaggugagcugggaagaggaagcagagcacuccggggccucacauaauauucucguagaagugcaggaugacggaacaaugaaaaucaaggaugaggagcgagacgauacccugacuauccuucugaaagcuacauugcuagcagucaguggcguuuacccccugagcauuccagccacccucuucgugugguauuucuggcaaaagaagaaacagcgcucuggcgugcugugggacacgccuucacccccagaagucgagcgggcggugcuugaugacgggauauacagaaucaugcagaggggauuacugggucguagccagguuggcguagggguguuucaagaaaacgucuuccacacuauguggcacgugacccgcggagcuguucucauguaucagggcaagcgguuggagccgaguugggccagcgugaaaaaggaccugauuuccuacggugggggauggagacuccagggcucuuggaauacaggcgaggaaguccaggugaucgcaguagagccugggaaaaaccccaagaauguccaaaccgccccaggaacauuuaagacucccgaaggugaggugggcgcuauugcccuggauuucaaaccugggaccucgggaagcccaaucguuaacagggaaggcaagauagugggucuuuacgggaauggagucgugacgacaucaggcacuuauguuuccgcaaucgcucaggccaaagcgagucaggagggcccccugccugagauugaagacgagguguuucgaaagcggaacuugaccaucauggaucuacauccggggucuggaaaaacacgcagauaccugccagccauugucagggaagcaaucaagcggaagcuccgaaccuuaauacuggcucccacuagagugguagccagcgagauggcugaagcacuuaaagguaugccuauucgcuaucaaaccacagccgugaaguccgagcacacgggcaaagagaucguugaccugaugugccaugccacuuucaccaugaggcucuugucaccaguccgugugcccaauuacaacaugaucauuauggaugaagcucacuuuacagacccuucuagcaucgcggcacggggguauauaaguaccagagugggaaugggcgaggccgcugccauuuucaugacugcaacaccgcccgguuccgucgaagccuuuccacagagcaaugcuguaauccaggaugaggaaagggacauuccugagcgcucuuggaacucaggguacgaguggaucaccgauuuccccggaaagacggugugguuuguuccauccauaaaaaguggcaaugacauugcgaacugucugcgaaagaauggcaagagagugauccagcucagccggaaaacuuucgauacagaauaucaaaagaccaaaaacaacgacugggacuacgucgugaccacugauaucucggagaugggggccaauuucagggcagaccgcguuauugauccucguagaugccugaagcccgugauccuuaaagacggaccagaacgggucauucuagcugguccgaugccugugacaguagccucugcagcccagaggcgcggccgaguggggagaaaccauaauaaggagggagaucaguacauauauaugggccagccccugaacaaugacgaggaucacgcucacuggaccgaagccaagauguuguuagacaacaucaauacaccagaggguauuauccccgcgcuguuugaaccugagcgggaaaaauccgcagccaucgauggggaguacaggcuccgcggcgaggcuagaaagacuuucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagauuuggacgaaggagggagaaaggaaaaaguugaggccccgguggcuggacgcucgcaccuauucugacccucuagcacugagagaguuuaaagaguucgccgcugguaggcgguccguuagcggcgaucucauacuugagaucgggaagcugccgcagcauuuaacacagcgagcccaaaaugcauuggacaaccuggugaugcuccacaauucagaacagggaggcagagcguaccgccaugccauggaggagcugccagauacuauugaaacccuuaugcugcucgcuuugaucgccguacugacagguggggugaccuuauuuuuccuaaguggcaggggacugggcaagacuagcauugggcuccuuugugucauggcauccucugcucuguuguggauggccagcguggagccccacuggaucgcagccuccauaauccuggaauuuuuccucaugguucugcuuauuccugagcccgaccggcagcguacgccacaggauaaccaacucgcuuauguggucaucggacuguuguuuaugauucugaccguagcggccaaugagauggguuuacuagaaacaacuaaaaaggaccugggcaucgggcacguggcaguugagaaccaucaccaugcugccaugcucgauguggaccuucacccugccucagcauggacccuguacgcugucgccacaaccauaauuacucccaugaugagacauacaaucgaaaacacgaccgcgaauauuucuuugacugcuaucgccaaccaggcagccauacugaugggacucgauaaaggcuggccaaucaguaagauggacauuggugugccucugcuugcuuuagggugcuacucgcaggucaauccgcugacacucaccgcagccguguugaugcugguugcgcacuaugcuaucauuggccccggacuacaagccaaagcaaccagggaggcccagaagcgcacagcugccggcaucaugaagaacccaacuguggaugggauaguagcaauugaccuggauccuguggucuacgacgcuaaauucgaaaagcagcucggacagaucaugcuucugaucuuguguacgagccaaauucugcucaugcggaccacaugggcccugugcgaguccaucacuuuagcgaccggcccccuuacaacccugugggaggguucuccagggaaauuuuggaauacuacgauagccguuucaauggcaaacauuuuccgaggaagcuaucucgcuggcgccggucuagcauucucccugaugaagaguuugggcgggggaagaaggggcacaggggcucagggagaaacccugggcgagaaauggaagcgccagcucaaucagcuuucuaagagcgaauuuaacacuuacaaacggucagguaucauggagguggacagauccgaagccaaggaggggcugaaacguggagagaccacaaagcacgccgucaguaggggcacugcgaaauugcggugguucguggaacgcaaucugguaaagccugaggguaaggugauugaucucggcugugggcgaggaggcuggagcuauuacugcgcugggcuaaagaagguuaccgaagugaaaggauauacaaagggcggucccgggcaugaggaaccgaucccaauggcaacguacggauggaaccuggucaaacuucacucuggcaaggacguguuuuucauaccucccgagaaaugugauacccugcuaugcgacaucggcgaguccucaccaaaucccacuauugaagaggggagaacacucaggguccugaagaugguggaaccuugguugcggggaaaccaauuuuguaucaagauucugaauccguacaugcccagcguuguagagacccucgagcagaugcagcgcaaacaugguggcaugcuugugagaaacccacugucgagaaauucuacucacgaaauguauugggucaguugcgggacaggaaacaucguguccgccguuaauaugaccagccgaauguuacugaaccgguucacgauggcucaccguaagccuaccuacgagagagauguggacuugggcgccgguacacgccaugucgcaguggaacccgagguagccaaccucgauauuaucgggcagaggauagaaaauauuaaacacgagcauaagucaacuuggcacuaugacgaggauaacccuuacaaaaccugggcuuaucauggauccuacgaagugaagccaucuggcagcgcgaguuccaugguuaauggcgucgugaagcugcuaacaaaacccugggacgugaucccuauggucacucaaaucgccaugaccgauacaaccccauuugggcagcagcggguuuucaaggagaaaguggacacuagaacgcccaaggcaaaacgcggaacaacccaaauuauggaaguaacugcuagguggcuuugggguuuucugagccgaaacaagaagccgcggauauguaccagagaggaguucacaaggaaagugcgcucuaaugccgcaaucggcgccgucuuuguggacgagaaccaguggaacucagcuaaggaggccguugaagaugagcguuucugggaccucgugcaccgggaaagagagcugcacaaacaggggaagugcgcgacgugcgucuauaacaugaugggaaaaagggaaaagaaguugggcgaguuugguaaagcaaaggggagucgcgccauuugguacauguggcugggagcucgauuccucgaguucgaagcccuuggcuuuaugaaugaggaucauugguucucccgggaaaacagccugucuggcguggagggggagggauuacacaaacuggguuacaucuugagagacauuucgaagaucccuggcgggaauauguaugcagaugacaccgcuggaugggauacuaggauaacagaagacgaucuccagaacgaggccaaaaucaccgacauuauggaaccagagcaugcucugcuagccaaggcaaucuuuaaacuuacuuaccaaaauaagguaguucgcgugcagagacccgcgaagaacggcacagucauggaugugauuucacggagggaccagcgugguagcggacaggugggaaccuauggccugaauacauucacuaacauggaagcccaacucauccgacagauggaguccgaggaaauauuuaguccuucugagcuggaaaccccaaacuuggcugagcgcgucuuagauuggcuggaaaaauacggcguugagagacucaagcggauggccauuagcggggacgacugugugguaaaacccaucgaugacagguucgcaacggcucuuaccgcccugaaugauaugggaaaggugcgcaaagacaucccgcagugggagccuuccaaggguuggaacgauuggcagcaaguccccuuuugcucacaccacuuccaucagcuaauuaugaaggacggcagagaaauagugguuccaugucggaaucaggaugagcugguggggagggcacgagucagucagggagccggcuggucucuccgugaaacagcgugcuuggguaaaagcuaugcucaaauguggcagcugauguacuuucacagacgcgaccuucggcuggccgcaaacgccaucuguuccgcugugccuguagauuggguucccacuucaaggaccacauggagcauucaugcccaccaucaguggaugacuaccgaggacaugcucucuguguggaauagagucuggaucgaagagaacccauggauggaggauaagacgcacauuuccaguugggaagacgugcccuauuuagggaaacgcgaggaccaauggugcggaagccugaucggcuugacagcacgggcuaccugggccacuaauauacagguugcgaucaaccaggugaggcgacugauuggcaaugaaaacuaccucgauuacaugacaucgaugaagagauucaaaaaugaguccgacccugagggggcucuuugguga

SEQ ID NO: 14167 - RNA, 9879 nt, Artificial Sequence
  derived and/or modified CDS sequence (opt3) from DENV-1__KC762622__SS-prME
agcgugaccaugcugcucaugcuuaugcccacggcacuggcuuuccacuugacuacgaggggaggggaaccucauaugaucgucuccaagcaggaaaggggaaaaucuuuacuguuuaagaccucagccgguguuaauaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauggcacuguuucucgcccaugcuauuggcacaucgaucacccagaagggcauuaucuucauauuacugaugcuugugacgccaucaauggccaugcgcugcgucgggaucggaagcagagauuuuguggaggguuugaguggcgcgacuuggguagacguugugcuggagcacggguccugugucacaaccauggcaaaggauaaacccacucuggacauugaacuccugaagacagaggugaccaacccugccgugcuuaggaaacugugcaucgaagcuaagauuucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugaucacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggaucguucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggcaaaaagaugauucgcccucaacccauggagcacaaauacucguggaaaagcuggggcaaggcgaaaaucauaggggccgacgugcagaauacuaccuuuaucauugauggaccaaacacaccugaaugucccgacgaucagagagcuuggaauaucugggaggucgaggacuauggcuucgguauuuuuacuaccaacaucugguugaagcucagggauuccuacacacaggugugcgaccaccgucugaugucagcagccauaaaagauaguaaggcuguucaugccgacaugggguauuggauugaaucugagaaaaaugaaacguggaagcuagcacgggcgagcuucaucgaggugaagaccuguauuuggccaaaaucccacacucuguggucaaacggaguacucgaaagcgagaugaucauacccaagaucuacggcgguccuacaucucaacauaauuaucgaccaggcuacuucacccagacugccgggccguggcaccugggaaaacuugaguuggauuuugaccugugcgaaggcacaaccgucgugguggaugagcacugcgggaacagaggacccuccuuaaggacgacuaccgucacaggcaagauuauccaugaaugguguugccgcaguuguacccucccuccacugcgguucagaggugaggacgggugcugguacggaauggagauuaggcccguuaaagaaaaggaggaaaaucuugugaaguccaugguaucugcuggcuccggugagguggacucauuuagucugggcuugcucuguaucagcauaaugauugaagaggucaugcgcucgcgauggucccggaaaaugcugaugacugggacacuagccguguucuuucugcucaucaugggacagcugaccuggaacgaucuuauccguuugugcauuaugguuggcgcaaaugcuucugacagaauggggaugggaacaacuuaucuggccuuaauggcaaccuucaagaugaggccuauguuugccgugggccuccuguuccgccggcuuacgagcagagagguccugcuacucacaaucggucugucauugguggcuaguguugaacugccaaacuccuuagaggaacucggggauggacuggcgaugggcauuaugauacuuaaacuguugaccgacuuucaaucucaccagcucugggccacucugcuaagccugaccuucaucaagacaacuuuuucccuucauuacgcauggaaaaccauggcuauggugcucucaauugucagccuguuccccuugugucugaguacgacaucucagaagaccacuugguuaccgguacuccugggcucccuugggugcaagccucugacaauguuuuugaucgccgagaauaaaauuuggggaagaaagagcuggccacucaacgaagguaucauggccgugggcauaguuucgauccugcuaucaucucugcuuaaaaacgaugugccccucgcugggccucugauugcaggaggcauguugaucgccuguuaugucauuagugguuccagcgcggacuuaucucuggagaaggcugccgaggugagcugggaagaggaagcagagcacuccggggccucacauaauauccucguagaagugcaggaugacggaaccaugaaaauaaaggaugaggagcgagacgauacucugacaauucuucugaaagcuaccuugcuagcagucaguggcguuuacccccugagcaucccagccacacucuucgugugguauuucuggcaaaagaagaaacagcgcucuggcgugcugugggacacuccuucacccccagaagucgagcgggcggugcuugaugacgggaucuacagaauuaugcagaggggauuacugggucguagccagguuggcguagggguguuucaagaaaacgucuuccacaccauguggcacgugacacgcggagcuguucucauguaucagggcaagcgguuggagccgaguugggccagcgugaaaaaggaccugauauccuacggugggggauggagacuccagggcucuuggaauaccggcgaggaaguccaggugaucgcaguagagccugggaaaaaccccaagaauguccaaacagccccaggaacuuuuaagacccccgaaggugaggugggcgcuauugcccuggauuucaaaccugggacgucgggaagcccaaucguuaacagggaaggcaagauugugggucuuuacgggaauggagucgugacaacuucaggcaccuauguuuccgcaaucgcucaggccaaagcgagucaggagggcccccugccugagauagaagacgagguguuucgaaagcggaacuugacaaucauggaucuacauccggggucuggaaaaacccgcagauaccugccagccauugucagggaagcaaucaagcggaagcuccgaacuuuaauucuggcucccaccagagugguagccagcgagauggcugaagcacuuaaagguaugccuauccgcuaucaaacaacggccgugaaguccgagcacacuggcaaagagauaguugaccugaugugccaugccaccuucacaaugaggcucuugucaccaguccgugugcccaauuacaacaugauuaucauggaugaagcucacuuuaccgacccuucuagcaucgcggcacggggguauauuaguacuagagugggaaugggcgaggccgcugccaucuucaugacagcaaccccgcccgguuccgucgaagccuuuccacagagcaaugcuguaauacaggaugaggaaagggacauuccugagcgcucuuggaacucaggguacgaguggaucacggauuuccccggaaagacugugugguuuguuccauccauuaaaaguggcaaugacaucgcgaacugucugcgaaagaauggcaagagagugauacagcucagccggaaaacauucgauaccgaauaucaaaagaccaaaaacaacgacugggacuacgucgugacuacagauauuucggagaugggggccaauuucagggcagaccgcguuaucgauccucguagaugccugaagcccgugauccuuaaagacggaccagaacgggucauucuagcugguccgaugccugugaccguagccucugcagcccagaggcgcggccgaguggggagaaaccauaauaaggagggagaucaguacaucuauaugggccagccccugaacaaugacgaggaucacgcucacuggacagaagccaagauguuguuagacaacauuaauacuccagaggguauaauccccgcgcuguuugaaccugagcgggaaaaauccgcagccauugauggggaguacaggcuccgcggcgaggcuagaaagacguucguugaacugaugaggcggggagaccuuccagucuggcugagcuauaaaguggccucagagggcuuucaauacagugaucgucgcuggugcuucgacggggaacgaaacaaucaggugcucgaggaaaacauggaugucgagaucuggaccaaggagggagaaaggaaaaaguugaggccccgguggcuggacgcucgcacauauucugacccucuagcacugagagaguuuaaagaguucgccgcugguaggcgguccguuagcggcgaucucauccuugagauugggaagcugccgcagcauuuaacucagcgagcccaaaaugcauuggacaaccuggugaugcuccacaauucagaacagggaggcagagcguaccgccaugccauggaggagcugccagauaccauagaaacacuuaugcugcucgcuuugaucgccguacugaccgguggggugacuuuauuuuuccuaaguggcaggggacugggcaagacgagcauugggcuccuuugugucauggcauccucugugcuguuguggauggcuagcguugagccccacuggaucgccgcauccauuauccuggaauuuuuccucauggugcugcuuauaccugagcccgaccggcagcguaccccacaggauaaccaacucgccuaugucguaaucggacuguuguuuaugauucugacaguggcugcgaaugagauggguuuacuagaaacuaccaaaaaggaccugggcaucgggcacguugccguggagaaccaucaccaugcagcuaugcucgaugucgaccuucacccugccucagccuggacacuguacgcaguggcuaccacuauuaucacacccaugaugagacauacgauagaaaacaccacugccaauauuucuuugacagcgaucgcuaaccaggccgcaauucugaugggacucgauaaaggcuggccaaucaguaagauggacauaggugucccucugcuugccuuagggugcuacagccaggugaauccgcugacccucaccgcugcaguuuugaugcugguggcccacuaugcgaucauuggccccggacuacaagcuaaagccacaagggaggcacagaagcgcacugccgcuggcaucaugaagaacccaacgguagaugggauuguggccaucgaccuggauccugucguuuacgacgcaaaauucgaaaagcagcucggacagauaaugcuucugauuuuguguaccagccaaauccugcucaugcggacaacuugggcucugugcgaguccaucaccuuagccacaggcccccuuaccacucugugggaggguucuccagggaaauuuuggaauacgacaauugcggugucaauggccaacaucuuccgaggaagcuaucucgcaggcgcuggucuagccuucucccugaugaagaguuugggcgggggaagaaggggcaccggggcacagggagaaacucugggcgagaaauggaagcgccagcucaaucagcuuucuaagagcgaauuuaacaccuacaaacggucagguauaauggaggucgacagauccgaagcuaaggaggggcugaaacguggagagacaacuaagcacgccgugaguaggggcaccgccaaauugcggugguucguagaacgcaaucuggugaagccugaggguaagguuauugaucucggcugugggcgaggaggcuggagcuauuacugcgcggggcuaaagaaggugacagaagucaaaggauauacgaagggcggucccgggcaugaggaaccgaucccaauggcuaccuacggauggaaccuggugaaacuucacucuggcaaggacgucuuuuucauuccucccgagaaaugugauacucugcuaugcgacaucggcgaguccucaccaaaucccacaauagaagaggggagaacccucagggugcugaagaugguugaaccuugguugcggggaaaccaauuuuguaucaagauucugaauccguacaugcccagcguaguggagacucucgagcagaugcagcgcaaacaugguggcaugcuugucagaaacccacugucgagaaauucuacacacgaaauguauugggugaguugcgggaccggaaacaucguuuccgcagugaauaugacgagccgaauguuacugaaccgguucaccauggcccaccguaagccuacauacgagagagaugucgacuugggcgcugguacucgccauguggccguagaacccgagguggcaaaccucgauauuaucgggcagaggauugaaaauaucaaacacgagcauaagucaaccuggcacuaugacgaggauaacccuuacaaaacaugggccuaucauggauccuacgaaguuaagccaucuggcagcgcuaguuccauggucaauggcguggugaagcugcuaacuaaacccugggacgucauaccuaugguuacccaaauugcgaugacagauaccacuccauuugggcagcagcggguguucaaggagaaaguagacacgagaacacccaaggccaaacgcggaaccacucaaaucauggaagugaccgcaagguggcuuugggguuuucugagccgaaacaagaagccgcggaucuguacaagagaggaguucauuaggaaaguccgcucuaaugcugccauaggcgcaguguuuguugacgagaaccaguggaacucagccaaggaggcuguggaagaugagcguuucugggaccucguccaccgggaaagagagcugcacaaacaggggaagugcgccacgugcguguauaacaugaugggaaaaagggaaaagaaguugggcgaguuugguaaagcgaaggggagucgcgcaaucugguacauguggcugggagcccgauuccucgaguucgaagcucuuggcuuuaugaaugaggaucauugguucucccgggaaaacagccugucuggcguagagggggagggauuacacaaacuggguuacauuuugagagacaucucgaagauuccuggcgggaauauguaugccgaugacaccgcaggaugggauacuaggaucacagaagacgaucuccagaacgaggcuaaaauaaccgacaucauggaaccagagcaugcccugcuagcuaaggccauuuuuaaacuuacuuaccaaaauaagguugugcgcguccagagacccgcaaagaacggcacagugauggaugugaucucacggagggaccagcgugguagcgggcaggucggaaccuauggccugaauacauucacuaacauggaagcgcaacucauucgacagauggaguccgagggcaucuuuaguccuucugaacuggagaccccaaacuuggccgaacgcguuuuagauuggcuggagaaauacgggguggaaagacucaagcggauggcuauaagcggagacgacuguguagugaaacccauugaugacagguucgccacggcacuuaccgcucugaaugauauggguaagguccgcaaagacaucccgcagugggagccuuccaagggcuggaacgauuggcagcaagugcccuuuugcucacaccacuuccaucagcuaaucaugaaggacgggagagagauuguugugccaugucggaaucaggaugaacuggucggaagggcccgagugagucagggcgcagguuggucucuccgugagacagccugcuuggggaaaagcuaugcgcaaauguggcagcugauguacuuucacagacgcgaccuucggcuggcugccaacgcaauauguuccgccguaccuguugauugggugcccacuucaaggaccacauggagcauccaugcucaccaucaguggaugacuaccgaagacaugcucucugucuggaauagaguguggauugaggaaaacccauggauggaggauaaggcccacguuuccaguugggaggacgugcccuauuuaggaaaacgcgaagaccaauggugcggcagccugaucggcuugacggcacgggcuacaugggccaccaauauucaggucgcgaucaaccaggugaggcgacugauagggaaugagaacuaccucgauuacaugacuucgaugaagagauucaaaaaugaauccgacccugagggagcucuuugguga

SEQ ID NO: 14168 - RNA, 9879 nt, Artificial Sequence
  derived and/or modified CDS sequence (opt3) from DENV-1__KC762629__SS-prME
agcgugaccaugcugcucaugcuuaugcccacggcacuggcuuuccacuugacuacgagaggcggggaaccucauauggucguuuccaagcaagaaagaggaaaaucuuuacuguuuaagaccucagccggugugaacaugugcacacugaucgccauggaccucggcgaacugugugaagauacucuuaccuacaaaugcccacggauuacagaggcggaaccggacgauguagacuguuggugcaaugcuaccgauacuugggugacauaugggaccuguagucaaacgggagagcaccgccgagacaagcguagcgucgcccuggcaccccaugugggcuugggucucgagacuagaaccgaaacauggauguccucugagggggccuggaggcagauacagcggguugaaacuugggcucugcgccacccuggauucaccgugaucgcacuguuucucgcccaugcuauuggcacaucgaucacccagaaaggcauuaucuucauauuacugaugcuugucacgccaucaauggccaugagaugcguggggaucggaagcagggauuuuguagaggguuugaguggcgcgacuuggguugacgugguccuggagcacggguccugugugacaaccauggcaaaggauaagcccacucuagacauugaacuccugaaaacagaggugaccaacccugccguccuucggaagcugugcaucgaagcuaaaauuucuaauacgaccacagauagccgcuguccaacucaaggagaggccaccuugguugaagaacaagacgcaaacuucgugugccgaagaacauuuguagauaggggcugggguaauggguguggacucuucggcaagggcucccugaucacuugcgcuaaauuuaagugcgugaccaaguuagaggggaaaauaguccaguacgaaaaccugaaguauucagugauuguuacagugcacaccggagaccagcaucaagucgguaaugagaguacugaacacggcacgacagccaccaucacuccccaggcgccuaccacagagauucagcucaccgacuacggggcccuuacucuggauuguagcccacggacaggauuggacuucaacgaaauggugcuacugacgaugaaagagaagucuuggcucguacauaaacagugguuucuggaucuuccgcugcccuggaccuccggcgcaucaacuagccaagagacauggaaucgucaggacuugcucguuaccuucaagacagcucacgccaaaaagcaggaaguggucgugcuggguagucaagagggggcuaugcacacugccuuaaccggcgcaacggaaauccagaccucuggaacaacuaccaucuuugccggccaucugaagugccgccuaaaaauggauaagcucacacugaaagggauguccuaugucauguguacugguagcuucaaacuugagaaagaaguggcugagacccagcacggaacgguuuuggugcagauuaaguacgagggcacagacgcgccuugcaagauaccauucucgacccaagaugaaaaagggguaacucagaacggaagacugaucacagcaaaucccauugucaccgacaaggagaaaccugugaacaucgaagccgagccacccuuuggcgagucuuauauaguuauuggugcuggggaaaagacucucaaacuguccugguucaagaagggcucaaguaucggaaaaauguuugaggccaccgcaaggggcgcccggcgaauggcuauccuuggggauacagccugggacuucggaagcauugguggcguguuuacguccgucgggaagcuggugcaucagaucuucggaaccgcauacggcguauuguuuucuggugugagcuggacuaugaaaauugggauaggcguucuccugacaugguuaggacuaaauucacgcaguaccucccuaagcaugacauguaucgcggucggccucgugacucuguaccuuggggugaugguccaggcugauucuggaugcguuauuaacuggaagggcagagaauugaaaugugguucagggaucuucgugaccaaugaggugcacacguggacagaacaauauaaguuucaggccgacaguccgaagaggcugagcgcagccaucggaaaggcuugggaggagggcguaugcgguauucgguccgccacccgccucgaaaacauaauguggaagcagaucucuaacgagcugaaucauauuuuacuggaaaacgacaugaaauucacugucgugguuggcgauguggcagggauccuugcucagggaaagaaaaugauuagaccucaacccauggagcacaaguacucguggaaaagcuggggcaaggccaagaucauaggggcggacguccagaauaccacauuuaucauugauggaccaaacacuccugaaugucccgacgaucagagggccuggaauaucugggagguggaggacuauggcuucgguauuuuuaccacaaacaucugguugaaacuccgugauuccuacacgcagguuugcgaccaccggcugaugucagcugcaauaaaggauaguaaagccgugcaugcugacaugggguauuggauugaaucugagaagaaugaaaccuggaaacuagcccgagcauccuucaucgagguaaagacuuguauuuggccaaagucccacacacuguggucaaacggaguccucgaaagcgagaugaucauacccaaaaucuacggcgguccuauuucucaacauaauuauagaccaggcuacuucacccagacugcggggccguggcaccugggaaaacuugaguuggauuuuaaccugugcgaaggcacaaccgugguggucgacgagcacugcgggaauaggggacccuccuuacgcacgacuaccguuacaggcaaaaucauucaugaaugguguugccggaguuguacccucccuccacugagauucaggggugaggaugggugcugguacggaauggagauccgccccgugaaggaaaaagaggaaaaccuuguaaagagcauggugucugccggcuccggugaggucgacucauuuagucugggcuugcucuguauaagcauuaugaucgaagaggugaugcgaucgcgguggucccguaagaugcugaugacugggacacuagcuguuuucuuucugcucaucaugggacagcugaccuggaaugaccuuauuagauugugcaucauggugggcgccaacgcaucugauaggauggggaugggaacaacuuaucuggcuuuaauggccaccuucaaaaugcgcccuauguuugcagucggccuccuguuccggagacuuacgagcagggaggugcugcuacucacaauuggucugucauugguugccaguguggaacugccaaauuccuuagaggaacucggggacggacuggcuaugggcauaaugauccuuaagcuguugaccgauuuucaaucucaccagcucugggcgacucugcuaagccugaccuucauuaaaacaacuuuuucccuucauuacgccuggaagaccauggcaaugguccucucaaucguaagccuguuccccuugugucugaguacgacaucucagaaaaccacuugguuaccggugcuccugggcucccuugggugcaagccucugacaauguuuuugauugcugagaacaagaucuggggacgaaaaagcuggccacucaacgaagguauaauggccguuggcaucgugucgauucugcuaucaucucugcuuaagaaugacgucccccucgccgggccucugaucgcuggaggcauguugauugcauguuaugugaucagugguuccagcgccgauuuaucucuggagaaagcggcugagguaagcugggaagaggaagccgagcacuccggggcaucacauaacauacucguggaaguccaggacgauggaaccaugaagauuaaagacgaggagcgcgaugacacucugacaauccuucugaaggccaccuugcuagcuguuaguggcguguacccccugagcaucccagcaacacucuucgugugguauuucuggcagaagaagaagcagcggucuggcguccugugggauacuccuucacccccagaaguggagagagccguucuugacgaugggauuuacaggauaaugcagcguggauuacugggucgcagccagguaggcgugggggucuuucaagaaaauguguuccacaccauguggcacguuacacggggagcggugcucauguaucagggcaaaagauuggagccgaguugggcuagcgucaagaaagaccugaucuccuacggugggggauggaggcuccagggcucuuggaacaccggcgaggaagugcagguaauugccgucgagccugggaagaaucccaaaaacgugcaaacagcaccaggaacuuuuaagacccccgaaggugagguuggcgccaucgcucuggacuucaagccugggacgucgggaagcccaauugugaaucgagaaggcaaaaucgucggucuuuacgggaacggagugguuacaacuucaggcaccuauguguccgccauagcacaggcuaaggccagucaggagggcccccugccugagaucgaagaugaggucuuucggaaacgcaauuugacaauuauggaccuacauccggggucuggaaagaccagaagguaccugccagcgaucgugcgggaagccauuaaacgaaagcucagaacuuuaauccuggcacccacccgcguaguggcuagcgagauggccgaagcucuuaaggguaugccuauaagguaucaaacaacggcaguuaaauccgagcacacuggcaaggagauugucgaucugaugugccaugccaccuucacaaugcgucucuugucaccagugcgggugcccaacuacaauaugaucaucauggacgaagcccacuuuaccgauccuucuagcauugcugcgagaggguauaucaguacuagggucggaaugggcgaggcagccgcuauauucaugacagccaccccgcccgguuccguagaagcauuuccacagagcaacgccgugauucaggacgaggaacgcgauaucccugagcgaucuuggaacucaggguacgaguggauuacggacuuccccggaaaaacuguuugguuugugccauccaucaagaguggcaacgauauagcuaauugucugaggaagaauggcaagcgggucauucagcucagcaggaagacauucgacaccgaauaucagaagaccaagaacaaugauugggacuacgugguuacuacagacaucucggagaugggggcgaacuuccgcgccgaucgugugaucgacccuagacggugccugaaacccgucauucuuaaggauggaccagaaagggugauccuagcagguccgaugccuguaaccguggcuucugccgcacagcgccgaggcagaguugggcggaaucauaacaaagagggagaccaguacauuuauaugggccagccccugaauaacgaugaggaccacgcccacuggacagaagcuaagauguuguuagauaauauaaacacuccagaggguaucauucccgcccuguuugaaccugagagggaaaaguccgcggcaaucgacggggaguaccgccucagaggcgaggccaggaaaacguucgucgaacugaugcggcguggagaucuuccaguguggcugagcuauaagguggcuucagagggcuuucaauacagugaccgccgauggugcuucgauggggaaagaaauaaccagguccucgaggaaaauauggacguugagaucuggaccaaagagggagaaaggaagaaauugcggccccgcuggcuggaugccagaacauauucugacccucuagcucugagggaguuuaaggaguucgcagccggucggcgauccgugagcggcgaccucauucuugagauagggaaacugccgcagcauuuaacucagagagcucaaaacgccuuggauaaucugguaaugcuccacaacucagaacagggaggccgcgcauacaggcaugcgauggaggagcugccagacaccaucgaaacacuuaugcugcucgccuugauugcugugcugaccgguggggucacuuuauuuuuccuaaguggccggggacugggcaagacgagcaucgggcuccuuugugugauggccuccucuguucuguuguggauggcaagcguggagccccacuggauugcugccuccaucauacuggaauuuuuccucaugguccugcuuaucccugagcccgaucgucagagaaccccacaggacaaucaacucgcauauguagugauuggacuguuguuuaugauccugacaguugccgcuaacgagauggguuuacuagaaacuaccaagaaagaucugggcauugggcacguggcggucgagaaccaucaccaugccgcaaugcucgacguggaucuucacccugcuucagccuggacacuguacgccgucgcaaccacuaucauaacacccaugaugaggcauacgauugaaaauaccacugcuaacaucucuuugacagccauugcgaaucaggcugccauccugaugggacucgacaagggcuggccaauaaguaaaauggauaucggugugccucugcuugcauuagggugcuacucgcagguuaacccgcugacccucaccgccgcuguguugaugcugguagcacacuaugccauuaucggccccggacuacaagcgaaggcuacacgcgaggcccagaaacggacugcagccggcauuaugaagaauccaacgguggacgggaucgucgcuauagaucuggacccuguuguguacgaugccaaguucgaaaaacagcucggacagauuaugcuucugaucuuguguaccagccaaauccugcucaugcgaacaacuugggcacugugcgaguccauuaccuuagcuacaggcccccuuaccacucugugggaggguucuccagggaaguuuuggaacacgacaaucgccgucucaauggcgaauauauucagaggaagcuaucucgccggcgcaggucuagcuuucucccugaugaaaaguuugggcgggggaaggcgcggcaccggggcccagggagaaacucugggcgagaaguggaaacggcagcucaaccagcuuucuaagagcgaauuuaauaccuacaagagaucagguauuauggagguggaccguuccgaagcaaaagaggggcugaagaggggagagacaacuaaacacgcuguaagucggggcaccgccaaguugcgcugguucguggaacgaaaccugguuaaaccugaggguaaggugaucgaccucggcugugggagaggaggcuggagcuauuacugcgccggguuaaagaaagucacagaagugaagggauauacgaaaggcggucccgggcaugaggaaccgauuccaauggcgaccuacggauggaaucuggucaaacuucacucuggcaaagauguguuuuucaucccucccgagaagugugacacucugcuaugcgauauaggcgaguccucaccaaaccccacaaucgaagaggggaggacccuccggguucugaaaaugguagaaccuugguugcgcggaaaucaauuuuguauuaagauccugaacccguacaugcccagcguggucgagacucucgagcagaugcagagaaagcaugguggcaugcuugugaggaauccacugucgcgaaacucuacacacgaaauguauuggguuaguugcgggaccggaaauauuguguccgcugucaacaugacgagccggauguuacugaaccguuucaccauggcacacagaaaaccuacauacgagcgcgacguggauuugggcgccgguacuaggcauguagcuguggaacccgagguugccaaucucgacaucauugggcagcggaucgaaaacauaaagcacgagcauaaaucaaccuggcacuaugaugaggacaauccuuacaagacaugggcauaucauggauccuacgaagucaaaccaucuggcagcgccaguuccauggugaacggcguggucaagcugcuaacuaagcccugggauguuauuccuauggugacccaaaucgcuaugacagacaccacuccauuugggcagcagagaguauucaaagagaagguggauacgcgcacacccaaagcgaagaggggaaccacucaaaucauggaagucaccgcccgauggcuuugggguuuucugagccggaauaaaaagccgagaauuuguacaagggaggaguucacgcgcaaggugcguucuaacgcagcuauaggcgccguuuuuguggacgagaaucaguggaacucagcaaaagaggccgucgaagacgagcgguucugggaucucgugcacagagaaagggagcugcacaagcaggggaaaugcgcuaccugcguauauaauaugaugggaaagcgcgagaaaaaguugggcgaguuugguaaggccaaagggagucgagcgaucugguacauguggcugggagcacgguuccucgaguucgaagcccuuggcuuuaugaacgaggaccauugguucuccagaggcaauagccugucugggguugaaggagaggguuuacacaagcugggcuacauuuugagggauaucucgaaaauuccugggggaaacauguaugcugacgauacugccggcugggacacacgcaucaccgaggaugaccuccagaaugaagcaaagauaacugauaucauggagccagaacaugcucugcuagccaaagcuauuuuuaaacuuacauaccaaaacaaaguggucagagugcagcggcccgccaagaaugguaccgugauggacgucaucucaaggcgugaucagcgagggagcggacagguuggcacauauggccugaacacuuucaccaacauggaggcacaacucauucgccagauggaauccgaggggaucuuuaguccuucugagcuggaaacgccaaauuuggcggagagaguguuagacuggcuggaaaaguacggaguagagcggcucaaaaggauggccauaagcggugaugacuguguggucaagcccauugacgaucgcuucgcuaccgcccuuacagcacugaacgacaugggcaaagugagaaaggauaucccgcagugggaaccuuccaaaggguggaaugacuggcagcaaguucccuuuugcucacaccacuuccaucagcuaaucaugaaggauggacgggagauuguggucccauguaggaaccaggacgagcuggugggccgagcucguguaagucagggugccggguggucucucagagaaacugcaugcuugggaaagagcuaugcccaaauguggcagcugauguacuuucaccgccgggaucuuaggcuggcggcuaaugccauauguuccgcaguuccuguggacuggguccccaccucaagaacaacuuggagcauccaugcccaccaucaguggaugaccacggaggauaugcucucuguguggaaccgcguuuggauugaagagaauccauggauggaagacaaaacacacaucuccaguugggaggaugugcccuauuuaggcaagcgggaggaccaauggugcggcagccugauuggguugaccgcuagggccacuugggcaacaaacauccaggucgcuauaaaucaggugcgaagacugaucggaaacgaaaauuaccucgacuacaugaccucgaugaaacgguucaagaacgaguccgauccugaaggugcccuuugguga

SEQ ID NO: 14169 - RNA, 9879 nt, Artificial Sequence
  derived and/or modified CDS sequence (opt3) from DENV-1__KC762627__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaacaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuggacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccauuuuugccggccaucugaaaugccgucuaaagauggauaaacucacacugaaggggauguccuaugugauguguacugguagcuucaaacuugagaaggaagucgcugagacccagcacggaacgguguugguucagauaaaguacgagggcacagacgcgccuugcaaaaucccauucucgacccaagaugaaaagggggugacucagaacggacgccugauuacagcaaaucccaucguaaccgacaaagagaagccugucaacauagaagccgagccacccuuuggcgagucuuauauugugaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguuuuuacauccguggggaaacugauucaucagauauucggaacggcguacggcgucuuguuuucuggugugagcuggaccaugaagaucgggauuggcguacuccugacuugguuaggacuaaauucacgaaguacaucccuaagcaugaccuguaucgcugugggccucguuacacuguaccuuggggucauggugcaggccgauucuggaugcgugaucaacuggaaaggccgcgaauugaagugugguucagggauuuucgucacuaaugagguucacaccuggacggaacaauauaaguuucaggcagacaguccgaaaagacugagcgccgcuauaggaaaggccugggaggagggcgugugcgguaucagguccgcaacacggcucgaaaacauuauguggaaacagaucucuaacgagcugaaucauauuuuacuggaaaacgacaugaaguucaccgugguagucggcgauguggcugggauccuugcccagggcaaaaagaugauacgcccucaacccauggagcacaaauacucguggaaaagcuggggcaaggcgaaaaucauuggggccgacguucagaauacuaccuuuaucauugauggaccaaacacaccugaaugucccgacgaucagagagcuuggaauaucugggagguggaggacuauggcuucgguauauuuacuaccaacauuugguugaagcucagggauuccuacacacaggucugcgaccaccgucugaugucagcagccaucaaagauaguaaggcugugcaugccgacaugggguauuggauugaaucugagaaaaaugaaacguggaagcuagcacgggcgagcuucaucgagguuaagaccuguauauggccaaaaucccacacucuguggucaaacggagugcucgaaagcgagaugaucauucccaagaucuacggcgguccuauuucucaacauaauuaucgaccaggcuacuucacacagaccgccgggccguggcaccugggaaaacuugaguuggauuuugaccugugcgaaggcacuacaguagucguggaugagcacugcgggaacagaggacccuccuuaaggaccacgacugugaccggcaagaucauacaugaaugguguugccgcaguuguacacucccuccacugcgguucagaggugaggacgggugcugguacggaauggagauuaggcccgucaaagaaaaggaggaaaaucuuguuaagagcauggugucugcuggcuccggugagguagacucauuuagucugggcuugcucuguaucagcaugaugaucgaagaggugaugcgcucgcgauggucccggaaaaugcugaugaccgggacucuagccgucuucuuucugcucauuaugggacagcugacauggaacgaucuuauccguuugugcauuauggugggcgcaaaugcuucugacagaauggggaugggaaccacauaucuggccuuaauggcaacuuucaagaugaggccuauguuugccguuggccuccuguuccgccggcuuaccagcagagaggugcugcuacucacgauaggucugucauuggucgcuaguguggaacugccaaacuccuuagaggaacucggggauggacuggcgaugggcaucaugauucuuaaacuguugacagacuuucaaucucaccagcucugggccacccugcuaagccugacuuucaucaagaccacauuuucccuucauuacgcauggaaaacuauggcuaugguucucucaauugugagccuguuccccuugugucugaguaccacgucucagaagacaaccugguuaccgguccuccugggcucccuugggugcaagccucugacuauguuuuugaucgccgagaauaaaauauggggaagaaaguccuggccacucaacgaagguaucauggccguaggcauugugucgauccugcuaucaucucugcuuaaaaacgauguuccccucgcugggccucugauugcaggaggcauguugaucgccuguuaugugauaagugguuccagcgcggacuuaucucuggagaaggcugccgaggucagcugggaagaggaagcagagcacuccggggccucacauaauauucucguggaaguacaggaugacggaacaaugaaaaucaaggaugaggagcgagacgauacccugacuauccuucugaaagcuacauugcuagcagugaguggcgucuacccccugagcauuccagccacccucuucguuugguauuucuggcaaaagaagaaacagcgcucuggcgugcugugggacacgccuucacccccagaaguggagcgggcgguccuugaugacgggauauacagaaucaugcagaggggauuacugggucguagccaggugggcguugggguauuucaagaaaacguguuccacacuauguggcacgucacccgcggagcugugcucauguaucagggcaagcgguuggagccgaguugggccagcguuaaaaaggaccugauuuccuacggugggggauggagacuccagggcucuuggaauacaggcgaggaagugcaggucaucgcaguggagccugggaaaaaccccaagaauguacaaaccgccccaggaacauuuaagacucccgaaggugaggucggcgcuauugcccuggauuucaaaccugggaccucgggaagcccaaucgugaacagggaaggcaagauaguuggucuuuacgggaauggaguggucacgacaucaggcacuuauguguccgcaaucgcucaggccaaagcgagucaggagggcccccugccugagauugaagacgagguuuuucgaaagcggaacuugaccaucauggaucuacauccggggucuggaaaaacacgcagauaccugccagccauugugagggaagcaaucaagcggaagcuccgaaccuuaauacuggcucccacuagagucguggccagcgagauggcugaagcacuuaaagguaugccuauucgcuaucaaaccacagccguaaaguccgagcacacgggcaaagagaucguggaccugaugugccaugccacuuucaccaugaggcucuugucaccaguucguguccccaauuacaacaugaucauuauggaugaagcucacuuuacagacccuucuagcaucgcggcacggggguauauaaguaccagagugggaaugggcgaggccgcugccauuuucaugacugcaacaccgcccgguuccguggaagccuuuccacagagcaaugcugucauccaggaugaggaaagggacauuccugagcgcucuuggaacucaggguacgaguggaucaccgauuuccccggaaagacgguaugguuugugccauccauaaaaaguggcaaugacauugcgaacugucugcgaaagaauggcaagagaguuauccagcucagccggaaaacuuucgauacagaauaucaaaagaccaaaaacaacgacugggacuacguggucaccacugauaucucggagaugggggccaauuucagggcagaccgcgugauugauccucguagaugccugaagcccguuauccuuaaagacggaccagaacgggugauucuagcugguccgaugccugucacaguggccucugcagcccagaggcgcggccgaguagggagaaaccauaauaaggagggagaucaguacauauauaugggccagccccugaacaaugacgaggaucacgcucacuggaccgaagccaagauguuguuagacaacaucaauacaccagaggguauuauccccgcgcuguuugaaccugagcgggaaaaauccgcagccaucgauggggaguacaggcuccgcggcgaggcuagaaagacuuucguggaacugaugaggcggggagaccuuccaguuuggcugagcuauaaagucgccucagagggcuuucaauacagugaucgucgcuggugcuucgacggggaacgaaacaaucaggugcucgaggaaaacauggauguggagauuuggacgaaggagggagaaaggaaaaaguugaggccccgguggcuggacgcucgcaccuauucugacccucuagcacugagagaguuuaaagaguucgccgcugguaggcgguccgucagcggcgaucucauacuugagaucgggaagcugccgcagcauuuaacacagcgagcccaaaaugcauuggacaaccugguuaugcuccacaauucagaacagggaggcagagcguaccgccaugccauggaggagcugccagauacuauugaaacccuuaugcugcucgcuuugaucgccgugcugacaggugggguaaccuuauuuuuccuaaguggcaggggacugggcaagacuagcauugggcuccuuugugugauggcauccucuguccuguuguggauggcuagcguggagccccacuggaucgccgcauccauaauccuggaauuuuuccucaugguucugcuuauuccugagcccgaccggcagcguacgccacaggauaaccaacucgccuauguggucaucggacuguuguuuaugauucugaccguagcugcgaaugagauggguuuacuagaaacaacuaaaaaggaccugggcaucgggcacguggccguugagaaccaucaccaugcagcuaugcucgauguggaccuucacccugccucagccuggacccuguacgcagucgcuacaaccauaauuacucccaugaugagacauacaaucgaaaacacgaccgccaauauuucuuugacugcgaucgcuaaccaggccgcaauacugaugggacucgauaaaggcuggccaaucaguaagauggacauuggugugccucugcuugccuuagggugcuacucgcaggucaauccgcugacacucaccgcugcaguguugaugcugguugcccacuaugcgaucauuggccccggacuacaagcuaaagccaccagggaggcacagaagcgcacagccgcuggcaucaugaagaacccaacuguggaugggauaguagccauugaccuggauccuguggucuacgacgcaaaauucgaaaagcagcucggacagaucaugcuucugaucuuguguacgagccaaauucugcucaugcggaccacaugggcucugugcgaguccaucacuuuagccaccggcccccuuacaacccugugggaggguucuccagggaaauuuuggaauacuacgauagcgguuucaauggccaacauuuuccgaggaagcuaucucgcaggcgcuggucuagccuucucccugaugaagaguuugggcgggggaagaaggggcacaggggcacagggagaaacccugggcgagaaauggaagcgccagcucaaucagcuuucuaagagcgaauuuaacacuuacaaacggucagguaucauggagguggacagauccgaagcuaaggaggggcugaaacguggagagaccacaaagcacgccgucaguaggggcacugccaaauugcggugguucguggaacgcaaucugguaaagccugaggguaaggugauugaucucggcugugggcgaggaggcuggagcuauuacugcgcggggcuaaagaagguuaccgaagugaaaggauauacaaagggcggucccgggcaugaggaaccgaucccaauggcuacguacggauggaaccuggucaaacuucacucuggcaaggacguguuuuucauaccucccgagaaaugugauacccugcuaugcgacaucggcgaguccucaccaaaucccacuauugaagaggggagaacacucaggguccugaagaugguggaaccuugguugcggggaaaccaauuuuguaucaagauucugaauccguacaugcccagcguuguagagacccucgagcagaugcagcgcaaacaugguggcaugcuugugagaaacccacugucgagaaauucuacucacgaaauguauugggucaguugcgggacaggaaacaucguguccgcaguuaauaugaccagccgaauguuacugaaccgguucacgauggcccaccguaagccuaccuacgagagagauguggacuugggcgcugguacacgccaugucgccguggaacccgagguagcaaaccucgauauuaucgggcagaggauagaaaauauuaaacacgagcauaagucaacuuggcacuaugacgaggauaacccuuacaaaaccugggccuaucauggauccuacgaagugaagccaucuggcagcgcuaguuccaugguuaauggcgucgugaagcugcuaacaaaacccugggacgugaucccuauggucacucaaaucgcgaugaccgauacaaccccauuugggcagcagcggguuuucaaggagaaaguggacacuagaacgcccaaggccaaacgcggaacaacccaaauuauggaaguaacugcaagguggcuuuggagcuuucugucucgaaacaagaagccgcggauauguaccagagaggaguucacaaggaaagugcgcucaaaugcugccaucggugcagucuuuguggacgagaaccaguggaauagugccaaggaggcuguugaagaugagcguuucugggaccucgugcaccgggaaagagagcugcacaaacagggcaagugcgccacgugcgucuauaacaugauggggaaaagggaaaagaaguugggagaguuuggcaaagcgaaggguucccgcgcaauuugguacauguggcugggggcccgauuccucgaguucgaagcucuuggauuuaugaaugaggaucauugguucagccgggaaaacucucugucgggcguggagggcgagggguuacacaaacugggauacaucuugagagacauuucaaagaucccugguggcaauauguaugccgaugacaccgcagggugggauacuaggauaacagaagacgaucuccagaacgaggcuaaaaucaccgacauuauggaaccagagcaugcccugcuagcuaaggccaucuuuaaacuuacuuaccaaaauaagguaguucgcgugcagagacccgcaaagaacggaacagucauggaugugauuagccggagggaccagcguggcuccggucagguggggaccuauggacugaauacauucacuaacauggaagcgcaacucauccgacagauggagagugagggcauauuuucuccuagcgaacuggagaccuccaacuuggccgaacgcgucuuagauuggcuggagaaauacggcguugaaagacucaagcggauggcuauuucaggggacgacugugugguaaaaccaaucgaugacagguucgccacggcacuuaccgcucugaaugauaugggaaaggugcgcaaagacaucccccagugggagccgaguaaggguuggaacgauuggcagcaagucccuuuuugcucucaccacuuccaucagcuaauuaugaaggacggcagagagauagugguucccugucggaaucaggaugaacugguggggagggcccgagucagccagggagcaggcuggucccuccgugagacagccugcuuggguaaaucauaugcgcaaauguggcagcugauguacuuucacagacgcgaccuucggcuggcugccaacgcaaucuguagcgccgugccaguagauuggguuccuacuucuaggaccacaugguccauucaugcucaccaucaguggaugacuaccgaagacaugcucaguguguggaauagagucuggaucgaggaaaaccccuggauggaggauaagacgcacauuagcucgugggaggacgugccauauuuagggaaacgcgaagaccaauggugcggaucccugaucggcuugacagcccgggcaaccugggcuacuaauauacagguugccaucaaccaggugaggcgacugauuggcaaugagaacuaccucgauuacaugacaucuaugaagagauucaaaaaugaaucagaccccgagggggcgcuuugguga

SEQ ID NO: 14170 - RNA, 9879 nt, Artificial Sequence
  derived and/or modified CDS sequence (opt3) from DENV-1__KC762647__SS-prME
uccgugaccaugcugcucaugcuuacgcccacugcacuggcuuuccacuugacgaccagaggaggggaaccucauaugaucgucuccaagcaggaaaggggaaaaucuuuacuguuuaagacgucagccgguguuaauaugugcacuuuaauugccauggaccucggcgagcugugugaagauacccuuacauacaaaugcccacggauaaccgaggcggaaccggacgauguggacuguuggugcaaugcuacugauacauggguaaccuaugggacguguagucaaacuggagagcaccgccgagacaagcguagcguggcccuggcaccccaugucggcuugggucucgagaccagaacagaaacuuggauguccucugagggggccuggaaacagauccagaggguggaaaccugggcucugcggcacccuggauucacaguuauugcacuguuucucgcccaugcuaucggcaccucgauuacgcagaagggcaucauauucaucuuacugaugcuugugacuccaucaauggccaugcgcugcgucgggauuggaagcagagauuuuguggaggguuugaguggcgcgacauggguagacguugugcuggagcacggguccugugucaccacuauggcaaaggauaaacccacacuggacaucgaacuccugaagaccgaggugacgaacccugccgugcuuaggaaacugugcauugaagcuaagaucucuaauaccacaacugauagccgguguccaacccaaggagaggccacauuggucgaagaacaagacgcaaacuucguuugccgccgaacuuuuguggauagaggcugggguaauggguguggacucuucggcaaaggcucccugauaaccugcgcuaaguuuaagugcguaacaaaauuagaggggaagauugugcaguacgaaaaccugaaauauucagucaucgugaccguucacacuggagaccagcaucaaguggguaaugagaguacggaacacggcacaaccgccacuauuacaccccaagcgccuaccaccgagauccagcucacugacuacggggcccuuacacuggauuguagcccaaggacgggauuggacuucaacgaaaugguccuacugaccaugaaggagaaaucuuggcucgugcauaagcagugguuucuggaucuuccgcugcccuggacuuccggcgcaucaacaagccaagagaccuggaaucggcaggacuugcucguaacauucaaaacugcucacgccaagaagcaggaaguugugguccuggguagucaagagggggcuaugcacaccgccuuaacgggcgcaaccgaaauccagacaucuggaacuaccacaauuuuugccggccaucugaaaugccgucuaaagauggauaaacucacucugaaggggauguccuaugugauguguaccgggagcuucaaacuugagaaggaagucgcugagacgcagcacgguacaguguugguucagauaaaguacgagggcaccgacgcgccuugcaaaaucccauucucgacucaagaugaaaagggggugacacagaacggacgccugauuaccgcaaaucccaucguaacugacaaagagaagccugucaacauagaagccgagccacccuuuggcgagucuuauauugugaucggugcuggggaaaaagcccucaagcuguccugguucaagaaaggcucaaguaucggaaagauguuugaggcaaccgccagaggcgcuaggcggauggccauucuuggggauacagcaugggacuucggaagcaucgguggcguuuuuacguccguggggaaacugguccaucagauuuucggaaccgcguacggcguguuguuuucugguguaagcuggacuaugaagauagggaucggcgugcuccugacaugguuaggacuaaauucacgaaguaccucccuaagcaugacauguauugcuguuggccucgucacucuguaccuuggggugauggugcaggccgauucuggaugcgucaucaacuggaaaggccgcgaauugaagugugguucagggaucuucguuaccaaugaggugcacacguggacagaacaauauaaguuucaggcagacaguccgaaaagacugagcgccgcuauuggaaaggccugggaggagggcgugugcgguauaagguccgcaacccggcucgaaaacaucauguggaaacagauuucuaacgagcugaaucauaucuuacuggaaaacgacaugaaguucacuguagucgugggcgauguugcugggauucuugcccagggcaagaagaugauccgcccucaacccauggagcacaaauacucguggaaaagcuggggcaaggcgaaaauaaucggggccgacgugcagaauaccacauuuauuaucgauggaccaaacacuccugaaugucccgacgaucagagagcuuggaauauuugggaggucgaggacuauggcuucgguaucuuuaccacaaacauaugguugaagcucagggauuccuacacacaggugugcgaccaccgucugaugucagcagccauuaaagauagucgggcuguucaugccgacaugggguauuggaucgaaucugagaagaaugaaaccuggaaacuagcacgagcgagcuucauugaggugaagacuuguguauggccaaagucccacacacuguggucaaacggaguccucgaaagcgagaugaucauacccaaaaucuacggcgguccuauuucucaacauaauuauagaccaggcuacuucacccagacugccgggccguggcaccugggaaaacuugaguuggauuuugaccugugcgaaggcacaaccgugguggucgaugagcacugcgggaacaggggacccuccuuacgcacgacuaccguuacaggcaaaaucauucaugaaugguguugccggaguuguacccucccuccacugagauucaggggugaggacgggugcugguacggaauggagauccgccccgugaaggaaaaagaggaaaaucuuguaaagagcauggugucugcuggcuccggugaggucgacucauuuagucugggcuugcucuguauaagcauuaugaucgaagaggugaugcgaucgcgguggucccguaagaugcugaugacugggacacuagccguuuucuuucugcucaucaugggacagcugaccuggaacgaucuuauuagauugugcaucauggugggcgcaaaugcuucugacaggauggggaugggaacaacuuaucuggccuuaauggcaaccuucaaaaugcgcccuauguuugccgucggccuccuguuccggagacuuacgagcagggaggugcugcuacucacaauuggucugucauugguugcuaguguggaacugccaaacuccuuagaggaacucggggauggacuggcgaugggcauaaugauccuuaagcuguugaccgacuuucaaucucaccagcucugggccacucugcuaagccugaccuucauuaaaacaacuuuuucccuucauuacgcauggaagaccauggcuaugguccucucaaucguaagccuguuccccuugugucugaguacgacaucucagaaaaccacuugguuaccggugcuccugggcucccuugggugcaagccucugacaauguuuuugauugccgagaauaagaucuggggacgaaaaagcuggccacucaacgaagguauaauggccguuggcaucgugucgauucugcuaucaucucugcuuaagaacgaugucccccucgcugggccucugaucgcaggaggcauguugauugccuguuaugugaucagugguuccagcgcggacuuaucucuggagaaagcugccgagguaagcugggaagaggaagcagagcacuccggggccucacauaauauacucguggaaguccaggaugacggaaccaugaagauuaaagaugaggagcgcgacgauacucugacaauccuucugaaggcuaccuugcuagcaguuaguggcguguacccccugagcaucccagccacacucuucgugugguauuucuggcagaaaaagaagcagcggucuggcguccugugggacacuccuucacccccagaaguggagagagcgguucuugaugacgggauuuacaggauaaugcagcguggauuacugggucgcagccagguaggcgugggggucuuucaagaaaacguguuccacaccauguggcacguuacacggggagcugugcucauguaucagggcaaaagauuggagccgaguugggccagcgucaagaaagaccugaucuccuacggugggggauggaggcuccagggcucuuggaauaccggcgaggaagugcagguaauugcagucgagccugggaagaaccccaaaaaugugcaaacagccccaggaacuuuuaagacccccgaaggugagguuggcgcuaucgcccuggauuucaagccugggacgucgggaagcccaauugugaaccgagaaggcaaaaucgucggucuuuacgggaauggagugguuacaacuucaggcaccuauguguccgcaauagcucaggccaaggcgagucaggagggcccccugccugagaucgaagacgaggucuuucggaaacgcaacuugacaauuauggaucuacauccggggucuggaaagaccagaagguaccugccagccaucgugcgggaagcaauuaaacgaaagcucagaacuuuaauccuggcucccacccgcguaguggccagcgagauggcugaagcacuuaaggguaugccuauaagguaucaaacaacggccguuaaauccgagcacacuggcaaggagauugucgaccugaugugccaugccaccuucacaaugcgucucuugucaccagugcgggugcccaauuacaacaugaucaucauggaugaagcucacuuuaccgacccuucuagcauugcggcaagaggguauaucaguacuagggucggaaugggcgaggccgcugccauauucaugacagcaaccccgcccgguuccguagaagccuuuccacagagcaaugcugugauucaggaugaggaacgcgacaucccugagcgaucuuggaacucaggguacgaguggauuacggauuuccccggaaaaacuguuugguuugugccauccaucaagaguggcaaugacauagcgaacugucugaggaaaaauggcaagcgggucauucagcucagcaggaagacauucgauaccgaauaucagaaaaccaagaacaacgacugggacuacgugguuacuacagauaucucggagaugggggccaauuuccgcgcagaccgugugaucgauccuagacggugccugaaacccgucauucuuaaggacggaccagaaagggugauccuagcugguccgaugccuguaaccguggccucugcagcccagcgccgaggcagaguugggcggaaccauaauaaagagggagaucaguacauuuauaugggccagccccugaacaaugacgaggaucacgcucacuggacagaagccaagauguuguuagacaacauaaauacuccagaggguaucauucccgcgcuguuugaaccugagagggaaaaguccgcagccaucgauggggaguaccgccucagaggcgaggcuaggaaaacguucgucgaacugaugcggcguggagaccuuccaguguggcugagcuauaagguggccucagagggcuuucaauacagugaucgccgauggugcuucgacggggaaagaaacaaucagguccucgaggaaaacauggauguugagaucuggaccaaagagggagaaaggaagaaauugcggccccgcuggcuggacgcuagaacauauucugacccucuagcacugagggaguuuaaggaguucgccgcuggucggcgauccgugagcggcgaucucauucuugagauagggaaacugccgcagcauuuaacucagaaggcccaaaaugcauuggacaaccugguaaugcuccacaauucagaacagggaggcagagcguaccgccaugccauggaggagcugccagauaccaucgaaacacuuaugcugcucgcuuugauugccgugcugaccgguggggucacuuuauuuuuccuaaguggcaggggacugggcaagacgagcaucgggcuccuuugugugauggcauccucuguucuguuguggauggcuagcguggagccccacuggauugccgcauccaucauacuggaauuuuuccucaugguccugcuuaucccugagcccgaccggcagcguaccccacaggauaaccaacucgccuauguagugauuggacuguuguuuaugauccugacaguugcugcgaaugagauggguuuacuagaaacuaccaaaaaggaccugggcauugggcacguggccgucgagaaccaucaccaugcagcuaugcucgauguggaccuucacccugccucagccuggacacuguacgcagucgcuaccacuaucauaacacccaugaugagacauacgauugaaaacaccacugccaauaucucuuugacagcgauugcuaaccaggccgcaauccugaugggacucgauaaaggcuggccaauaaguaagauggacaucggugugccucugcuugccuuagggugcuacucgcagguuaauccgcugacccucaccgcugcaguguugaugcugguagcccacuaugcgauuaucggccccggacuacaagcuaaagccacaagggaggcacagaagcgcacugccgcuggcauuaugaagaacccaacgguggaugggaucgucgccauagaccuggauccuguuguguacgacgcaaaauucgaaaagcagcucggacagauuaugcuucugaucuuguguaccagccaaauccugcucaugcggacaacuugggcucugugcgaguccauuaccuuagccacaggcccccuuaccacucugugggaggguucuccagggaaauuuuggaauacgacaaucgcggucucaauggccaacauauuccgaggaagcuaucucgcaggcgcuggucuagccuucucccugaugaagaguuugggcgggggaagaaggggcaccggggcacagggagaaacucugggcgagaaauggaagcgccagcucaaucagcuuucuaagagcgaauuuaacaccuacaaacggucagguauuauggagguggacagauccgaagcuaaggaggggcugaaacguggagagacaacuaagcacgccguaaguaggggcaccgccaaauugcggugguucguggaacgcaaucugguuaagccugaggguaaggugaucgaucucggcugugggcgaggaggcuggagcuauuacugcgcggggcuaaagaaggucacagaagugaaaggauauacgaagggcggucccgggcaugaggaaccgauuccaauggcuaccuacggauggaaccuggucaaacuucacucuggcaaggacguguuuuucaucccucccgagaaaugugauacucugcuaugcgacauaggcgaguccucaccaaaucccacaaucgaagaggggagaacccucaggguucugaagaugguagaaccuugguugcggggaaaccaauuuuguauuaaggugcugaauccguacaugcccagcgucguggagacucucgagcagaugcagcgcaaacaugguggcaugcuuguuagaaacccacugucgagaaauucuacacacgaaauguauugggugaguugcgggaccggaaacaucgucuccgcagugaauaugacgagccgaauguuacugaaccgguucaccauggcccaccguaagccuacauacgagagagauguagacuugggcgcugguacucgccauguggccguugaacccgaggucgcaaaccucgauauuaucgggcagaggauugaaaauaucaaacacgagcauaagucaaccuggcacuaugacgaggauaacccuuacaaaacaugggccuaucauggauccuacgaagugaagccaucuggcagcgcuaguuccauggugaauggcgucguuaagcugcuaacuaaacccugggacgugauaccuaugguaacccaaauugcgaugacagauaccacuccauuugggcagcagcggguguucaaggagaaagucgacacgagaacacccaaggccaaacgcggaaccacucaaaucauggaagugaccgcaagguggcuuugggguuuucugagccgaaacaagaagccgcggaucuguacaagagaggaguucacgaggaaaguucgcucuaaugcugccauuggcgcaguguuugucgacgagaaccaguggaacucagccaaggaggcuguggaagaugagcguuucugggaccucguacaccgggaaagagagcugcacaaacaggggaagugcgcgaccugcguuuauaacaugaugggaaaaagggaaaagaaguugggcgaguuugguaaagccaaggggagucgcgcaauaugguacauguggcugggagcccgauuccucgaguucgaagcucuuggcuuuaugaaugaggaucauugguucucccgggaaaacagccugucuggcguggagggggagggauuacacaaacuggguuacaucuugagagacauuucgaagaucccuggcgggaauauguaugccgaugacacugcaggaugggauacaaggauuaccgaagacgaucuccagaacgaggcuaaaaucacugacauaauggaaccagagcaugcccugcuagcuaaggccaucuuuaaacuuacauaccaaaauaaggucgugcgcgugcagagacccgcaaagaacggcaccgucauggauguuauuucacggagggaccagcgugguagcggacaggugggaacauauggccugaauacuuucaccaacauggaagcgcaacucauccgacagauggaguccgagggcauuuuuaguccuucugaacuggagacgccaaacuuggccgaacgcguauuagauuggcuggagaaauacgggguggaaagacucaagcggauggcuaucagcggagacgacugugucgugaaacccauagaugacagguucgccaccgcacuuacagcucugaaugauauggguaagguucgcaaagacauuccgcagugggagccuuccaagggcuggaacgauuggcagcaagugcccuuuugcucacaccacuuccaucagcuaaucaugaaggacgggagagagaucgucgugccaugucggaaucaggaugaacugguaggaagggcccgaguuagucagggcgcagguuggucucuccgugagccugccugcuuggggaaaagcuaugcgcaaauguggcagcugauguacuuucacagacgcgaccuucggcuggcugccaacgcaauuuguuccgccgugcccgucgauugggugccaacuucaaggaccacauggagcauacaugcucaccaucaguggaugacuaccgaagacaugcucucuguuuggaauagaguguggaucgaggaaaaccccuggauggaggauaagacgcacauuuccaguugggaggacgucccuuauuuaggaaaacgcgaagaccaauggugcggcagccugaucggcuugacagcccgggcaaccugggcuacuaauauucagguggccaucaaccagguaaggcgacugauagggaaugagaacuaccucgauuacaugacaucgaugaagagauucaaaaaugaauccgacccagagggagcgcuuugguga

SEQ ID NO: 14171 - RNA, 9879 nt, Artificial Sequence
  derived and/or modified CDS sequence (opt3) from DENV-1__KC762639__SS-prME
uccgugaccaugcugcucaugcuuacgcccacugcacuggcuuuccacuugacgaccagaggaggggaaccucauaugaucgucuccaagcaggaaaggggaaaaucuuuacuguuuaagacgucagccgguguuaauaugugcacuuuaauugccauggaccucggcgagcugugugaagauacccuuacauacaaaugcccacggauaaccgaggcggaaccggacgauguggacuguuggugcaaugcuacugauacauggguaaccuaugggacguguagucaaacuggagagcaccgccgagacaagcguagcguggcccuggcaccccaugucggcuugggucucgagaccagaacagaaacuuggauguccucugagggggccuggaaacagauccagaggguggaaaccugggcucugcggcacccuggauucacaguuauugcacuguuucucgcccaugcuaucggcaccucgauuacgcagaagggcaucauauucaucuuacugaugcuugugacuccaucaauggccaugcgcugcgucgggauuggaagcagagauuuuguggaggguuugaguggcgcgacauggguagacguugugcuggagcacggguccugugucaccacuauggcaaaggauaaacccacacuggacaucgaacuccugaagaccgaggugacgaacccugccgugcuuaggaaacugugcauugaagcuaagaucucuaauaccacaacugauagccgguguccaacccaaggagaggccacauuggucgaagaacaagacgcaaacuucguuugccgccgaacuuuuguggauagaggcugggguaauggguguggacucuucggcaaaggcucccugauaaccugcgcuaaguuuaagugcguaacaaaauuagaggggaagauugugcaguacgaaaaccugaaauauucagucaucgugaccguucacacuggagaccagcaucaaguggguaaugagaguacggaacacggcacaaccgccacuauuacaccccaagcgccuaccaccgagauccagcucacugacuacggggcccuuacacuggauuguagcccaaggacgggauuggacuucaacgaaaugguccuacugaccaugaaggagaaaucuuggcucgugcauaagcagugguuucuggaucuuccgcugcccuggacuuccggcgcaucaacaagccaagagaccuggaaucggcaggacuugcucguaacauucaaaacugcucacgccaagaagcaggaaguugugguccuggguagucaagagggggcuaugcacaccgccuuaacgggcgcaaccgaaauccagacaucuggaacuaccacaauuuuugccggccaucugaaaugccgucuaaagauggauaaacucacucugaaggggauguccuaugugauguguaccgggagcuucaaacuugagaaggaagucgcugagacgcagcacgguacaguguugguucagauaaaguacgagggcaccgacgcgccuugcaaaaucccauucucgacucaagaugaaaagggggugacacagaacggacgccugauuaccgcaaaucccaucguaacugacaaagagaagccugucaacauagaagccgagccacccuuuggcgagucuuauauugugaucggugcuggggaaaaagcccucaagcuguccugguucaagaaaggcucaaguaucggaaagauguuugaggcaaccgccagaggcgcuaggcggauggccauucuuggggauacagcaugggacuucggaagcaucgguggcguuuuuacguccguggggaaacugguccaucagauuuucggaaccgcguacggcguguuguuuucugguguaagcuggacuaugaagauagggaucggcgugcuccugacaugguuaggacuaaauucacgaaguaccucccuaagcaugacauguauugcuguuggccucgucacucuguaccuuggggugauggugcaggccgauucuggaugcgucaucaacuggaaaggccgcgaauugaagugugguucagggaucuucguuaccaaugaggugcacacguggacagaacaauauaaguuucaggcagacaguccgaaaagacugagcgccgcuauuggaaaggccugggaggagggcgugugcgguauaagguccgcaacccggcucgaaaacaucauguggaaacagauuucuaacgagcugaaucauaucuuacuggaaaacgacaugaaguucacuguagucgugggcgauguugcugggauucuugcccagggcaagaagaugauccgcccucaacccauggagcacaaauacucguggaaaagcuggggcaaggcgaaaauaaucggggccgacgugcagaauaccacauuuauuaucgauggaccaaacacuccugaaugucccgacgaucagagagcuuggaauauuugggaggucgaggacuauggcuucgguaucuuuaccacaaacauaugguugaagcucagggauuccuacacacaggugugcgaccaccgucugaugucagcagccauuaaagauagucgggcuguucaugccgacaugggguauuggaucgaaucugagaagaaugaaaccuggaaacuagcacgagcgagcuucauugaggugaagacuuguguauggccaaagucccacacacuguggucaaacggaguccucgaaagcgagaugaucauacccaaaaucuacggcgguccuauuucucaacauaauuauagaccaggcuacuucacccagacugccgggccguggcaccugggaaaacuugaguuggauuuugaccugugcgaaggcacaaccgugguggucgaugagcacugcgggaacaggggacccuccuuacgcacgacuaccguuacaggcaaaaucauucaugaaugguguugccggaguuguacccucccuccacugagauucaggggugaggacgggugcugguacggaauggagauccgccccgugaaggaaaaagaggaaaaucuuguaaagagcauggugucugcuggcuccggugaggucgacucauuuagucugggcuugcucuguauaagcauuaugaucgaagaggugaugcgaucgcgguggucccguaagaugcugaugacugggacacuagccguuuucuuucugcucaucaugggacagcugaccuggaacgaucuuauuagauugugcaucauggugggcgcaaaugcuucugacaggauggggaugggaacaacuuaucuggccuuaauggcaaccuucaaaaugcgcccuauguuugccgucggccuccuguuccggagacuuacgagcagggaggugcugcuacucacaauuggucugucauugguugcuaguguggaacugccaaacuccuuagaggaacucggggauggacuggcgaugggcauaaugauccuuaagcuguugaccgacuuucaaucucaccagcucugggccacucugcuaagccugaccuucauuaaaacaacuuuuucccuucauuacgcauggaagaccauggcuaugguccucucaaucguaagccuguuccccuugugucugaguacgacaucucagaaaaccacuugguuaccggugcuccugggcucccuugggugcaagccucugacaauguuuuugauugccgagaauaagaucuggggacgaaaaagcuggccacucaacgaagguauaauggccguuggcaucgugucgauucugcuaucaucucugcuuaagaacgaugucccccucgcugggccucugaucgcaggaggcauguugauugccuguuaugugaucagugguuccagcgcggacuuaucucuggagaaagcugccgagguaagcugggaagaggaagcagagcacuccggggccucacauaauauacucguggaaguccaggaugacggaaccaugaagauuaaagaugaggagcgcgacgauacucugacaauccuucugaaggcuaccuugcuagcaguuaguggcguguacccccugagcaucccagccacacucuucgugugguauuucuggcagaaaaagaagcagcggucuggcguccugugggacacuccuucacccccagaaguggagagagcgguucuugaugacgggauuuacaggauaaugcagcguggauuacugggucgcagccagguaggcgugggggucuuucaagaaaacguguuccacaccauguggcacguuacacggggagcugugcucauguaucagggcaaaagauuggagccgaguugggccagcgucaagaaagaccugaucuccuacggugggggauggaggcuccagggcucuuggaauaccggcgaggaagugcagguaauugcagucgagccugggaagaaccccaaaaaugugcaaacagccccaggaacuuuuaagacccccgaaggugagguuggcgcuaucgcccuggauuucaagccugggacgucgggaagcccaauugugaaccgagaaggcaaaaucgucggucuuuacgggaauggagugguuacaacuucaggcaccuauguguccgcaauagcucaggccaaggcgagucaggagggcccccugccugagaucgaagacgaggucuuucggaaacgcaacuugacaauuauggaucuacauccggggucuggaaagaccagaagguaccugccagccaucgugcgggaagcaauuaaacgaaagcucagaacuuuaauccuggcucccacccgcguaguggccagcgagauggcugaagcacuuaaggguaugccuauaagguaucaaacaacggccguuaaauccgagcacacuggcaaggagauugucgaccugaugugccaugccaccuucacaaugcgucucuugucaccagugcgggugcccaauuacaacaugaucaucauggaugaagcucacuuuaccgacccuucuagcauugcggcaagaggguauaucaguacuagggucggaaugggcgaggccgcugccauauucaugacagcaaccccgcccgguuccguagaagccuuuccacagagcaaugcugugauucaggaugaggaacgcgacaucccugagcgaucuuggaacucaggguacgaguggauuacggauuuccccggaaaaacuguuugguuugugccauccaucaagaguggcaaugacauagcgaacugucugaggaaaaauggcaagcgggucauucagcucagcaggaagacauucgauaccgaauaucagaaaaccaagaacaacgacugggacuacgugguuacuacagauaucucggagaugggggccaauuuccgcgcagaccgugugaucgauccuagacggugccugaaacccgucauucuuaaggacggaccagaaagggugauccuagcugguccgaugccuguaaccguggccucugcagcccagcgccgaggcagaguugggcggaaccauaauaaagagggagaucaguacauuuauaugggccagccccugaacaaugacgaggaucacgcucacuggacagaagccaagauguuguuagacaacauaaauacuccagaggguaucauucccgcgcuguuugaaccugagagggaaaaguccgcagccaucgauggggaguaccgccucagaggcgaggcuaggaaaacguucgucgaacugaugcggcguggagaccuuccaguguggcugagcuauaagguggccucagagggcuuucaauacagugaucgccgauggugcuucgacggggaaagaaacaaucagguccucgaggaaaacauggauguugagaucuggaccaaagagggagaaaggaagaaauugcggccccgcuggcuggacgcuagaacauauucugacccucuagcacugagggaguuuaaggaguucgccgcuggucggcgauccgugagcggcgaucucauucuugagauagggaaacugccgcagcauuuaacucagaaggcccaaaaugcauuggacaaccugguaaugcuccacaauucagaacagggaggcagagcguaccgccaugccauggaggagcugccagauaccaucgaaacacuuaugcugcucgcuuugauugccgugcugaccgguggggucacuuuauuuuuccuaaguggcaggggacugggcaagacgagcaucgggcuccuuugugugauggcauccucuguucuguuguggauggcuagcguggagccccacuggauugccgcauccaucauacuggaauuuuuccucaugguccugcuuaucccugagcccgaccggcagcguaccccacaggauaaccaacucgccuauguagugauuggacuguuguuuaugauccugacaguugcugcgaaugagauggguuuacuagaaacuaccaaaaaggaccugggcauugggcacguggccgucgagaaccaucaccaugcagcuaugcucgauguggaccuucacccugccucagccuggacacuguacgcagucgcuaccacuaucauaacacccaugaugagacauacgauugaaaacaccacugccaauaucucuuugacagcgauugcuaaccaggccgcaauccugaugggacucgauaaaggcuggccaauaaguaagauggacaucggugugccucugcuugccuuagggugcuacucgcagguuaauccgcugacccucaccgcugcaguguugaugcugguagcccacuaugcgauuaucggccccggacuacaagcuaaagccacaagggaggcacagaagcgcacugccgcuggcauuaugaagaacccaacgguggaugggaucgucgccauagaccuggauccuguuguguacgacgcaaaauucgaaaagcagcucggacagauuaugcuucugaucuuguguaccagccaaauccugcucaugcggacaacuugggcucugugcgaguccauuaccuuagccacaggcccccuuaccacucugugggaggguucuccagggaaauuuuggaauacgacaaucgcggucucaauggccaacauauuccgaggaagcuaucucgcaggcgcuggucuagccuucucccugaugaagaguuugggcgggggaagaaggggcaccggggcacagggagaaacucugggcgagaaauggaagcgccagcucaaucagcuuucuaagagcgaauuuaacaccuacaaacggucagguauuauggagguggacagauccgaagcuaaggaggggcugaaacguggagagacaacuaagcacgccguaaguaggggcaccgccaaauugcggugguucguggaacgcaaucugguuaagccugaggguaaggugaucgaucucggcugugggcgaggaggcuggagcuauuacugcgcggggcuaaagaaggucacagaagugaaaggauauacgaagggcggucccgggcaugaggaaccgauuccaauggcuaccuacggauggaaccuggucaaacuucacucuggcaaggacguguuuuucaucccucccgagaaaugugauacucugcuaugcgacauaggcgaguccucaccaaaucccacaaucgaagaggggagaacccucaggguucugaagaugguagaaccuugguugcggggaaaccaauuuuguauuaaggugcugaauccguacaugcccagcgucguggagacucucgagcagaugcagcgcaaacaugguggcaugcuuguuagaaacccacugucgagaaauucuacacacgaaauguauugggugaguugcgggaccggaaacaucgucuccgcagugaauaugacgagccgaauguuacugaaccgguucaccauggcccaccguaagccuacauacgagagagauguagacuugggcgcugguacucgccauguggccguugaacccgaggucgcaaaccucgauauuaucgggcagaggauugaaaauaucaaacacgagcauaagucaaccuggcacuaugacgaggauaacccuuacaaaacaugggccuaucauggauccuacgaagugaagccaucuggcagcgcuaguuccauggugaauggcgucguuaagcugcuaacuaaacccugggacgugauaccuaugguaacccaaauugcgaugacagauaccacuccauuugggcagcagcggguguucaaggagaaagucgacacgagaacacccaaggccaaacgcggaaccacucaaaucauggaagugaccgcaagguggcuuugggguuuucugagccgaaacaagaagccgcggaucuguacaagagaggaguucacgaggaaaguucgcucuaaugcugccauuggcgcaguguuugucgacgagaaccaguggaacucagccaaggaggcuguggaagaugagcguuucugggaccucguacaccgggaaagagagcugcacaaacaggggaagugcgcgaccugcguuuauaacaugaugggaaaaagggaaaagaaguugggcgaguuugguaaagccaaggggagucgcgcaauaugguacauguggcugggagcccgauuccucgaguucgaagcucuuggcuuuaugaaugaggaucauugguucucccgggaaaacagccugucuggcguggagggggagggauuacacaaacuggguuacaucuugagagacauuucgaagaucccuggcgggaauauguaugccgaugacacugcaggaugggauacaaggauuaccgaagacgaucuccagaacgaggcuaaaaucacugacauaauggaaccagagcaugcccugcuagcuaaggccaucuuuaaacuuacauaccaaaauaaggucgugcgcgugcagagacccgcaaagaacggcaccgucauggauguuauuucacggagggaccagcgugguagcggacaggugggaacauauggccugaauacuuucaccaacauggaagcgcaacucauccgacagauggaguccgagggcauuuuuaguccuucugaacuggagacgccaaacuuggccgaacgcguauuagauuggcuggagaaauacgggguggaaagacucaagcggauggcuaucagcggagacgacugugucgugaaacccauagaugacagguucgccaccgcacuuacagcucugaaugauauggguaagguucgcaaagacauuccgcagugggagccuuccaagggcuggaacgauuggcagcaagugcccuuuugcucacaccacuuccaucagcuaaucaugaaggacgggagagagaucgucgugccaugucggaaucaggaugaacugguaggaagggcccgaguuagucagggcgcagguuggucucuccgugagacugccugcuuggggaaaagcuaugcgcaaauguggcagcugauguacuuucacagacgcgaccuucggcuggcugccaacgcaauuuguuccgccgugccugucgauugggugcccaccucaaggacaacuuggagcauacaugcucaccaucaguggaugaccacggaagacaugcucucuguuuggaauagaguguggaucgaggaaaacccauggauggaggauaagacacacauuuccaguugggaggacguccccuauuuaggaaaacgcgaagaccaauggugcggcagccugaucggcuugaccgcccgggcaacuugggcuacaaauauucagguggccaucaaccagguaaggcgacugauagggaaugagaacuaccucgauuacaugaccucgaugaagagauucaaaaaugaauccgacccugagggagcgcuuugguga

SEQ ID NO: 14172 - RNA, 9879 nt, Artificial Sequence
  derived and/or modified CDS sequence (opt3) from DENV-1__KC762642__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuagacaucgaacuccugaagacagaggugaccaacccugccgugcuuaggaaacugugcauugaagcuaagaucucuaauacgaccacagauagccgguguccaacucaaggagaggccaccuuggucgaagagcaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuacacaagagaccuggaaucggcaggacuugcucguaacauucaaaacugcucacgccaagaagcaggaaguugugguccuggguagccaagagggggcuaugcacaccgccuuaacgggcgcaaccgaaauccagacaaguggaacuaccacaauuuuugccggccaucugaaaugccgucuaaagauggauaaacucacucugaaggggaugucuuaugugauguguaccggauccuucaaacuugagaaggaagucgcugagacgcagcacgguacaguguugguucagauaaaguacgagggcaccgacgcgccuugcaaaaucccauucagcacucaagaugaaaagggggugacacagaacggacgccugauuaccgcaaaucccaucguaacugacaaagagaagccugucaacauagaagccgagccacccuuuggcgagucguauauugugaucggugcuggggaaaaagcccucaagcugucuugguucaagaaaggcuccucaaucggaaagauguuugaggcaaccgccagaggcgcuaggcggauggccauucuuggggauacagcaugggacuucggaaguaucgguggcguuuuuacgagcguggggaaacugguccaucagauuuucggaaccgcguacggcguguuguuuuccgguguaucuuggacuaugaagauagggaucggcgugcuccugacaugguuaggacugaauagccgaucaaccagucuauccaugacauguauugcuguuggccucgucacucuguaccuuggggugauggugcaggccgauagcggaugcgucaucaacuggaaaggccgcgaauugaagugugguucugggaucuucguuaccaaugaggugcacacguggacagaacaauauaaguuucaggcagacucaccgaaaagacugagugccgcuauuggaaaggccugggaggagggcgugugcgguauaaggagcgcaacccggcucgaaaacaucauguggaaacagauuuccaacgagcugaaucauaucuuacuggaaaacgacaugaaguucacuguagucgugggcgauguugcugggauucuugcccagggaaaaaagaugauccgcccucaacccauggagcacaaauacucuuggaagucguggggcaaggcgaaaauaaucggggccgacgugcagaauaccacauuuauuaucgauggaccaaacacuccugaaugucccgacgaucagagagcuuggaauauuugggaggucgaggacuauggcuucgguaucuuuaccacaaacauaugguugaagcucagggauagcuacacgcaggugugcgaccaccgucugauguccgcagccauuaaagauucaaaggcuguucaugccgacaugggguauuggaucgaaagugagaaaaaugaaaccuggaagcuagcacgggcgucuuucauugaggugaagacuuguaucuggccaaaaagccacacacugugguccaacggaguacucgaaucagagaugauaauccccaagauuuacggcgguccuaucagccaacauaauuaucgaccaggcuacuucacccagacugccgggccguggcaccugggaaaacuugaguuggauuuugaccugugcgaaggcacaaccgucgugguggaugagcacugcgggaacagaggacccucuuuaaggacgacuaccgucacaggcaagauuauccaugaaugguguugccgcuccuguacccucccuccacugcgguucagaggugaggacgggugcugguacggaauggagauaaggcccguuaaagaaaaggaggaaaaucuugugaagaguaugguaagcgcuggcucuggugagguggacuccuuuucacugggcuugcucuguauuaguaucaugaucgaagaggucaugcgcagccgauggucgcggaaaaugcugauuacugggacacuagccguguucuuucugcucaucaugggacagguuaccuggaacgaucugacacgucuuugcauuauggugggcgcaaaugcuuccgacagaauggggaugggaacuaccuauuuggcccugauggcaacguucaagaugaggccuauguuugccgucggcuuacucuuccgccggcugacaucuagagaggugcuucugcuaaccauaggucucagccugguugcuucaguggaauugccaaacagucuggaggaauuaggggauggacucgcgaugggcaucaugauucugaaacuucugacugacuuucaaucccaccaguugugggccacccuccugucucuaacauucaucaagacuaccuuuagccugcauuacgcauggaaaacgauggcuaugguccuuuccauuguaucacucuucccccuguguuugagcacaaccagucagaagacuacauggcugccgguguuacucggcucucuggggugcaagccucuuaccauguuucugaucgccgagaauaaaauauggggaaggaaguccuggccauugaacgaagguaucauggccguuggcauugugagcauccuccugucgucacuacugaaaaacgaugucccccuugcugggccucucauugcaggaggcaugcugaucgccuguuaugugauaucugguaguuccgcggacuugagcuuagagaaggcugccgagguaucuugggaagaggaagcagagcacagcggggccucccauaauauucugguggaaguccaggaugacggaacuaugaaaaucaaggaugaggagcgagacgauacacucaccauccugcuuaaagcuacgcuguuggcaguuucaggcguguacccccuaaguauuccagccacucuguucgugugguauuucuggcaaaagaagaaacagcgcagcggcguccucugggacaccccuucucccccagaaguggagcgggcgguucuggaugacgggauauacagaaucaugcagaggggacuuuuaggucguucccagguaggcgugggggucuuucaagaaaacguguuccacacaauguggcacguuacccgcggagcugugcugauguaucagggcaagcggcucgagccgucaugggccagugucaaaaaggacuugauuagcuacggugggggauggagacugcagggcuccuggaauacaggcgaggaagugcagguaaucgcagucgagccugggaaaaaccccaagaaugugcaaacugccccaggaaccuuuaagacgcccgaaggugagguuggcgcuauugcccucgauuucaaaccugggacaucuggaucgccaaucgugaacagggaaggcaagauagucggucuguacgggaauggagugguuacuaccagcggcacauaugugucagcaaucgcucaggccaaagcgucccaggagggcccccuuccugagauugaagacgaggucuuucgaaagcggaaccugaccaucauggauuugcauccggggaguggaaaaacucgcagauaccuaccagccauugugagggaagcaaucaagcggaagcugcgaacccucauauuagcucccacaagaguaguggccucugagauggcugaagcacugaaagguaugccuauucgcuaucaaacgacugccguuaagagcgagcacaccggcagggagaucgucgaccuuaugugccaugccacauucaccaugcgucugcucuccccagugcgggugcccaauuacaacaugaucauuauggaugaagcucacuuuacugacccuucaucuaucgcggcaagaggguauauaagcacaagggucggaaugggcgaggccgcugccauuuucaugaccgcaacgccgcccgguaguguagaagccuuuccacaguccaaugcugugauccaggaugaggaacgcgacauuccugagcgaagcuggaacucuggguacgaguggaucacugauuuccccggaaaaacaguuugguuugugccaucaauaaaguccggcaaugacauugcgaacuguuugagaaaaaauggcaagcgggucauccagcugaguaggaagaccuucgauaccgaauaucaaaaaacuaagaacaacgacugggacuacgugguuacaaccgauaucagcgagaugggggccaauuuccgcgcagaccgugugauugauccuagacggugccucaaacccgucauccugaaggacggaccagaaagggugauucuugcugguccgaugccuguaacaguggccucggcagcccagcgccgaggcagaauagggcggaaccauaauaaagagggagaucaguacaucuauaugggccagccccuaaacaaugacgaggaucacgcucacuggacugaagccaagaugcuguuggacaacauuaauacgccagaggguaucauccccgcguuauuugaaccugagagggaaaagucugcagccauugauggggaguaccgccugagaggcgaggcuaggaaaaccuucguugaacucaugcggcguggagaccugccagucuggcuuuccuauaagguggccagcgagggcuuucaauacucagaucgccgauggugcuucgacggggaaagaaacaaucaggugcuggaggaaaacauggaugucgagauauggacaaaagagggagaaaggaagaaacuccggccccgcugguuggacgcuagaacuuauagugacccucuggcacuaagggaguuuaaggaauucgccgcuggucggcgaucuguuuccggcgaucugauccucgagauugggaaacuuccgcagcaucugacccagagagcccaaaaugcauuagacaacuuggugaugcugcacaauagcgaacagggaggccgcgcguacaggcaugccauggaggagcucccagauacaaucgaaacccugaugcuucuggcucucauugccguauugacugguggggugacgcuguuuuucuuaucaggccggggacuaggcaagaccaguaucgggcugcucugugucauggcaagcuccgugcuucuguggauggcuucuguugagccccacuggauagccgcaagcaucauuuuggaauuuuuccugauggugcuccugaucccugagcccgaccgucagagaacaccacaggauaaccaacuugccuaugucguaauuggacuccuguuuaugaucuugacuguggcugcgaaugagaugggucuguuagaaaccacaaagaaagaccuaggcauagggcacguugccguggagaaccaucaccaugcagcuaugcuggaugucgaccuccacccugccuccgccuggacccuuuacgcaguggcuacuacaauuaucacgcccaugaugaggcauaccauugaaaacacuacagccaauaucucacugaccgcgauagcuaaccaggccgcaaucuugaugggacuggauaagggcuggccaauuucuaaaauggacaucggugucccucuccuggcccuugggugcuacagucaggugaauccguuaacccugacagcugcaguucucauguugguggcccacuaugcgauuaucggccccggacugcaagcuaaggccacucgcgaggcacagaaacggacggccgcuggcauaaugaagaacccaaccguagaugggauuguggccaucgaccuagauccugucguuuacgacgcaaaguucgaaaaacagcugggacagaucaugcuccuuauucuguguacaucgcaaaucuugcugaugcgaacuaccugggcucucugcgagagcauaacacuggccaccggccccuuaacuacgcuuugggaggguuccccagggaaguuuuggaauacaaccauugcggugucuauggccaacaucuucagaggaucauaucuggcaggcgcuggucucgccuucagccuaaugaaaucccugggcgggggaaggcgcggcacuggggcacagggagaaaccuugggcgagaaguggaaacggcagcugaaucagcucaguaagucugaauuuaacacauacaagagaagcgguauuauggaggucgaccguucagaagcuaaagaggggcuuaagaggggagagacuaccaaacacgccgugucccggggcacagccaagcugcgcugguucguagaacgaaauuuggugaaaccugaggguaagguuaucgaucugggcugugggagaggaggcuggaguuauuacugcgcggggcucaagaaagugacggaagucaagggauauaccaaaggcggucccgggcaugaggaaccgauaccaauggcuacuuacggauggaacuuagugaagcugcacagcggcaaagacgucuuuuucaucccucccgagaagugugauacacuucugugcgacauuggcgagucuuccccaaaucccaccaucgaagaggggaggacucuacgggugcucaaaaugguugaaccuuggcugcgcggaaaccaauuuuguauuaagaucuugaauccguacaugcccucaguaguggagacacuggagcagaugcagagaaagcaugguggcaugcucgucaggaacccacuuagccgaaauucgacccacgaaauguauugggugucuugcgggacgggaaacauuguuagugcagugaauaugaccucccggaugcuguuaaaccguuucacaauggcccacagaaaaccuacuuacgagcgcgaugucgaccugggcgcugguaccaggcauguggccguagaacccgagguggcaaacuuggauaucauagggcagcggauugaaaauaucaaguaugagcacaaaagcacauggcauuacgacgaggauaacccuuauaagacuugggccuaccacggaucauaugaaguuaaaccauccggcucugcuagcaguauggucaauggcguggugaagcuccugaccaagcccugggacgucaucccuaugguuacacaaauugcgaugaccgauacuacgccauuugggcagcagagaguguucaaagagaagguagacacacgcacccccaaagccaagaggggaacugcacaaauaauggaagugaccgcucgauggcuaugggguuuucuuucccggaacaaaaagccgagaaucuguacaagggaggaauucacgcgcaagguccguagcaaugccgcaauuggcgccguguuuguugacgagaaccaguggaauucugcuaaagaggccguggaagaugagcgguucugggaccugguccauagagaaagggagcuccacaagcaggggaaaugcgcgaccugcguguacaacaugaugggaaagcgcgaaaaaaagcugggcgaguuugguaaggcaaaagggucacgagccaucugguacaugugguugggagcucgguuccuggaguucgaagcccucggcuuuaugaaugaggaucacugguucaguagagaaaacucccuuagcggcguagagggggagggacugcauaaguuagguuauauucugagggacaucucuaaaauaccuggcgggaauauguacgcagaugacacugcuggaugggauacacgcaucaccgaagacgauuugcagaacgaggccaagauuacugacaucauggaaccagagcacgcucuccuggccaaagcaguuuuuaagcuaacauaucaaaauaaaguggucagagugcagcggcccgcgaagaacggcaccgugauggaugucauuucgaggcgugaccagcgagguucagggcagguuggaacauacggccuuaauacuuucaccaacauggaagcccaacugauccgccagauggagagcgagggcauauuuuccccuagugaacucgagacgccaaaccuggcugaaagaguguuguauugguuagagaaguacgggguagaacggcugaaaaggauggccauuucuggagaugacuguguggucaagcccaucgacgaucgcuucgcaaccgcucucacagcccuuaaugacauggguaaagugagaaaggauaucccgcagugggagccuagcaaaggcuggaacgacuggcagcaaguucccuuuugcucccaucacuuccaccagcugauuaugaaggaugggcgggagauaguggucccauguaggaaucaggacgaacuagugggacgagcacguguaucacagggcgccgguuggagucugagagagacugcgugccucgggaagucuuaugcucaaauguggcaguugauguacuuucaucgccgggaucugaggcuugccgcaaacgccaucuguagcgcuguuccuguggacuggguccccaccuccagaacaacuuggucaauucacgcccaucaccaguggaugaccacggaagauaugcugagcguguggaaucgcguuuggaucgaggaaaacccauggauggaggacaaaacacauauuucuuccugggaggaugugcccuaccucggaaagcgggaagaccaauggugcggcaguuuaaucggccugaccgcaagggcuacuugggccacaaauauacaggucgcgaucaaccaggugcgaagauugauugggaaugagaacuaucuggacuacaugaccagcaugaaacgguucaagaaugaaucggauccugagggagcucucugguga

SEQ ID NO: 14173 - RNA, 9879 nt, Artificial Sequence
  derived and/or modified CDS sequence (opt3) from DENV-1__JQ915077__SS-prME
agcgugaccaugcugcucaugcuucugcccaccgucuugacuuuccacuuaacgaccagaggcggggagccucauaugaucguuuccaagcaggaaaggggaaaaucucuguuauuuaagaccucagcaggggugaauaugugcacucucauugcuauggaccugggcgagcuuugugaugacaccaugacauacaaaugcccgcggauaaccgaaacugagccggaugacguagauuguuggugcaaugcaacagaaaccugggugacguaugggacuuguagucaaaccggagagcaccgccgagacaagcguagcgucgcacuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguugaggguuugagcggcgccaccuggguugacgugguccuggagcacgggaguugugugacuacaauggcuaaggauaaacccaccuuggacaucgaacuccugaagacggaggugaccaauccugccguccuuaggaaacugugcauugaagcgaagaucuccaacacaacuaccgauucucgguguccaacacaaggagaggcaacuuugguugaggaacaggacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaucuggcgcuuccaccucacaagagacauggaaccggcaggacuugcucguuacuuucaaaaccgcccacgcgaagaagcaggaaguggucgugcuggguagccaagagggggccaugcacacggcauuaaccggcgcuacagaaauucagacaaguggaaccacaacuauauuugccggccaucugaaaugccgucuaaagauggauaaacucacccugaaggggaucucuuaugucauguguacgggauccuucaaacuugagaaggaaguggcugagacacagcacgguaccguuuuggugcagguaaaguacgagggcacugacgccccuugcaaaauuccauucagcucgcaagaugaaaagggggucacacagaauggacgccuggugaccgcaaaccccaucguuacugacaaagagaagccugugaauauagaagccgagccacccuuuggcgagucuuauauugucgugggugcuggggaaaaagcgcucaagcuguccugguucaagaaaggcucaaguaucggaaagauguuugaggcaaccgccagaggcgcuaggcggauggccauccuuggggauacagcaugggacuucggaagcauugguggcguauuuacguccguggggaaacugguucaucagaucuucggaaccgccuacggcgucuuguuuucuggugugagcuggacuaugaagauugggauaggcauccuccugacaugguuaggacugaacucacgaaguaccucccuaagcaugacauguauugcugugggcauggucacucucuaccuggggguuauggugcaggccgauucuggaugcgugaucaauuggaaaggccgcgaacuuaagugugguucagggaucuucguaaccaacgagguccacacguggacagaacaauauaaguuucaggcagacaguccgaaaagauugagcgcggcuauuggaaaggccugggaggagggcgugugcgguauaagguccgcaacccggcuggaaaacaucauguggaaacagauuucuaaugagcucaaccauauccuguuagaaaaugacaugaaguucacuguuguggucggcgaugugucggggauucuggcccagggcaagaaaaccauccgcccucaacccauggagcacaaauacagcuggaaguccuggggcaaggcuaaaauaaucggggccgacguucagaacacaacuuuuauuaucgauggaccaaauaccccugaaugucccgacgaucagagagcauggaacauuugggagguggaggacuauggcuucgguaucuuuacaacgaauauauggcuuaaguugagggauucauacacccagguaugcgaccaccgucucaugagugcugccauuaaagauucuaaggcgguccaugccgacaugggguauuggaucgaaagcgagaaaaacgaaacuuggaagcuggcucgggcauccuucauugaggugaagacauguguguggccaaaaucacacacccuauggagcaauggaguccuggaaucugagaugaucauacccaagaucuacggcgguccuauuucccaacauaacuaucgaccaggcuacuucacucagacagccgggccguggcaccucggaaaacuggagcuugauuuugacuugugcgaaggcaccacgguugugguagaugagcacugcgggaauagaggacccagucugaggacuaccacagugaccggcaagaucauucaugaaugguguugccgcagcuguacuuuaccuccacuccgguucaaaggugaggacgggugcugguacggaauggagaucagacccgucaaggaaaaggaggaaaaccuggugaaaucuaugguuuccgcuggcucaggugagguggacaguuuuagccuuggccuguuguguauaucgauuaugaucgaagaggucaugaggucccgcuggucucgaaagaugcucaugacagggacccuggugguuuuccuacugcucacacugggacagcuuacuuggaaugauuugauccggcugugcauuauggugggcgccaacgcaagcgacaauauggggaugggaaccacguauuuagcgcucauggccacauuucguaugagaccuauguucgcugucggccugcuuuuuaggcgccugaccucacgggagguacuacuccugacuguggguuugagucugguugccuccguggaauuaccaaacucucucgaugagcugggggacggacuugcaaugggcaucaugauucugaaauugcucaccgauuuccaaagccaccagcugugggcuauacuacugucccuuacauuugucaagacuacccucucacugcauuacgccuggaaaacgauggcaaugaucuugagcauugugagucuguuaccccucugucugucuacaaccucccagaagacuacauggcuuccgguacuguugggcagccucgggugcaagccucugaccauguuccuaaucacugaaaacaaaauuuggggaagaaagucguggccacugaaugaggguaucauggccgugggcauagucucaauccuucucucuagucuguugaaaaacgacguucccuuagcugggccucugauugcgggaggcaugcucaucgccuguuaugugauuuccgguagcucugcagaucugagccuugaaaaggcugccaaaguguccugggaggaggaagccgagcacucaggggcuagucauaauauccuggucgaaauacaggacgauggaacaaugaagauuaaagacgaggaaagggaugacaccaucacgaucuugcuaaaggcaacucugcucgccauuagcggcguguaccccaugucuauaccagcgacccuguuuguuuggcacuucuggcaaaagaaaaagcagcgauccggcguacuuugggauacaccuucacccccagagguggagaaagcugucuuagacgacgggaucuaucgcauucugcagcggggacucuuggguagaagucaggugggcguugggguguuucaagaaggagucuuccacaccauguggcaugugacaaggggcgccguacugauguaccaggguaagcgucucgagccgagcugggcauccgucaaaaaggaucugaucucuuaugggggaggcuggcgcuuccagggcucguggaacacuggggaagaggugcagguuauugccguggagccuggaaagaaucccaaaaacguccaaaccgcuccagguacguuuaagacaagcgaaggcgaggugggggcaaucgcccuugacuucaaacccggaacuucaggcuccccuauaguuaaucgggaagguaagaucguggggcuguacggaaacggcgucgugaccacaaguggcaccuacguaucugcgauugcucaggccaaagcaagccaggaggggccauugcccgaaaucgaggaugagguguuuagaaagaggaaucuaacuauuauggaccugcacccuggauccgguaagacccgacgguaucucccggccaucguucgcgaagcuauaaaaagaaaguuaaggacacugguccuugccccaacgcgggugguggcaucagagauggcugaagcccugaaaggcaugcccauucgauaccaaacuaccgcggucaagucugagcauacagggaaagaaaucguagaucucaugugccacgccaccuucacuaugagauugcugagcccugugcgcguuccaaacuauaauaugaucauuauggacgaggcacauuuuacagaucccgcuaguaucgccgcuaggggauacauauccacccgugugggcaugggugaggcagccgccauuuucaugacggcuacuccuccggggagcgucgaagcguuuccccagucuaacgcagugauccaggacgaggaaaaggauauuccagagcggucauggaacuccggauaugacuggaucacagauuucccuggcaagaccguuugguuugugcccaguauaaaaagcggcaacgacauugccaauugucucagaaagaacgggaaaagggucauccagcugucgcgcaagaccuucgacacugaauaccaaaagacuaagaacaaugauugggacuaugugguaaccacagauaucucugagaugggagcuaacuuucgagccgacagagugauugauccacggaggugccuuaagccuguuauccuaaaagacggucccgagcgcgucauucuggcaggcccaaugccggugacuguggccuccgcugcgcagcguagagggcggauaggaaggaaucagaacaaggaaggcgaucaguacaucuacaugggucaaccuuugaauaacgacgaggaucacgcccacuggacggaagcaaaaauguuacuggacaauauuaacacccccgaggggaucaucccagcucucuucgagcccgaacgcgagaaaagcgccgcaauugauggcgaauaucgacugagaggagaagcccggaaaacauucgucgaacuuaugaggcgcggcgaccugccuguuuggcucucauacaagguggcuagugagggguuucaguauucugauagaagguggugcuucgacggagagcggaauaaccagguauuggaagagaauauggacguggaaauauggacuaaagagggugaacguaagaagcugcgcccacgauggcuagaugccagaaccuacuccgacccccuggcgcucagggaguuuaaagaguucgcagccggccggcgcagcgucucaggggaucuuauccuggaaauuggaaaguuaccucagcauuugacacaaagagcucagaacgcccuggacaaucucgugaugcugcacaacagugagcagggcgguaaggcuuauaggcaugcaauggaggaacuuccggauaccaucgaaacuauuaugcugcucgccuugaucgcuguucugacggguggagugaccuuauuuuuccuaagcggacggggccuggggaagacauccauaggacuccuuugugucacuucuagcuccguacuguuguggauggccucaguggagccacacuggaucgcagcgucuauuauccuggaguuuuuccucaugguucugcuuauucccgaaccugaccgacagagaacaccccaagauaaucagcucgccuacguggucaucggucuguuguuuaugauacugacaguggcugccaacgagaugggcuuacuagaaaccacuaaaaaggaccuggggauuggacacgcagcugccgagaaccaucaccaugcagccaugcucgaugucgaccuucacccagcuagugcguggacacuguaugccguggcaacgaccaucauuacuccuaugaugcgccauacaaucgagaauaccaccgcuaacauaucguugacagccaucgccaaucaggcagcuauucugaugggccucgauaaggguuggcccaucagcaaaauggacauugggguuccacugcuugccuuaggcugcuacucccaagugaacccucugacucucacggcggcuguauugaugcugguggcccacuacgcaaucauaggaccgggccuacaggccaaggcuaccagggaagcacagaaacggacagccgcggggauuaugaagaaucccacugucgauggaaucguugcuaucgaccuggacccaguggucuaugaugccaaauucgagaagcagcucggccaaauuaugcuucugaucuuguguaccucucagauacugcucaugcguacaaccugggcacugugcgaaucaauuacuuuagccacggguccucuuacaacccugugggaggggagccccggaaaguuuuggaacacuaccaucgcuguguccauggccaauauuuucagaggcaguuaccucgccggugcuggccuagccuuuucucugaugaaaagccuagggggaggcaggcgcgggacaggagcgcagggcgaaacucugggugagaaguggaaacggcagcucaaccaacuuucaaaguccgaguucaauaccuauaaacgaagugggaucauagaaguagacagaagcgaggccaaggaaggacugaagaggggcgagacaacgaaacacgcagugucucgcgguaccgcuaaguugcggugguucguugaaagaaaccuggugaaaccagagggcaaggucaucgaucucggguguggacguggcgggugguccuacuauugcgccggacugaaaaaggugacugaggucaaaggcuacacaaagggugggccuggacaugaggagcccauuccgauggcaaccuauggcuggaaucuagugaaacuucacucaggcaaagacguauuuuucaucccaccugaaaagugugauacucugcuaugcgacauuggggagagcucgcccaacccaacaaucgaagagggaaggacccuccggguacugaaaaugguggagcccugguugcgcgguaaucaguuuuguauuaagauccugaacccuuacaugccgucugucguggaaacgcucgagcagaugcagcgaaaacauggcgggaugcuuguuagaaauccccugaguaggaacuccacccacgaaauguacugggugagcugcggaacaggcaauauagucucagcugugaacaugacuucccggauguuacugaaccgcuucaccauggcccacagaaagccaacauaugagagggauguagacuugggugccgggacucgacauguggcgguugagccugaagucgcuaaucucgauauuaucggacaacggaucgagaacauuaagaaugaacacaaaucuaccuggcauuacgacgaggauaaccccuauaagacaugggcauaccacggcagcuaugaagugaaaccuaguggcuccgccagcucuauggugaauggggucguucgucugcuaaccaagccaugggacgugauacccaugguaacucagaucgcuaugacggacacaaccccuuuuggacagcaaagaguguucaaagagaaggucgauacucgcaccccaaaggccaaaagggguacagcacagauuauggaggugacggccaaguggcuuuggggcuuucugucacggaacaaaaagcccagaaucuguacccgcgaagaguucacuaggaaaguucgaaguaaugcugcgauuggggccguguuugucgacgaaaaccaguggaacuccgcaaaggaggcuguggaagaugagcgguucugggaccucguaagaagggagcgcgaacugcauaagcagggaaaaugcgccacaugcguuuacaacaugaugggcaagcgugagaaaaaguugggugaauuugggaaagcaaagggaagccgggccaucugguauauguggcugggcgcuagauuccucgaguuugaagcccuuggcuucaugaaugaggaucacugguucucuagggagaacucgcugucagggguggaaggagaggguuuacacaaacugggcuacauauugcgcgacaucagcaagauuccagggggaaauauguacgcggaugacaccgcaggcugggauacucgaaucacagaagacgaucuccaaaacgaggccaagauuaccgacaucauggagccugaacaugcucugcuagccacauccauauuuaaacuuacuuaucagaauaaggucgugcgggugcagagaccagccaaaaaugguaccgucauggauguuauuaguaggcgcgaccagagagggucuggacaagugggcacguacggccugaacaccuucacaaauauggaggcucagcucauccggcagauggaaagcgaggggaucuuuucccccucagaacuggagacuccuaacuuggccggaaggguauuagacuggcuggagaagcacgguaccgaacgucuccgacgcauggcuauuaguggcgaugacuguguggucaaaccaauagaugacagauucgccacagcacuuacugcgcugaaugauauggggaaggugcggaaggacaucccccagugggagccgucuaaaggauggaacgauuggcaacagguuccuuuuugcagccaucacuuccaccagcuaauuaugaaggacggcagggaaaucgugguccccugucgcaaucaggaugagcugguggguagagcccggguaucccaaggggcuggauggucacucagggaaaccgccugcuugggcaaaagcuaugcacagauguggcagcugauguacuuucaucgacgugaccuuagacuggcugccaacgcaauuuguucugccguuccaguggauugggucccuacgucccgcacaaccuggaguauccacgcgcaucaccaauggaugacuacagaggacaugcucagcguguggaaucggguuuggauagaggaaaaccccuggauggaggacaagacccaugugucguccugggaagaugucccauauuuaggcaaaagggaggaccaguggugcgggucucugaucggauugacugcuagagccaccugggcaacaaauauucagguggccaucaaccagguacgccggcugauugguaaugaaaacuaccucgauuauaugacgucaaugaagagguucaagaaugagagcgaccccgagggcgcucuuugguga

SEQ ID NO: 14174 - RNA, 9879 nt, Artificial Sequence
  derived and/or modified CDS sequence (opt3) from DENV-1__JQ915079__SS-prME
uccgugaccaugcugcucaugcuucugcccaccgucuugacuuuccacuuaacgaccagaggcggggagccucauaugaucguuuccaagcaggaaaggggaaagucucuguuguuuaagacaucagcuggugugaauaugugcacucucauugcaauggaccugggcgagcuuugugaugacaccaugacauacaagugcccacggauaaccgaaacugagccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguugaggguuugagcggcgccaccuggguugacgugguccuggagcacgggaguugugugacuacaauggcuaaggauaaacccacccuagacaucgaacuccugaagacggaggugaccaauccugccguccuuaggaaacugugcauugaagcgaagaucuccaacacaacuaccgauucucgguguccaacacaaggagaggcaacuuugguugaagaacaggacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaaccggcgcuucuacaucccaagagacuuggaaccggcaggacuugcucguuaccuucaaaacggcccacgcgaagaagcaggaaguggucgugcuggguucacaagagggggccaugcacaccgcauuaacaggcgcuacugaaauucagaccagcggaacaacuaccauauuugccggccaucugaaaugccgucuaaagauggauaaacucacgcugaaggggaucaguuaugucauguguacaggaucuuucaaacuugagaaggaaguggcugagacccagcacgguacuguuuuggugcagguaaaguacgagggcacagacgccccuugcaaaauuccauucuccagccaagaugaaaagggggucacccagaauggacgccuggugacugcaaaccccaucguuaccgacaaagagagaccugugaauauagaagccgagccacccuuuggcgagucguauauugucgugggugcuggggaaaaggcgcucaaacugucuugguucaagaagggcuccucaaucggaaaaauguuugaggcaacagccaggggcgcucggcgaauggccauccuuggggauacggcaugggacuucggaaguauugguggcguauuuaccagcguggggaagcugguucaucagaucuucggaacugccuacggcgucuuguuuuccggugugucuuggacaaugaaaauugggauaggcauccuccugaccugguuaggacugaacagccgcucaacaagucuauccaugacuuguauugcugugggcauggucacccucuaccuggggguuauggugcaggccgauagcggaugcgugaucaauuggaagggcagagaacuuaaaugugguucugggaucuucguaacgaacgagguccacacauggaccgaacaauauaaguuucaggcagacucaccgaagagguugagugcggcuauuggaaaagccugggaggagggcgugugcgguauacggagcgcaacucgccuggaaaacaucauguggaagcagauuuccaaugagcucaaccauauccuguuagaaaaugacaugaaauucaccguuguggucggcgaugugucugggauucuggcccagggaaagaaaacaaucagaccucaacccauggagcacaaguacucguggaaaagcuggggcaaggcuaagauaaucggggccgacguucagaacacuaccuuuauuaucgauggaccaaauacaccugaaugucccgacgaucagagggcauggaacauuugggagguggaggacuauggcuucgguaucuuuacgaccaauauauggcuuaaauugcgugauuccuacacucagguaugcgaccaccggcucaugucagcugccauuaaggauaguaaagcgguccaugccgacaugggguauuggaucgaaucugagaagaacgaaacauggaaacuggcucgagccagcuucauugaggugaagaccuguguguggccaaagucccacacucuauggucaaauggaguccuggaaagcgagaugguuauccccaaaauauacggcgguccuaucucucaacauaacuauagaccaggcuacuucacacagaccgcagggccguggcaccucggaaagcuggagcuugauuuugacuugugcgaaggcacgacugugguaguggaugagcacugcgggaauaggggacccucccugcgcaccacaaccgucacuggcaaaauuauccaugaaugguguugccggaguuguacauuaccuccacucagauucaagggugaggacgggugcugguacggaauggagauuaggcccgugaaagaaaaggaggaaaaccugguuaagagcauggugucugcuggcuccggugaggucgacucauuuagucuuggccuguuguguaucagcauaaugauugaagaggugaugcgcucgcgauggucccggaaaaugcucaugaccgggacacugguuguguuccuacugcucacucugggacagcuuaccuggaaugauuugauccgucugugcaucauggucggcgccaacgcaucugacaauauggggaugggaacgacauauuuagcgcucauggccaccuuuagaaugaggccuauguucgcuguaggccugcuuuuucgccggcugacuagcagagaggugcuacuccugaccguugguuugucacugguggccagugucgaauuaccaaacucccucgaugagcugggggacggacuugcaaugggcauuaugauccugaaguugcucacagauuuccaaucucaccagcugugggcuacucuacugagccuuaccuuugugaaaacgacacucucccugcauuacgccuggaagaccauggcaaugauuuugucaauaguaagccuguuaccccucugucugaguacuacaucucagaaaaccacuuggcuuccggugcuguugggcucccucgggugcaagccucugacaauguuccuaaucaccgaaaacaagauuuggggaaggaaaagcuggccacugaaugaggguaucauggccgucggcauuguuucgauccuucucucaucucuguugaagaacgacgugcccuuagcugggccucugauagcgggaggcaugcucaucgccuguuaugugauuagugguuccagcgcagaucugucucuugaaaaagcugccaaggucagcugggaggaggaagccgagcacuccggggcuucacauaauauccugguggaaauucaggacgauggaacgaugaaaaucaaggacgaggaacgagaugacacuauaaccauuuugcuaaaagcaacacugcucgccaucaguggcguuuaccccaugagcaucccagcgacccuguuuguauggcacuucuggcaaaagaagaaacagcgcucuggcgugcuuugggauacaccuucacccccggaggucgagaaggcuguguuagacgacgggauuuaucggauacugcagagaggacucuuggguaggagccagguuggcgugggggucuuucaagaaggaguguuccacacuauguggcauguaacccguggcgccguccugauguaccaggguaaacgccucgagccgaguugggcaagcgugaagaaagaucugaucuccuaugggggaggcuggcgguuccagggcucuuggaacaugggggaagagguucaggugauugccgucgagccuggaaagaaucccaagaacgugcaaacggcuccagguacauuuaaaacuucggaaggcgagguuggggcaaucgcccuugacuucaagcccggaaccagcggcucaccuauugugaauagagaagguaaaaucgucgggcuguacggaaacggcgugguaacaaccuccggcacuuacgugagugcgauagcucaggccaaggcaucucaggaggggccauugcccgaaaucgaggaugagguuuuuaggaaacgaaaucuaaccauuauggaccugcacccuggaagcgguaagacacggcgcuaucucccggccaucgucagagaagcuauuaagaggaaauuacggacgcuggugcuugccccaacucgaguggucgcauccgagauggcugaagcccugaagggcaugcccaucagauaccaaaccacagcgguaaaaucagagcauaccgggaaggaaauaguggaucucaugugccacgccacuuucacaaugcgcuugcugucuccuguuagggugccaaacuauaauaugauuaucauggacgaggcacauuuuaccgaucccgcuagcaucgccgcucguggauacauuaguacgcgggucggcaugggugaggcagccgccaucuucaugacugcuacaccuccgggguccguggaagcguuuccccagagcaacgcaguuauacaggacgaggaaaaagauauuccagagagaucuuggaacucaggauaugacuggaucaccgauuucccuggcaagaccgugugguuuguccccuccauuaagaguggcaacgacaucgccaauugucucaggaaaaacgggaagcgcgugauacagcugagccgaaaaacuuucgacacagaauaccaaaagaccaaaaacaaugauugggacuauguagugacaacugauauuucggagaugggagcuaacuuuagagccgaccggguuaucgauccaaggcgcugccuuaagccugucauccuaaaggacggucccgagcgugugauucuggcaggcccaaugccggugacggucgccucugcugcgcagagacgggggaggaucggacgcaaucagaacaaagaaggcgaucaguacauuuacaugggucaaccuuugaauaacgacgaggaucacgcccacuggaccgaagcaaagauguuacuggacaauauaaacacacccgaggggaucauuccagcucucuucgagcccgaacgagagaaauccgccgcaaucgauggcgaauauagacugcggggagaggccaggaagacuuucguugaacuuaugcgcagaggcgaccugccuguguggcucagcuacaaaguagcuucagagggguuucaguauagugauaggcgguggugcuucgacggagagcguaauaaccagguguuggaagagaauauggacgucgaaaucuggaccaaggagggugaacgcaaaaagcugcgaccaagauggcuagaugccaggacauacucugacccccuggcgcuccgggaguuuaaggaguucgcagccggccgcagauccgugagcggggaucuuauucuggaaauaggaaaauuaccucagcauuugacccaaagggcucagaacgcccuggacaaucucguuaugcugcacaacucagagcagggcgguaaggcuuaucggcaugcaauggaggaacuuccggauacuaucgaaacgauuaugcugcucgccuugaucgcugugcugaccgggggcgucacauuauuuuuccuaaguggacgaggccuggggaaaacuagcauuggacuccuuuguguaaccuccucuagcgcccuguuguggauggcauccguggagccacacuggaucgcggccucaauaauccuggaguuuuuccucaugguucugcuuauucccgaaccugacagacagcgcacaccccaagauaaucagcucgcuuacguggucaucggucuguuguuuaugauucugaccguggccgcaaacgagaugggcuuacuagaaacuacaaagaaagaccuggggaucggacacacggcugccgagaaccaucaccaugcagccaugcucgaugucgaccuucacccagcuucugcguggacccuguaugccguggcaacuacaauaauuaccccuaugaugaggcauaccaucgagaauacaacugcuaacauuaguuugacggccaucgccaaucaggcagcuauacugaugggccucgauaaggguuggcccaucucgaagauggacauugggguuccacugcuugccuuaggcugcuacagccaagugaacccucugacccucacagcggcuguauugaugcugguggcccacuacgcaaucauuggaccgggccuacaggccaaagcuacucgggaagcacagaagcguaccgccgcggggaucaugaaaaaucccacagucgauggaauaguugcuauugaccuggacccaguggucuaugaugccaaguucgagaaacagcucggccaaaucaugcuucugaucuuguguaccucccagauucugcucaugagaacuacgugggcacugugcgaaucuaucacauuagccaccgguccucuuacuacccugugggaggggucacccggaaaguuuuggaacacaacuauagcugugagcauggccaauauuuucaggggcuccuaccucgccggugcuggccuagccuuuagucugaugaagucucuagggggaggccgccgggggaccggagcgcagggcgaaacacugggugagaaauggaagcgacagcucaaccaacuuagcaaaucacaguucaauacguauaagagauccgggaucauugagguagacaggagugaagccaaagagggacugaagcgcggcgaaaccacuaagcacgcagugagccgggguacagcuaaauugagaugguucguugagcguaaccuggugaagccagaaggcaaagucaucgaucucggguguggaaggggcggguggucuuacuauugcgccggauuaaagaaagugaccgaggucaagggcuacacuaaaggugggccuggacaugaggaacccauaccgauggcaacauauggcuggaaucuggugaaacuucacuccggcaaggacguauuuuucaucccaccugagaaaugugauacccugcuaugcgacauuggggaaucaagccccaacccaacgaucgaggaaggacggacccuccgcguacugaagaugguggagcccugguugcgagguaaucaguuuuguauuaaaauccugaacccuuacaugccgucggucguggagacacucgaacagaugcaaagaaagcauggcgggaugcuuguuaggaauccccugucucggaacaguacucacgagauguacuggguguccugcggaaccggcaauauugucagcgcugugaacaugacaucacgcauguuacugaacagauucacuauggcccacaggaaaccaaccuaugaacgagauguagacuugggugccgggacacggcauguggcgguugagccugaggucgcuaaucucgauaucauaggacagcguauugaaaacaucaagaaugagcacaaguccaccuggcauuacgacgaagauaaccccuauaaaacuugggcauaccacggcucuuaugaggugaagccuagcggcagugccuccagcauggugaauggggucguuagacugcuaacgaaaccaugggacgugauccccaugguaacacagauugcuaugaccgacacuaccccuuuuggacaacagcgcguguucaaggaaaaagucgauacaaggacgccaaaggccaagcgggguaccgcacagauaauggaggugacugccaaauggcuuuggggcuuucugucuagaaacaagaaaccccgcaucuguacaagggaggaguucacccgaaagguucggucaaaugcugcgauuggggccguguuugucgacgagaaccaguggaauagugcaaaagaagcuguggaggaugaaagauucugggaccucguaaggcgcgagcgugagcugcauaagcaaggaaagugcgccacuugcguuuacaacaugaugggcaaacgggaaaagaaauugggugaguuugggaaggcaaaaggauccagagccaucugguauauguggcugggcgcuagguuccucgaauuugaggcccuuggcuucaugaaugaagaucacugguucagccgcgagaacucucugucggggguggagggagaagguuuacacaagcugggcuacauuuugcgagacaucucaaaaauaccagggggaaauauguacgcggaugacacagcaggcugggauacccggaucacagaggaagaccuccagaacgaggccaagauuacugauaucauggagccugaacaugcucugcuagccaccagcauuuuuaaacuuacguaucagaauaaagucgugagagugcagaggccagcaaagaacgguaccgucauggacguuaucucccgcagagaucaacgggggaguggacaggugggcacauacggccugaacacuuucaccaauauggaggcucagcucauaaggcagauggaaucugaggggauuuuuagccccuccgaacuggagacaccuaacuuggccggacguguauuagacuggcuggagaaacacgguaucgaacgacuccgcagaauggcuaucucaggcgacgauuguguggucaagccaauugacgaucgguucgccacugcacuuaccgcgcugaaugacauggggaaagugaggaaggauauaccccaaugggagccgaguaagggauggaacgacuggcagcagguuccuuuuugcucucaucacuuccaccagcuaaucaugaaagauggccgcgaaauugugguccccuguagaaaucaagacgagcuggugggucgggccaggguaagccagggggcuggauggucccuccgagaaacggccugcuugggcaagucauaugcacagauguggcaacugauguacuuucaucguagagaucuucgccuggcugccaacgcaaucuguagcgccguuccaguggacugggucccuacaucucggaccacuugguccauucacgcgcaucaccaguggaugacaaccgaggauaugcucaguguguggaauaggguuuggaucgaggaaaaccccuggauggaggacaaaacucaugugagcucgugggaagacgucccauauuuaggcaagagagaggaucaguggugcgggucccugauaggauugaccgcucgcgccacaugggcaacgaauauccagguggccauuaaccaaguacggaggcugaucgguaaugaaaacuaccucgacuauaugaccucuaugaaacgauucaagaaugagucagaucccgagggcgcucuuugguga

SEQ ID NO: 14175 - RNA, 9879 nt, Artificial Sequence
  derived and/or modified CDS sequence (opt3) from DENV-1__JQ915080__SS-prME
uccgugaccaugcugcucaugcuucugcccaccgucuugacuuuccacuuaacgaccagaggcggggagccucauaugaucguuuccaagcaggaaaggggaaagucucuguuguuuaagacaucagcuggugugaauaugugcacucucauugcaauggaccugggcgagcuuugugaugacaccaugacauacaagugcccacggauaaccgaaacugagccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguugaggguuugagcggcgccaccuggguugacgugguccuggagcacgggaguugugugacuacaauggcuaaggauaaacccacccuagacaucgaacuccugaagacggaggugaccaauccugccguccuuaggaaacugugcauugaagcgaagaucuccaacacaacuaccgauucucgguguccaacacaaggagaggcaacuuugguugaagaacaggacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaaccggcgcuucuacaucccaagagacuuggaaccggcaggacuugcucguuaccuucaaaacggcccacgcgaagaagcaggaaguggucgugcuggguucacaagagggggccaugcacaccgcauuaacaggcgcuacugaaauucagaccagcggaacaacuaccauauuugccggccaucugaaaugccgucuaaagauggauaaacucacgcugaaggggaucaguuaugucauguguacaggaucuuucaaacuugagaaggaaguggcugagacccagcacgguacuguuuuggugcagguaaaguacgagggcacagacgccccuugcaaaauuccauucuccagccaagaugaaaagggggucacccagaauggacgccuggugacugcaaaccccaucguuaccgacaaagagagaccugugaauauagaagccgagccacccuuuggcgagucguauauugucgugggugcuggggaaaaggcgcucaaacugucuugguucaagaagggcuccucaaucggaaaaauguuugaggcaacagccaggggcgcucggcgaauggccauccuuggggauacggcaugggacuucggaaguauugguggcguauuuaccagcguggggaagcugguucaucagaucuucggaacugccuacggcgucuuguuuuccggugugucuuggacaaugaaaauugggauaggcauccuccugaccugguuaggacugaacagccgcucaacaagucuauccaugacuuguauugcugugggcauggucacccucuaccuggggguuauggugcaggccgauagcggaugcgugaucaauuggaagggcagagaacuuaaaugugguucugggaucuucguaacgaacgagguccacacauggaccgaacaauauaaguuucaggcagacucaccgaagagguugagugcggcuauuggaaaagccugggaggagggcgugugcgguauacggagcgcaacucgccuggaaaacaucauguggaagcagauuuccaaugagcucaaccauauccuguuagaaaaugacaugaaauucaccguuguggucggcgaugugucugggauucuggcccagggaaagaaaacaaucagaccucaacccauggagcacaaguacucguggaaaagcuggggcaaggcuaagauaaucggggccgacguucagaacacuaccuuuauuaucgauggaccaaauacaccugaaugucccgacgaucagagggcauggaacauuugggagguggaggacuauggcuucgguaucuuuacgaccaauauauggcuuaaauugcgugauuccuacacucagguaugcgaccaccggcucaugucagcugccauuaaggauaguaaagcgguccaugccgacaugggguauuggaucgaaucugagaagaacgaaacauggaaacuggcucgagccagcuucauugaggugaagaccuguguguggccaaagucccacacucuauggucaaauggaguccuggaaagcgagaugguuauccccaaaauauacggcgguccuaucucucaacauaacuauagaccaggcuacuucacacagaccgcagggccguggcaccucggaaagcuggagcuugauuuugacuugugcgaaggcacgacugugguaguggaugagcacugcgggaauaggggacccucccugcgcaccacaaccgucacuggcaaaauuauccaugaaugguguugccggaguuguacauuaccuccacucagauucaagggugaggacgggugcugguacggaauggagauuaggcccgugaaagaaaaggaggaaaaccugguuaagagcauggugucugcuggcuccggugaggucgacucauuuagucuuggccuguuguguaucagcauaaugauugaagaggugaugcgcucgcgauggucccggaaaaugcucaugaccgggacacugguuguguuccuacugcucacucugggacagcuuaccuggaaugauuugauccgucugugcaucauggucggcgccaacgcaucugacaauauggggaugggaacgacauauuuagcgcucauggccaccuuuagaaugaggccuauguucgcuguaggccugcuuuuucgccggcugacuagcagagaggugcuacuccugaccguugguuugucacugguggccagugucgaauuaccaaacucccucgaugagcugggggacggacuugcaaugggcauuaugauccugaaguugcucacagauuuccaaucucaccagcugugggcuacucuacugagccuuaccuuugugaaaacgacacucucccugcauuacgccuggaagaccauggcaaugauuuugucaauaguaagccuguuaccccucugucugaguacuacaucucagaaaaccacuuggcuuccggugcuguugggcucccucgggugcaagccucugacaauguuccuaaucaccgaaaacaagauuuggggaaggaaaagcuggccacugaaugaggguaucauggccgucggcauuguuucgauccuucucucaucucuguugaagaacgacgugcccuuagcugggccucugauagcgggaggcaugcucaucgccuguuaugugauuagugguuccagcgcagaucugucucuugaaaaagcugccaaggucagcugggaggaggaagccgagcacuccggggcuucacauaauauccugguggaaauucaggacgauggaacgaugaaaaucaaggacgaggaacgagaugacacuauaaccauuuugcuaaaagcaacacugcucgccaucaguggcguuuaccccaugagcaucccagcgacccuguuuguauggcacuucuggcaaaagaagaaacagcgcucuggcgugcuuugggauacaccuucacccccggaggucgagaaggcuguguuagacgacgggauuuaucggauacugcagagaggacucuuggguaggagccagguuggcgugggggucuuucaagaaggaguguuccacacuauguggcauguaacccguggcgccguccugauguaccaggguaaacgccucgagccgaguugggcaagcgugaagaaagaucugaucuccuaugggggaggcuggcgguuccagggcucuuggaacaugggggaagagguucaggugauugccgucgagccuggaaagaaucccaagaacgugcaaacggcuccagguacauuuaaaacuucggaaggcgagguuggggcaaucgcccuugacuucaagcccggaaccagcggcucaccuauugugaauagagaagguaaaaucgucgggcuguacggaaacggcgugguaacaaccuccggcacuuacgugagugcgauagcucaggccaaggcaucucaggaggggccauugcccgaaaucgaggaugagguuuuuaggaaacgaaaucuaaccauuauggaccugcacccuggaagcgguaagacacggcgcuaucucccggccaucgucagagaagcuauuaagaggaaauuacggacgcuggugcuugccccaacucgaguggucgcauccgagauggcugaagcccugaagggcaugcccaucagauaccaaaccacagcgguaaaaucagagcauaccgggaaggaaauaguggaucucaugugccacgccacuuucacaaugcgcuugcugucuccuguuagggugccaaacuauaauaugauuaucauggacgaggcacauuuuaccgaucccgcuagcaucgccgcucguggauacauuaguacgcgggucggcaugggugaggcagccgccaucuucaugacugcuacaccuccgggguccguggaagcguuuccccagagcaacgcaguuauacaggacgaggaaaaagauauuccagagagaucuuggaacucaggauaugacuggaucaccgauuucccuggcaagaccgugugguuuguccccuccauuaagaguggcaacgacaucgccaauugucucaggaaaaacgggaagcgcgugauacagcugagccgaaaaacuuucgacacagaauaccaaaagaccaaaaacaaugauugggacuauguagugacaacugauauuucggagaugggagcuaacuuuagagccgaccggguuaucgauccaaggcgcugccuuaagccugucauccuaaaggacggucccgagcgugugauucuggcaggcccaaugccggugacggucgccucugcugcgcagagacgggggaggaucggacgcaaucagaacaaagaaggcgaucaguacauuuacaugggucaaccuuugaauaacgacgaggaucacgcccacuggaccgaagcaaagauguuacuggacaauauaaacacacccgaggggaucauuccagcucucuucgagcccgaacgagagaaauccgccgcaaucgauggcgaauauagacugcggggagaggccaggaagacuuucguugaacuuaugcgcagaggcgaccugccuguguggcucagcuacaaaguagcuucagagggguuucaguauagugauaggcgguggugcuucgacggagagcguaauaaccagguguuggaagagaauauggacgucgaaaucuggaccaaggagggugaacgcaaaaagcugcgaccaagauggcuagaugccaggacauacucugacccccuggcgcuccgggaguuuaaggaguucgcagccggccgcagauccgugagcggggaucuuauucuggaaauaggaaaauuaccucagcauuugacccaaagggcucagaacgcccuggacaaucucguuaugcugcacaacucagagcagggcgguaaggcuuaucggcaugcaauggaggaacuuccggauacuaucgaaacgauuaugcugcucgccuugaucgcugugcugaccgggggcgucacauuauuuuuccuaaguggacgaggccuggggaaaacuagcauuggacuccuuuguguaaccuccucuagcgcccuguuguggauggcauccguggagccacacuggaucgcggccucaauaauccuggaguuuuuccucaugguucugcuuauucccgaaccugacagacagcgcacaccccaagauaaucagcucgcuuacguggucaucggucuguuguuuauuauccugaccguggccgcaaacgagaugggcuuacuagaaacuacaaagaaagaccuggggauaggacacacggcugccgagaaccaucaccaugcagccaugcucgaugucgaccuucacccagcuucugcguggacccuguaugccguggcaacuacaauuaucaccccuaugaugaggcauaccauugagaauacaacugcuaacaucaguuugacggccauagccaaucaggcagcuauccugaugggccucgauaaggguuggcccauuucgaagauggacaucgggguuccacugcuugccuuaggcugcuacagccaagugaacccucugacccucacagcggcuguauugaugcugguggcccacuacgcaauuaucggaccgggccuacaggccaaagcuacucgggaagcacagaagcguaccgccgcggggauaaugaaaaaucccacagucgauggaauuguugcuaucgaccuggacccaguggucuaugaugccaaguucgagaaacagcucggccaaaucaugcuucugauuuuguguaccucccagauccugcucaugagaacuacgugggcacugugcgaaucuauaacauuagccaccgguccucuuacuacccugugggaggggucacccggaaaguuuuggaacacaacuauugcugugagcauggccaauaucuucaggggcuccuaccucgccggugcuggccuagccuuuagucugaugaagucucuagggggaggccgccgggggaccggagcgcagggcgaaacacugggugagaaauggaagcgacagcucaaccaacuuagcaaaucacaguucaauacguauaagagauccgggauuaucgagguagacaggagugaagccaaagagggacugaagcgcggcgaaaccacuaagcacgcagugagccgggguacagcuaaauugagaugguucguugagcguaaccuggugaagccagaaggcaaagucauagaucucggguguggaaggggcggguggucuuacuauugcgccggauuaaagaaagugaccgaggucaagggcuacacuaaaggugggccuggacaugaggaacccaucccgauggcaacauauggcuggaaucuggugaaacuucacuccggcaaggacguauuuuucauuccaccugagaaaugugauacccugcuaugcgacaucggggaaucaagccccaacccaacgauugaggaaggacggacccuccgcguacugaagaugguggagcccugguugcgagguaaucaguuuuguaucaaaauucugaacccuuacaugccgucggucguggagacacucgaacagaugcaaagaaagcauggcgggaugcuuguuaggaauccccugucucggaacaguacucacgagauguacuggguguccugcggaaccggcaauaucgucagcgcugugaacaugacaucacgcauguuacugaacagauucacuauggcccacaggaaaccaaccuaugaacgagauguagacuugggugccgggacacggcauguggcgguugagccugaggucgcuaaucucgauauaauuggacagcguaucgaaaacaucaagaaugagcacaaguccaccuggcauuacgacgaagauaaccccuauaaaacuugggcauaccacggcucuuaugaggugaagccuagcggcagugccuccagcauggugaauggggucguuagacugcuaacgaaaccaugggacgugauucccaugguaacacagauagcuaugaccgacacuaccccuuuuggacaacagcgcguguucaaggaaaaagucgauacaaggacgccaaaggccaagcgggguaccgcacagaucauggaggugacugccaaauggcuuuggggcuuucugucuagaaacaagaaaccccgcauuuguacaagggaggaguucacccgaaagguucggucaaaugcugcgaucggggccguguuugucgacgagaaccaguggaauagugcaaaagaagcuguggaggaugaaagauucugggaccucguaaggcgcgagcgugagcugcauaagcaaggaaagugcgccacuugcguuuacaacaugaugggcaaacgggaaaagaaauugggugaguuugggaaggcaaaaggauccagagccauuugguauauguggcugggcgcuagguuccucgaauuugaggcccuuggcuucaugaaugaagaucacugguucagccgcgagaacucucugucggggguggagggagaagguuuacacaagcugggcuacaucuugcgagacauaucaaaaaucccagggggaaauauguacgcggaugacacagcaggcugggauacccggauuacagaggaagaccuccagaacgaggccaagaucacugauauuauggagccugaacaugcucugcuagccaccagcaucuuuaaacuuacguaucagaauaaagucgugagagugcagaggccagcaaagaacgguaccgucauggacguuauaucccgcagagaucaacgggggaguggacaggugggcacauacggccugaacacuuucaccaauauggaggcucagcucauuaggcagauggaaucugaggggaucuuuagccccuccgaacuggagacaccuaacuuggccggacguguauuagacuggcuggagaaacacgguaucgaacgacuccgcagaauggcuauuucaggcgacgauuguguggucaagccaauagacgaucgguucgccacugcacuuaccgcgcugaaugacauggggaaagugaggaaggauaucccccaaugggagccgaguaagggauggaacgacuggcagcagguuccuuuuugcucucaucacuuccaccagcuaauuaugaaagauggccgcgaaaucgugguccccuguagaaaucaagacgagcuggugggucgggccaggguaagccagggggcuggauggucccuccgagaaacggccugcuugggcaagucauaugcacagauguggcaacugauguacuuucaucguagagaucuucgccuggcugccaacgcaauuuguagcgccguuccaguggacugggucccuacaucucggaccacuugguccauccacgcgcaucaccaguggaugacaaccgaggauaugcucaguguguggaauaggguuuggauagaggaaaaccccuggauggaggacaaaacucaugugagcucgugggaagacgucccauauuuaggcaagagagaggaucaguggugcgggucccugaucggauugaccgcucgcgccacaugggcaacgaauauucagguggccaucaaccaaguacggaggcugauugguaaugaaaacuaccucgacuauaugaccucuaugaaacgauucaagaaugagucagaucccgagggcgcucuuugguga

SEQ ID NO: 14176 - RNA, 9879 nt, Artificial Sequence
  derived and/or modified CDS sequence (opt3) from DENV-1__KJ755855__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagagccgaaaccuggauguccucugagggggcuuggaaacagauccagaggguggaaacaugggcacuccggcacccuggauucacuguuauugcccuguuucuggcucaugccaucggcaccucgauuacacagaagggcaucauauucauccucuuaaugcuggugaccccaucaauggcgaugcgcugcgucgggauuggaagcagagauuuuguggagggucuuaguggcgcaacguggguagacguugaguuggaacacggguccugugugacuacaauggccaaggauaaacccacccuggacaucgagcuacucaagacugaagucacaaacccugcugugcugaggaaacuuugcauugaggccaagaucucuaauaccacgaccgauagccgguguccaacacaaggagaagcaacucugguggaggagcaggacgcuaacuucgucugccgccgaaccuuuguugauagaggcugggguaaugggugugaauuguucggaaaaggcucccuccugacaugcgccaaguuuaagugcgugacuaaauuagagggcaagauaguacaguacgaaaaccugaaauauucagugauugucaccgugcacaucgcggcccagcaucaaguugggaaugagaguacagaacacggaaccacugcaauuaucacgccccaggcuccuacaaccgagauccagcucacugacuacggugcccuuacccuggacuguagcccaaggacaggcuuggauuucaacgagauggugcuacugaccaugaaggaaaaaucuuggcucguccauaagcagugguuucuggaccuuccgcugcccuggacuuccggggcuucaacaagccaagagacguggaaucgguuguuccuccuggugaccuuuaaaacugcccacgcaaagaagcaggaaguaguuguguuaggaagucaggagggcgccaugcacacagcucugaccggugcgacagcacuacaaacuuucgggaccacgaccauuuucgccggccaucucaacauacgucugaaaauggauaagcuuacauugaaaggaaugucuuaugucaugugcacuggcuccuuuaagcuggaaaaagagguggcugagacccagcacgggacaauccucguccagauuaaguacgaaggaacugacgccccuuguaagaucccauucagcacccaggaugagaaaggugugacgcaaaauggccgccugauaacagcaaaccccauuguuaccgacaaggaaaaaccugugaauaucgaggccgagccacccuuuggggaaucguauaucguaauuggagcuggcgagaaggcccuuaaacugucuugguucaagaaggguuccucaaucgggaaaauguuugaagcaacugcgagaggcgcuaggcggauggccauuuugggagauacagcaugggacuucggcaguauagggggagucuuuaccagcguggguaagcucguucaucagaucuucggcacugccuacggggugcuguuuuccggagucucuuggaccaugaaaauuggcaucgguguguuacugacauggcuagggcucaacagccgaucaacgagucuguccaugaccugcaucgcuguaggccuugugacuuuguaccugggaguuaugguccaggccgauagcggcugugugauuaauuggaaggggcgcgagcucaaaugcggaucuggcauauucgugacaaacgaaguccacaccuggacagagcaguauaaguuucaagcagacucaccgaagagacugagugcugccaucgguaaagcgugggaggaagggguuuguggaauuaggagcgccacucgguuagagaacaucauguggaagcagauuuccaaugaacugaaccauauccuuuuggagaaugaucucaaauucaccguggugguaggcgacgucgcugguauacuggcacagggcaagaaaaugauccgcccucagcccauggaacacaaguacucuuggaaaaacugggggaaggccaagauuaucggagcugacgugcaaaauucgacguuuauuaucgauggcccaaacacaccugagugcagcgacgaucagagagccuggaauauaugggagguugaagacuauggguucggaauuuucaccacuaacaucuggcuaaaacugagggauuccuacacccaggugugugaccaccgucucaugucagcagcgauuaaggauaguaaagccguccaugcugacaugggcuauuggaucgagucugaaaagaaugagacauggaaacuggcccgggcaagcuuuauagaagugaagacuugcaccuggcccaagucccacacacuuuggucaaacgguguuuuggagagcgagaugaucauuccaaaaaucuacgggggacccauuucucagcauaauuauuccccuggcuacuucacgcaaaccgcugguccauggcaccugggcaaguuagaacucgauuuugaccugugugaggggacuacagugguagucgaugaacacugcggaaaccgaggcccgagucuuagaaccacuacagugaccgggaaaaucauacaugaguggugcuguaggagcugcacgcugcccccuuugcgcuuccggggagaggacggcuguugguacgguauggaaauuagaccagugaaggagaaagaagagaaucucgucaagucuaugguuuccgccgggucaggagaagugguaagucugagccuaggccugcucugcaucucgaucaugauugaggaggugaugaggucccgcuggucucgaaagaugcugaugacugguacccuugcagucuuuuuccggaaaauccguggccaguugacauggaacgaucugauuagauuauguauaauggugggggccaaugcuagcgacaggaugggaacccgcacuacauaucucgcgcugauggccaccuuuaagaugcggcccauguucucaguuggccuucuguuuagaaggcuaacaagucgagaagugcuccuguugacuaucgggcuguccuuagucgcaucuguggagcucccuaacagccuggaagagcuuggaguucuguuggcuaugggcauuaugauccucacccugcuaacggacuuccagucccaccaacugugggccacacuucucucaaugaccuuuauuaaaacuaccuucagccugcauuacacauggaagacuauggccaugguguugaguaucgucucucuguuuccauuaugccucuccaccacgagccagaaaacaaccuggcugcccguacuucuggguucguugggguguaagccgcucacuauguuccugauagcugaaaacaagaucuggggacgcaaaucauggccucuaaaugagggcauuauggcagugggcaucguuucuauucugcuuaguucccuccugaagaacgaugugccauuggccgggcccuuaaucgcgggagguaugcugauagcuugcuaugucauuagcggcucuagcgccgaccucucccuggagaaagcagccgaagugucaugggaggaagaggcugaacacaguggggcaagccauaauauccuuguagaggugcaggaugacggaacaaugaagaucaaagaugaggaacgggacgauacccugacuauuuugcuaaaggccacacugcucgcggucucuggcguuuacccucuguccauacccgcuacccuuuucgugugguauuuuuggcagaaaaagaagcaaagaucagguguguuaugggacacgccaaguccucccaaagucgagaaggccgugcuggaugacgggaucuacaggauuaugcagcguggacucuugggccgcagccagguuggcguagggguguuccaggaaaacgucuuucacacuauguggcacgugacccggggagcaguucugauguaucaagguaaaagacucgagccauccuggggcagggugaagaaagaucugaucucuuacgggggaggcuggggucuuaaggggucguggaauacaggagaggaaguccaggugauugccguagagccgggcaagaacccuaaaaauguccagaccgcucccggcacauucaagacuccagaaggggaggugggagccaucgcacuggacuuuaaacccgguaccagcggcucaccuauaguuaaccgagaagggaagaucgugggauuguacggcaauggugucgugacgacauccgggacuuauguuagugcuauugcccaugcgaaagccucucaggagggaccacuacccgagaccgaaguggaggcauuccggaagcgcaaccugacaaucauggaucuccacccuggcagcggcaagaccagaagguacuuaccggcuauuguccgggaagccaucaaacgaaagaugagaacucugauacuugcuccaacccgcgugguagcauccgagauggccgaagcccugaaagggaugcccauuagguaucaaacaacggcugugaagucagagcauacuggaaaagagaucguugaccucaugugucacgcgaccuuuacaaugcguuugcugucuccuguccgggugccaaauuacaacaugaucauuauggacgaagcacauuucaccgaucccagcagucucgccgcuagagguuauaucuccacuagggugggcaugggggaggccgcagccauauuuaugacagcuaccccuccgggaagcgucgaagcguucccccagucuaaugccguaauucaggacgaggaacgcgauaucccagagcgaucauggaacuccggcuacgaguggauuacggacuuuccugguaagacugugugguucguucccaguaucaaggcagggaaugauauagcuaacugccugagaaaaaacggaaagcgggugauucaacuuagcaggaaaacauucgacaccgaauaucagaagaccaaaaauaacgauugggacuacgucgugacuacagauaucucggagaugggcgccaauuuuccagcagaccgcguuaucgauccucguagaugucuaaaccccgugauucugaaggacggcccagaacgggucaucuuggccgggccgaugccugugaccguagcuucugccaaucagaggcgcggacgaauugguagaaaccacaauaaggagggcgaccaguacauauauauggggcaacccuuaaacaaugaugaggaccacgcgcauuggacagaagcaaaaaugcugcucgauaacaucaauacuccagagggaauuauccccgcccuguucgaaccugagcgggaaaaguccgcugccaucgacggcgaguacaggcuucgcggugaggcuagaaaaacguuuguggaacugaugaggcggggggaucucccaguuugguugagcuauaaggucgcaucagagggcuuccaguacagugaccgucgcuggugcuuugauggagaacgaaacaaucaggugcuggaggaaaacauggacguggagauuuggaccaaagagggcgaaagaaagaaacuaaggccccgguggcuggaugcccgcacauauucugacccucucgcucuuagagagaagaaggaauucgccgcagggaggcgguccgucagcggagaucugauauuagagaucgguaaauugccgcagcaccugacucaacgagcgcagaaugcccucgacaaccugguuaugcuucauaacucagaacagggcgggagagcuuaccgccacgccauggaggagcugccagauaccauugaaacacucauguugcuggcauuaaucgcugugcuaaccggaggcguaacucuguuuuuccucagugguaaggggcuuggcaaagccggaaauggccuguugugcgugauggcaagcuccgcccugcucuggauggcuaacgucgagccccacuggauugcggccucuaucauacuggaauuuuuccuuauggugcuccugaucccugagcccgacaggcagcggacgccacaagacaaucaguuggcauauguugugauucgucuguuauuuaugauccuaaccgucgcugccaacgagauggggcugcucgaaacaacuaagaaagaucuuggaauuggucaugccgcaguagagaaucaccaucacgcugccaugcuggacaucgauuugcauccugcgagcgcuuggacccuguacgccguggcaacaaccauaauuacucccaugaugagacacacaaucgaaaacacgaccgccaauauuucccucacugcuaucgcaaaccaggccgcgauacugaugggccuugacaagggguggccaaucucaaagauggauauuggaguuccuuuacuggcucucggcuucuugucucaggugaauccgcugacacuaaccgccgcaguccugaugcucguggcccacuacgcuaucauuggucccgggcuucaagccaaagcaaccagggaggcucagaagcgcacagccgcgggcaucaugaaaaacccaacuauagacggaauugucgccaucgaucuggacccugugguuuaugaugcaaaguuugaaaaacaguugggccaaaucaugcugcucauucuguguacgagucagaucuuacuuaugcggaccacaugggcucugugcgagucgauaacucucgccaccgggccccuaagcccacugugggagggauccccuggcaagucuuggaauacaaccauugcagugucaauggcuaacaucuuccgagguagcuacuuggccggggccggacuggcguucucccucaugaagagucuuggcgguggcagaagggggacuggagcucagggcgaaacgcugggggagaaauggaagcgccaguugaaucaacugucuaaaacagaauuuaacaccuauaagcggagcggaauuauggagguagacagaucagaagcaaaagagggccucaagcguggugagacuaccaagcaugccguguccagggggacagcuaaauuacggugguucgucgaacgcaaucugguuaagcccgagggaaaagugaucgaucuuggcuguggucgaggcggguggaguuacuauugcgccggacugaagaaagucagcgaagugagaggcuacacuaaggggggaccgggccacgaggaaccaauaccuauggcaaccuaugguugggaccuacucaaaagguguucugggaaggaguuuuucuuuauccccccagagaagugcgauuccuuccugggagacauuggcgaaucaagccccaacccuacaaucgaggaaggccggacgguacgcguguugaaaaugguugagccguggcugagagggaaucaguuuuguauuaagauccucaaccccuacaugccaucgguggucgagacccuugaacagaugcagaggaaacauggagguaugcuggugcgaaacccuuuaucucggaauaguacucacgagauguacugggucuccugcggcacagggaacauugugagcgccguuaauaugaccucacguaugcuguugaacagauucacuauggcucaccgcaagcccacauaugaaagggacguagaucucggagcgggcacccggcauguggccgucgagccugaaguggcaaaucuggacaucauaggucaaagaauugagaacaucaaacacgagcauaaguccacguggcacuacgaugaagacaauccauauaagaccugggcuuaccaugggucuuaugagguuaaacccagcggaagugccuccagcauggugaacggcgucgugaagcuacuuacaaaaccuugggauguaaucccaauggugacucagauugcaaugaccgacacaacucccuuuggccagcagcgcguuuucaaggaaaaagucgauaccaggacaccgaaggccaagcgagggaccgcucaaauaauggaggugacugcccgguggcuguggucuuuucucucaagaaauaaaaagccuaggaucuguacgcgcgaagaguucacacguaaagugcggaguaacgcggcaauuggagccgucuuuguugacgagaaucaguggaacuccgcuaaggaagccguggaggaugacagauucugggaucugguacacagggaacgcgaguugcacaaacaggguaagugcgcaaccuguguguacaauaugaugggcaagcgagaaaaaaagcugggggaguucggaaaagcuaagggcagccgggccaucugguauauguggcucggugcuagauuucuugaguucgaagcccugggguuuaugaacgaggaccauugguucucuagggaaaauucguuaucaggagucgagggcgagggccugcacaaauugggguacauucuccgcgacaucagcaagauaccaggagguaacauguacgcagaugacacugcgggcugggauaccagaaucacagaagacgaucugcaaaacgaggccaaaauuacggacaucauggaacccgagcaugcucuacuugccaaguccauuuuuaagcugaccuaucagaauaaagugguucgggugcagaggccugcaaagaacgggacugucauggaugugaucagucgucgagaccagcgcggaucuggccaaguagguacauacgggcucaauaccuucacuaacauggaagcucagcugauaagacagauggagagcgaggaaauuuuuuccccaaaugaguuggaaacacccaacuuagccgagcggguucuggauuggcucgaaaaauauggaguggagaggcuuaagcgcauggcaaucucaggcgacgauugcgucgugaaaccgaucgacgauagauucgccaccgcgcugacagcucuaaaugacaugggcaaggugcggaaggacauuccucagugggagcccaguaaaggguggaacgauuggcaacaggucccauuuugcucucaccacuuccaucagcugguuaugaaggacggaagggaaauagugguaccuugucgaaaucaggaugagcucgugggucgugccagagucagccaaggcgcagggugguccuugcgcgaaacugccugccugggaaaaucauacgcucagauguggcagcuuauguauuuucaccggagggaccugagacucgccgcaaacgcuaucuguagcgccgugcccguugauugggugccaaccucucgcacgaccugguccauucaugcgcaccaucaguggaugacaacugaggacauguuaagugucuggaaucggguguggaucgaagagaaccccuggauggaggauaagaccaggguaagcucgugggaagacguuccuuaccugggcaaacgagaggaucaauggugcgguuccuugauugggcugacagcuagagccacuugggcaaccaauauccagguggccauaaaccagguccggaggcucaucggaaaugaaaacuauucugacuacaugacgucaaugaagcgcuucaagaacgagagcgagccagaaggcgcucuuugguga

SEQ ID NO: 14177 - RNA, 9879 nt, Artificial Sequence
  derived and/or modified CDS sequence (opt3) from DENV-1__KF289073__SS-prME
agcgugaccaugcuguucaugcuccuucccacugcacuggcuuuucacuugacuacgagaggaggggagccucauaugaucgucuccaagcaggaaagaggaaaaucuuuacuguucaagaccucagccgguguuaacaugugcacauugauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaagguggaaacuugggcucucaggcacccuggauuuaccguuauugcacuguuccuggcccaugcuaucggcacaucgauuacccagaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggccaagaauaagcccacucuggauaucgaacuacucaaaacagaggugaccaacccugccgugcugagaaaacuuugcauugaagcuaaaaucuccaagacgaccacagacucuagguguccaacucaaggagaggccacccuggucgaggaacaggaugcaaauuuuguuugccggcgcacauucguggaccgaggcugggguaacggguguggauuguuuggcaagggcagccuccugacuugcgcuaaauucaagugcguaaccaaauuagaggggaagauagugcaguacgaaaaucugaaauauuccgucauugugacaguucacaccggagaucagcaucaaguggguaacgagacuacggaacacggcacaaucgccaccauuacuccccaggcgccuaccucagagauccagcucacagacuacggggcccuuacccuggacuguaguccaagaacuggauuggauuuuaaugaaaugguccuacugacaaugaaggagaaaagcuggcucgugcauaagcagugguuccuggaccuuccgcugcccuggacgucuggcgcauccaccucacaagagacuuggaacaggcaggauuugcucguaacauuuaagaccgcucacgccaaaaagcaggaaguugugguccuggguagccaagagggggcuaugcacacagccuuaacuggcgcaaccgaaauccagacgaguggaaccacaacuauuuucgccggccaucugaaaugccggcuaaagauggacaaacucacccugaaggggaugucuuaugugauguguacaggauccuucaaacuugagaaagaagucgcugagacucagcacgguaccguguugguucaggugaaguacgagggcacggaugcgccuugcaaaauaccaaucagcacacaagacgaaaaggggguaacccagaauggacgucugauuacugcaaaccccaucgucacagauaaagagaagccugugaauauagaaaccgagccacccuuuggcgagucguauauuguuaucggugccggggaaaaggcucucaaacugucuugguucaagaaaggcuccucaaucggaaagauguuugaggccacugcacgcggcgccagaaggauggcuauucuuggggacaccgccugggauuucggaaguaucgguggcguguuuacaagcgucgggaaacuggugcaucagguauucggaacggcauacggcguguuguuuuccgguguuucuuggaccaugaagauugggauaggcguccuccugacuugguuaggacugaacagccggucaacaagucuauccaugaccuguaucgcggugggcauggugacacucuaccugggggucaugguucaggcugacagcggaugcgugauuaauuggaagggccgagaacuuaaaugugguucugggaucuucgugacuaacgagguacacaccuggacggaacaauauaaguuucaggccgauucaccgaaacgcuugagugcagccaucggaaaggcuugggaggagggcgucugcgguauuagaagcgccacaaggcuggaaaacauaauguggaaacagaucuccaaugagcucaaccauauucuguuagaaaaugacaugaaguucaccgugguugugggcgacgcaaacgggauccuggcucagggcaagaaaaugauucggccucaacccauggagcacaaguacucuuggaaaucguggggcaaggccaaaaucauaggggcggauauccagaauacuaccuuuauuaucgacggaccagauacaccugaaugucccgacgaucaccgcgccuggaacauuugggaggucgaggacuauggcuucgguaucuuuacuaccaauauauggcuuaaguugagagauagcuacacacagaugugcgaccauaggcucauguccgcugcaauuaaagauucaaaggccgugcacgcugacaugggguauuggaucgaaagugagaagaacgaaacguggaaacuggcccgugcaucuuucauugagguuaagaccuguaucuggccaaaaagccauacucuaugguccaauggagugcuggaaucagagaugauaauccccaagauuuacggcgguccuaucagccagcacaacuaucggccaggcuacuucacacaaaccgcggggccguggcaccucggaaaacuggagcuugauuuugacuugugcgaaggcacuacaguagucguggaugagcauugcgggaaucgaggacccucucugagaaccacgacugugaccggcaagauuauccacgaaugguguugcagguccuguacauuaccuccacuccgcuucaagggugaggacgggugcugguacggaauggagauacggcccgucaaagaaaaggaggaaaaccugguuagaaguauggugagcgccggcucuggugagguagacuccuuuucacuuggccuguugugugugaguauuaugaucgaagaggucaugaggagccgcuggucgcgaaaaaugcucaugaccgggacucuggcuguguuccuacugcucaucaugggacagcugacauggaaugaucuuauucgguugugcaucaugguuggcgccaacgcauccgaccguauggggaugggaaccacauaucuggcuuuaauggccacuuuuaagaugagaccuauguucgcagugggccuccuguuuaggcgccuuaccucucgggagguccugcuacucacgauuggucugagcuugguggccucaguugaacugccaaauaguuuagaggaacucggggauggacuggcuaugggcauaaugaugcuuaaacuguugacagacuuccagucccaucaacucuggaccacucugcuaucucugaccuuuaucaagacaacucuuagccucgauuacgcguggaagaccauggccauggugcuguccauugucucauuguucccccuguguuuaagcacgacaagucagaaaaccacuuggcucccgguacugcuuggcucuuuugggugcaagccucugacaauguucuugaucaccgagaacaaaauuuggggaagaaaguccuggccacucaacgaagguaucauggcagugggcauaguuagcauccugcuaucgucacugcuuaaaaaugacgugccccucgcugggccucugauugccggaggcauguugaucgccuguuaugucauuucugguaguuccgcugauuuaagccuggagaaggcagccgaggugucuugggaagaggaagcggagcacagcggggcuucccauaacauccucguagaagugcaggacgauggaacuaugaaaauaaaggacgaggagagggaugacacacugaccauucuucugaaggccacguugcuagcagucucaggcguuuaccccaugaguaucccagccacucuguuugugugguauuucuggcagaaaaagaaacaacgaagcggcgugcucugggauaccccuucucccccagaagucgagcgcgcugugcuggacgacgggaucuaccggauucuucagagaggauuacuggguaggucccagguuggcguagggguguuccaggauggagucuuucacacaauguggcacgugacccguggcgcaguucucauguaucaagguaagcgcuuggaaccgucaugggccagugugaaaaaggaccugauaagcuacgggggaggcuggcgguuccagggcuccuggaauaugggggaggagguccaggugaucgcgguagaaccuggaaagaaccccaaaaauguccagacaacuccagguaccuuuaagacgcccgagggcgaagugggggcuauugcccucgauuucaaaccuggaacaucuggcucgccaaucguuaacagagaggguaagauuguggggcuguacggaaauggcgucgugacuaccagcggcacauauguuucagcaaucgcccaagcuaaagccucccaggaagggccccuuccugagauagaggacgaaguguuuaggaagcgaaaccugaccaucauggauuugcauccgggaagugguaagacucggcgcuaccuaccagcaauugucagagaggcuaucaaaaggaagcugcggacccucauuuuagcccccacacgagugguagcgucugaaauggccgaggcacugaaaggcaugccuaucagauaucagacgacugcuguaaagagcgaacacaccgggcgcgagauaguugaccuuaugugccaugccacauucaccaugaggcugcucuccccaguccgugugcccaauuacaacaugauuaucauggaugaggcucacuuuacugacccugcaucaaucgccgcccggggauauauuucuacaagagugggcaugggugaagcugcggcaaucuucaugaccgccacgccgcccgggagcgucgaggcuuuuccacaaaguaaugccguaauacaggaugaagagagggacauuccugaacgcuccuggaacagcggauacgauuggaucacugacuuccccggcaaaacagugugguuuguuccaucuauuaagucaggcaaugacaucgcaaacuguuugcgaaagaaugggaaaagagugauacagcugucccggaagaccuucgauaccgaguaucagaaaacuaagaacaacgacugggauuacgucgugacaaccgacauuagugagaugggagccaauuucagggcugaucgcguuaucgacccucguagaugccucaaacccgugauccugaaggaugguccagaacgggucauucuugcgggcccgaugccugugacaguagccagcgcagcucaaaggcgcgggcgaaucggaagaaaccagaauaaggagggcgaccaguacguguauaugggucagccccuaaacaaugaugaagaccaugcccacuggacugaggcaaaaaugcuguuggauaacauuaauacgccagaggggauaauccccgccuuauuugaaccugagcggaagaaaucggcugccauugacggcgaauacaggcugcgcggagaggcgagaaagaccuucguugaacucaugaggcggggcgaucugccagucuggcuuucuuauaaaguggcauccgagggguuucaauacagcgaccgucgcuggugcuucgacggagagcgaaacaaucaggugcuggaagagaacauggaugucgaaaucuggacaaaggagggugaaaggaagaagcucaggccccggugguuggacgcccgcacuuauucagauccucuggcucuaagagaguuuaaggaguucgccgcuggcaggcggaguguuucuggggaccugauccucgaaauuggaaaacuuccgcagcaccugaccuuacgagcacagaaggccuuggauaaucuggugaugcuccauaacuccgagcaaggcgguaaggcuuacagacacgccauggaggaacugccagacacaauagaaacccuuaugcugcucgcauugaucgcgguacugacugggggcgugacguuauuuuuccuaagcggaaagggccuggggaaaaccucaauuggacuccuuugugucauggccaguagcgcucuguuguggauggccuccguggagccccauuggaucgcagcuucuauuauccuggaguuuuuccucaugguucugcuuauaccugaacccgaucgccagaggacaccacaggacaaucagcucgccuauguggucaucggucuguuguuuaugauucugacuguagcagccaacgagaugggcuuacuagaaaccacaaagaaggaucuggggaucggacacguggcugcggagaaucaccaucacgccaccaugcucgacguugaucuucggccugcaagcgcuuggacucuguacgccguggccacaacgauuaucacccccaugaugcgucauacuauagagaacacaaccgcaaacauuuccuugaccgcuaucgccaaucaagcggcuauucugaugggccucgacaaagguuggccaaucucaaagauggauauaggggucccucugcuugccuuaggcugcuacucucaggugaacccgcugacacucacugcagccgucuugaugcugguggcucacuaugcaaucauuggacccggccuacaggccaaagcgacgagagaagcucaaaagaggaccgccgcagggaucaugaaaaauccaacaguugacggaauuguggccaucgaccuggauccuguaguguacgacgcuaaguucgagaagcagcucggccagauaaugcuucugauuuuguguaccagucagauccugcucaugcgcacuacaugggcccugugcgaaucgaucaccuuagcaacugguccccuuacgacacugugggaggggagcccaggaaaauuuuggaacaccacuauugcugucuccauggccaauaucuuccggggcucuuaucucgcgggugccggccuagcauucucacugaugaaaagccuagggggaggccgaagagggaccggagcucaaggcgaaacacugggugagaaauggaagaggcagcucaaccagcuuuccaaaagugaguuuaauacuuacaagcgcucugggauaauggaaguugaucggagcgaggccaaggaaggacugaaaagaggcgagaccacaaagcaugcagugucacgugguacggcuaaauugaggugguucgucgaacggaaccuggugaagccugagggcaaaguaauugaccucggguguggacgcggcgggugguccuauuacugcgccggauuaaagaaagugaccgagguuaagggcuauacuaagggugggcccggacacgaggaaccgaucccaauggccacauacggcuggaaucuggugaaacuucacaguggcaaggaugucuuuuucaccccucccgaaaaaugugacacucugcuaugcgauauuggggagagcucuccaaaccccacaaucgaagagggacgaacccucagagugcugaagauggucgagccuugguugagggguaaucaguuuuguauaaaaauccugaacccguacaugcccuccgugguugaaacgcucgagcaaaugcagcggaagcauggcgggaugcuuguacgcaauccacugucaagaaacagcacccacgaaauguauugggugucgugcggaacaggcaauauugucucugcggugaacaugacaaguaggauguuacugaaucgauucaccaugacacaucggaagccuacuuacgagcgugacguugauuugggugcugggaccagacacguggcagucgagcccgaaguggccaaccucgacaucauuggacagcgcaucgagaacauuaaaaaugaacacaaguccacauggcauuaugaugaggacaacccuuacaaaaccugggcuuaucacggcagcuacgaaguaaagccaucaggcuccgccucuagcauggugaaugggguugucaggcugcuaacuaaacccugggacgugaucccuauggugacgcagauagcaaugacagauaccacuccauuuggacaacagcgggucuucaaggagaagguugacaccagaacaccccgcgccaaaagggguacggcucagauuauggaggugaccgcgaaguggcuuuggggcuuucugagucgaaacaaaaagccgcggaucuguacuagagaagaguucacaaggaaaguacgcuccaaugccgcaaucggggcuguguuugucgaugaaaaccaauggaauagcgccaaggaggcaguggaagacgagcguuucugggaucucguucaucgggagagagaacugcacaagcagggaaaaugcgcaaccugcguguauaacaugaugggcaagagggagaaaaaguugggugaauuugggaaagcuaagggaucucgcgccauuugguacauguggcugggcgcgcgauuccucgaguucgaagcacuuggcuuuaugaaugaggaccauugguucucacgggagaacagucuguccggggucgaaggagaggguuuacacaaacugggcuacauauugagagauaucagcaagauuccugggggaaauauguaugccgacgauacuacaggcugggacaccaggaucacagaagaugaccuccagaacgaggcuaagauuacugauaucauggagccagaacacgcccugcuagcaaccucuauauuuaaacuuacguaccagaauaaggugguacgcguucaaagacccgcuaaaucggguaccgugauggacgucaucucacggagggaccagcgugggagcggacaggugggcacauauggccugaacacuuucaccaauauggaggugcagcucauucgacaaauggaauccgaggggaucuuucugccuagugaauuggagacaccaaacuuagccgagcgcguccuggauuggcucgaaaagcauggaguugagagacuuaaacggauggcuauuucuggugacgauugugugguaaagcccacugacgauagguucgccaccgcacugacggcgcuaaacgacaugggcaaggugcgcaaagauaucccgcagugggaaccuagcaagggguggaaugacuggcagcagguccccuuuugcucccaccauuuccaccaacugauaaugaaagauggaagagagauugugguuccaugucggaaccaggacgaacucaugggcagggcccgagugucacagggugcuggguggaguuugcgugagacagccugccugggaaagucuuacgcacagauguggcaacuuauguauuuucacagacgcgaucugcggcucgcugccaaugcaaucuguagcgccgucccuguggacuggguacccaccuccaggacuacauggucaauccaugcgcaccaucaguggaugaccacugaggacauguuaagcguuuggaacagaguguggauugaagagaauccauggauggaagauaaaacccacgucucuuccugggaggacgugcccuaccugggcaagcgcgaagaucaguggugcggcaguuugauagggcugacagcucgggccacgugggcaaccaacauccaaguugccauuaaucaggugaggcgacucaucggaaacgagaauuaucuugacuacaugacuagcaugaagagauucaaaaacgagucggauccugaaggugcucugugguga

SEQ ID NO: 14178 - RNA, 9879 nt, Artificial Sequence
  derived and/or modified CDS sequence (opt3) from DENV-1__JQ915072__SS-prME
uccgugaccaugcugcucaugcuucugcccacagucuugacuuuccacuuaacgaccaggggaggggagccucauaugaucguuuccaagcaggaaaggggaaaaucucuguuauuuaagacaucagccggugugaacaugugcacucucauugcuauggaccugggcgagcuuugugaugacaccaugacauacaaaugcccacggauaaccgaaacugagccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguagaggguuugagcggcgccaccuggguugacgugguccuggagcacgggaguugugugacuacaauggcuaaggauaaacccaccuuggacaucgaacuccugaagacggaggugaccaauccugccguccuuaggaaacugugcauugaagcgaagaucuccaacacaacuaccgauucucgguguccaacacaaggagaggcaacuuugguugaggaacaagacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaaccggcgcuucuacaucccaagagacuuggaaccggcaggacuugcucguuaccuucaaaacggcccacgcgaagaagcaggaaguggucgugcuggguucacaagagggggccaugcacaccgcauuaacaggcgcuacugaaauucagaccagcggaacaacuaccauauuugccggccaucugaaaugccgucuaaagauggauaaacucacgcugaaggggaucaguuaugucauguguacaggaucuuucaaacuugagaaggaaguggcugagacccagcacgguacuguuuuggugcagguaaaguacgagggcacagacgccccuugcaaaauuccauucuccagccaagaugaaaagggggucacccagaauggacgccuggugacugcaaaccccaucguuaccgacaaagagaagccugugaauauagaagccgagccacccuuuggcgagucguauauugucgugggugcuggggaaaaagcgcucaagcugucuugguucaagaaaggcuccucaaucggaaagauguuugaggcaacagccagaggcgcuaggcggauggccauccuuggggauacggcaugggacuucggaaguauugguggcguauuuaccagcguggggaaacugguucaucagaucuucggaacugccuacggcgucuuguuuuccggugugucuuggacaaugaagauugggauaggcauccuccugaccugguuaggacugaacagccgaucaacaagucuauccaugacuuguauugcugugggcauggucacccucuaccuggggguuauggugcaggccgauagcggaugcgugaucaauuggaaaggccgcgaacuuaagugugguucugggaucuucguaacgaacgagguccacacauggaccgaacaauauaaguuucaggcagacucaccgaaaagauugagugcggcuauuggaaaggccugggaggagggcgugugcgguauaaggagcgcaacucggcuggaaaacaucauguggaaacagauuuccaaugagcucaaccauauccuguuagaaaaugacaugaaguucaccguuguggucggcgaugugucugggauucuggcccagggcaagaaaacaauccgcccucaacccauggagcacaaauacucguggaaaagcuggggcaaggcuaaaauaaucggggccgacguucagaacacuaccuuuauuaucgauggaccaaauacaccugaaugucccgacgaucagagagcauggaacauuugggagguggaggacuauggcuucgguaucuuuacgaccaauauauggcuuaaguugagggauuccuacacucagguaugcgaccaccgucucaugucagcugccauuaaagauaguaaggcgguccaugccgacaugggguauuggaucgaaucugagaaaaacgaaacauggaagcuggcucgggccagcuucauugaggugaagaccuguguguggccaaaaucccacacucuauggucaaauggaguccuggaaagcgagaugaucauacccaagaucuacggcgguccuauuucucaacauaacuaucgaccaggcuacuucacacagaccgcagggccguggcaccucggaaaacuggagcuugauuuugacuugugcgaaggcacgacuguugugguagaugagcacugcgggcauagaggacccucccugaggaccacaaccgugacuggcaagaucauucacgaaugguguugccgcaguuguacauuaccuccacuccgguucaaaggugaggacgggugcugguacggaauggagaucagacccgucaaggaaaaggaggaaaaucuggugaaaagcaugguuucugcuggcuccggugagguggacucauuuagucuuggccuguuguguauaagcauuaugaucgaagaggucaugaggucgcgcuggucccgaaagaugcucaugaccgggacacuggugguuuuccuacugcucacucugggacagcuuaccuggaacgauuugauccggcugugcauuauggugggcgccaaugcaucugacaacauggggaugggaacgacauauuuagcgcucauggccaccuuucguaugagaccuauguucgcugucggccugcuuuuuaggcgccugacuagccgggagguacuacuccugaccguggguuugucacugguugccaguguggaauuaccaaauucccucgaugagcugggggacggacuugcaaugggcaucaugauucugaaauugcucacagauuuccaaucucaucagcugugggcuacucuacugagccuuaccuuugucaagacgacacucucccugcacuacgccuggaaaaccauggcaaugauauugucaaucgugagccuguuaccccucugucugaguacuacaucucagaagaccacuuggcuuccgguacuguugggcucccucgggugcaagccucugacaauguuccuaauuaccgaaaacaaaaucuggggaagaaagagcuggccacugaacgaggguauuauggccgugggcaucgucucgauacuucucucaucucuguugaaaaaugacguucccuuagcugggccucugaucgcgggaggcaugcucauugccuguuaugugaucagugguuccagcgcagaucugucucuugaaaaggcugccaaagugagcugggaggaggaagccgagcauuccggggcuucacacaacauucuggucgaaauccaggacgauggaacgaugaagauaaaagacgaggaaagggaugacacuauuaccaucuugcuaaaggcaacacugcucgccaucaguggcguguaccccaugagcauuccagcgacccuguuuguuuggcacuucuggcaaaagaaaaagcagcgaucuggcguacuuugggauacaccuucacccccagagguggagaaagcugucuuagacgacgggauauaucgcauccugcagcggggacucuuggguagaagccaggugggcguugggguguuucaagaaggagucuuccauacuauguggcacgugaccaggggcgccguacugauguaccaggguaagcgucucgagccgaguugggcaagcgucaaaaaggaucugauuuccuaugggggaggcuggcgcuuccagggcucuuggaauaugggggaagaggugcagguuaucgccguggagccuggaaagaaccccaaaaauguccaaacggcuccagguacauuuaagacuucggaaggcgaggugggggcaauugcccuugacuucaaacccggaaccagcggcucaccuaucguuaaccgggaagguaagauaguggggcuguacggaaauggcgucgugacaaccuccggcacuuacguaagugcgaucgcucaggccaaagcaucucaggaggggccauugcccgaaauugaggaugagguguuuagaaagaggaaccuaaccaucauggaccugcauccuggaagcgguaagacacgacgguaucucccggccauuguucgcgaagcuaucaaaagaaaguuaaggacgcugguccuugccccaacucgggugguggcauccgagauggcugaagcccugaaaggcaugcccauacgauaccaaaccacagcggucaagucagagcacaccgggaaagaaauuguagaucucaugugccaugccacuuucacaaugagauugcugucuccugugcgcguuccaaauuauaacaugaucaucauggacgaggcacacuuuaccgaucccgcuagcauugccgcuaggggauacaucaguacgcgugugggcaugggugaggcagccgccauauucaugacugcuacaccuccgggguccgucgaagcguuuccccagagcaaugcagugauucaggacgaggaaaaggauaucccagagcggucuuggaacucaggauaugacuggauuaccgauuucccuggcaagaccguuugguuugugcccuccaucaaaaguggcaaugacauagccaacugucucagaaagaaugggaaaagggucauucagcugagccgcaagacuuucgacacagaauaccagaagaccaagaacaacgauugggacuaugugguaacaacugauaucucggagaugggagcuaauuuucgagccgacagagugaucgauccacggaggugccuuaagccuguuauucuaaaagacggucccgagcgcgucauccuggcaggcccaaugccggugacgguggccucugcugcgcagcguagagggcggauuggaaggaaccagaauaaggaaggcgaucaguacauauacaugggucaaccuuugaacaaugacgaggaucacgcccauuggaccgaagcaaaaauguuacuggacaacaucaauacacccgaggggauuaucccagcucucuucgagcccgaacgcgagaaguccgccgcaaucgauggcgaauaucgacugagaggagaggcccggaaaacuuucgucgaacuuaugaggcgcggcgaccugccuguuuggcucagcuacaagguggcuucagagggguuucaguauagugauagaagguggugcuucgacggagagcggaacaaucagguauuggaagagaacauggacguggaaauuuggaccaaagagggugaacguaagaagcugcgcccacgauggcuagaugccagaacauacucugacccccuggcgcucagggaguuuaaagaguucgcagccggccggcgcuccgucagcggggaucuuauacuggaaaucggaaaguuaccucagcacuugacccaaagagcucagaaugcccuggacaaccucgugaugcugcauaauucagagcagggcgguaaggcuuauaggcacgcaauggaggaacuuccggauacuauugaaacgaucaugcugcucgccuugauugcuguucugaccgggggcgugacauuauuuuuccuaaguggacggggccuggggaagacuagcaucggacuccuuugugucaccuccucuagcgcccuguuguggauggcauccguagagccacacuggauagcggccucaaucauucuggaguuuuuccucauggugcugcuuauccccgaaccugaccgacagagaacaccccaagauaaccagcucgcuuacguugugauuggucuguuguuuaugauccugaccgucgccgcaaaugagaugggcuuacuagaaacuaccaaaaaggaccuggggauaggacauacggcugccgagaaccaccaucacgcagccaugcucgauguggaccuucauccagcuucugcguggacccuguaugccgucgcaacuacaauuaucaccccuaugaugcgccacaccauugagaacacaacugcuaauaucaguuugacggccauagccaaccaggcagcuauccugaugggccucgauaaggguuggcccauuucgaaaauggacaucggggugccacugcuugccuuaggcugcuacagccaaguuaauccucugacccucacagcggcuguguugaugcugguagcccacuacgcaauuaucggaccgggccuacaggccaaggcuacuagggaagcacagaaacggaccgccgcggggauaaugaagaaccccacaguggauggaauugucgcuaucgaccuggacccaguuguguaugaugccaaauucgagaagcagcucggccaaaucaugcuucugauuuuguguaccucccagauccugcucaugcguacuacgugggcacugugcgaaucuauaacauuagccaccgguccucuuacuacccugugggaggggucacccggaaaguuuuggaauacaacuauugcugucagcauggccaacaucuucagaggcuccuaccucgcaggagcuggccuagccuuuagucugaugaaaucucuaggggguagcaggcgcggcaccggggcgcagggagaaacacugggcgagaaguggaaacggcagcucaaucaacuuucaaaguccgaguucaacauuuauaaacgaagugguaucauagaaguggacagaagcgaggccaaggaagggcugaagaggggagagacgaccaaacaugcaguaucucgcggcacugcuaaguugcggugguucguggaaagaaaucugguuaaaccagaggguaaggugaucgaucucggcugugggcguggaggcugguccuacuauugcgccgggcuaaagaaggucacagaggugaaaggauacaccaagggcgguccugggcacgaggagcccauuccgauggcaacuuauggauggaaccuggucaaacuucauucaggcaaagacguguuuuucaucccaccugaaaagugugauacacugcuaugcgacauuggcgagagcucgcccaauccaaccaucgaagaggggaggacgcuccggguucugaaaaugguagagcccugguugcgcggaaaccaguuuuguauuaagauccugaauccuuacaugccgucuguggucgaaacccucgagcagaugcagcgaaaacacgguggcaugcuugugagaaacccccugaguagaaauuccacacacgaaauguacuggguuagcugcgggacuggaaacauagugucagcugucaauaugaccucccggauguuacugaaccgcuucacaauggcccauagaaagccaacuuaugagagggauguggacuugggcgccgguacccgacacguagcgguggagccugaaguugcuaaccucgauauuaucgggcaacggaucgagaauauuaagaacgaacauaaaucuacauggcacuacgacgaggauaaucccuauaagaccugggcauaccauggaagcuaugaagucaaaccuaguggcuccgccagcucuauggugaacggcgugguccgucugcuaacuaagccaugggacguuauacccauggugacgcagaucgcuaugacagacaccacuccuuuugggcagcaaagaguauucaaagagaagguggauacccgcacaccaaaggccaaaaggggaacggcacagauuauggaggucaccgccaaguggcuuugggguuuucugucacggaauaaaaagcccagaaucuguacucgcgaagaguucacaaggaaagugcgaaguaacgcugcgauuggcgccguuuuuguggacgaaaaucaguggaacuccgcaaaggaggcugucgaagaugagcgguucugggaccucgugagaagggagcgcgaacugcacaagcaggggaaaugcgcaaccugcguauacaauaugaugggaaagcgugagaaaaaguugggcgaauuugguaaagcaaaggggagccgggccaucugguauauguggcugggagcuagauuccucgaguuugaagcccuuggcuucaugaacgaggaucacugguucucuagggaaaauucgcugucaggcguugaaggggagggauuacauaaacuggguuacauauugcgcgacaucagcaagauuccgggcgggaacauguacgcggaugacacugcaggaugggauacacgaaucaccgaagaggaccuccaaaaugaggccaagauuacagauaucauggaaccugagcacgcucugcuagccacuuccauauuuaaacuuaccuaucagaacaaggugguccgggugcagagaccagccaaaaauggcacggugauggacgucauuaguaggcgcgaucagagagguucugggcaaguuggaaccuacggccugaacacauucacuaacauggaagcucagcucauccggcagauggagagcgaaggcaucuuuucccccucagagcuggagaccccuaauuuggccgggaggguguuagacuggcuggaaaagcauggaauugagcgucuccgacgcauggcuauaaguggugacgauuguguagugaaaccaaucgacgauagauucgccacagcacuuacugcgcugaacgacaugggcaagguccggaaggauauuccccagugggaaccgucuaaaggguggaaugacuggcaacaggugccuuuuugcagccaccacuuccaucagcuaaucaugaaggauggaagggagauuguugugcccugucgcaaccaggacgaacuggucggcagagcccgggugucccaaggugcuggguggucacucagggagaccgccugcuugggaaaaagcuaugcacagauguggcagcugauguacuuucaccgacgugaucuuagacuggcugccaaugcaaucuguucugccguaccaguugacugggugccuacgucccgcacaaccuggaguauacaugcgcaccaucaauggaugacuacagaggauaugcucagcgucuggaaccggguguggaucgaagagaaucccuggauggaagacaagacccacguuucguccugggaggacgugccauauuuaggcaaaagggaagaucaguggugcggcucucugauuggguugacugcuagagccaccugggcaacaaacauccaggucgccauuaaacaggugcgccggcugaucggaaaugagaacuaccucgacuauaugacgucaaugaagagguucaaaaaugagagcgaucccgaaggugcucuuugguga

SEQ ID NO: 14179 - RNA, 9879 nt, Artificial Sequence
  derived and/or modified CDS sequence (opt3) from DENV-1__JQ915071__SS-prME
agcgugaccaugcugcucaugcuucugcccaccgucuugacuuuccacuuaacgaccagaggcggggagccucauaugaucguuuccaagcaggaaaggggaaaaucucuguuauuuaagacaucagccggugugaacaugugcacucucauugcuauggaccugggcgagcuuugugaugacaccaugacauacaaaugcccacggauaaccgaaacugagccggaugacguagauuguuggugcaaugcaacagaaaccugggugacguaugggacuuguagucaaaccggagagcaccgccgagacaagcguuccgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguagaggguuugagcggcgccaccuggguugacgugguccuggagcacgggaguugugugacuacaauggcuaaggauaaacccacccuagacaucgaacuccugaagacggaggugaccaauccugccguccuuaggaaacugugcauugaagcgaagaucuccaacacaacuaccgauucucgguguccaacacaaggagaggcaacuuugguugaggaacaggacaccaauuucgugugccgccgaacauuuguagauagaggcugggguaacggguguggacucuucggcaaaggcagccugauaaccugcgccaaguuuaagugcgcuacuaaauuagaggggaagauugugcaguacgaaaaucugaaauauuccgucaucgugacgguucacacaggagaccagcaucaaguggguaacgagaccacugaacacggcaccauugccacaaucacaccccaggcaccuacuucagagauccagcucacagacuacggggcucuuacgcuggauuguaguccaaggaccggauuggacuucaaugaaaugguccuacugacuaugaaggagaaaagcuggcucgugcauaagcagugguuucuggaucuuccgcugcccuggacaaccggcgccucuacaucccaagagacuuggaaccggcaggacuugcucguaaccuucaaaacggcgcacgccaagaagcaggaaguugugguccuggguucacaagagggggcaaugcacaccgcuuuaacaggcgccacugaaauucagaccagcggaacaacuaccauauuugcuggccaucugaaaugccgucuaaagauggauaaacucacgcugaaggggaucaguuaugugauguguacaggaucuuucaaacuugagaaggaagucgccgagacccagcacgguacuguguugguucaggugaaguacgagggcacagacgcaccuugcaaaauuccauucuccagccaagaugaaaaggggguaacccagaauggacgccuggucacugccaaccccaucgugaccgacaaagagagaccuguuaauauagaagcugagccacccuuuggcgagucguauauuguggucggugcgggggaaaaggcacucaaacugucuugguucaagaagggcuccucaaucggaaaaauguuugaggccacagcuaggggcgcccggcgaauggcaauccuuggggauacggccugggacuucggaaguauugguggcguguuuaccagcguagggaagcuggugcaucagaucuucggaacugcuuacggcguuuuguuuuccggugucucuuggacaaugaaaauugggauaggcauccuccugaccugguuaggacugaacagccgcucaacaagucuauccaugacuuguauugccgugggcauggugacccucuaccugggggucaugguucaggcagauagcggaugcgugaucaauuggaagggcagagaacuuaaaugugguucugggaucuucgugacgaacgagguacacacauggaccgaacaauauaaguuucaggcggacucaccgaagagguugagugcugccauuggaaaagcaugggaggagggcgucugcgguauacggagcgccacucgccuggaaaacaucauguggaagcagauuuccaaugagcucaaccauauccuguuagaaaaugacaugaaauucaccgugguugugggcgaugucucugggauucuggcucagggaaagaaaacaaucagaccucaacccauggagcacaaguacucguggaaaagcuggggcaaggccaagauaaucggggcagacgugcagaacacuaccuuuauuaucgauggaccaaauacaccugaaugucccgacgaucagagggcuuggaacauuugggagguugaggacuauggcuucgguaucuuuacgaccaauauauggcuuaaauugcgugauuccuacacucaggugugcgaccaccggcucaugucagccgcgauuaaggauaguaaagccguacaugcugacaugggguauuggaucgaaucugagaagaacgaaacauggaaacuggcacgagccagcuucauugaggucaagaccuguguguggccaaagucccacacucuauggucaaauggagugcuggaaagcgagaugaucauacccaaaaucuacggcgguccuauuucucaacauaacuauagaccaggcuacuucacacagaccgcugggccguggcaccucggaaagcuggagcuugauuuugacuugugcgaaggcacgacugucguuguggaugagcacugcgggaauaggggacccucccugcgcaccacaaccguaacuggcaaaaucauucaugaaugguguugccggaguuguacauuaccuccacucagauucaagggugaggacgggugcugguacggaauggagaucaggcccgugaaagaaaaggaggaaaaccuggucaagagcauggugucugccggcuccggugagguugacucauuuagucuuggccuguuguguauaagcauuaugaucgaagaggugaugcgcucgcgauggucccggaaaaugcucaugaccgggacacuggucguguuccuacugcucacucugggacagcuuaccuggaaugauuugauccgucugugcauuaugguuggcgcaaacgcgucugacaauauggggaugggaacgacauauuuagcccucauggcuaccuuuagaaugaggccuauguucgccgugggccugcuuuuucgccggcugacuagcagagagguccuacuccugaccguagguuugucacugguggcaaguguugaauuaccaaacucccucgaugagcugggggacggacuugcuaugggcaucaugauucugaaguugcucacagauuuccaaucucaccagcugugggccacucuacugagccuuaccuuugugaaaacgacacucucccugcauuacgcauggaagaccauggccaugauauugucaaucgucagccuguuaccccucugucugaguacuacaucucagaaaaccacuuggcuuccggugcuguugggcucccucgggugcaagccucugacaauguuccuaauuaccgaaaacaagaucuggggaaggaaaagcuggccacugaaugaggguauuauggcuguaggcaucgugucgauacuucucucaucucuguugaagaacgacguccccuuagcggggccucugaucgccggaggcaugcucauugcauguuauguuaucagugguuccagcgcugaucugucucuugaaaaagccgccaaggugagcugggaggaggaagcugagcacuccggggcaucacauaauauucugguggaaauccaggacgauggaacgaugaaaauaaaggacgaggaacgagaugacacuauuaccaucuugcuaaaagccacacugcucgcgaucaguggcgucuaccccaugagcauuccagcuacccuguuuguguggcacuucuggcaaaagaagaaacagcgcucuggcguucuuugggauacaccuucacccccagagguagagaaggccguguuagacgacgggauauaucggauccugcagagaggacucuuggguaggagccaggucggcguggggguuuuucaagaaggaguguuccacacuauguggcaugucacccguggcgcagugcugauguaccaggguaaacgccucgagccgaguugggccagcguaaagaaagaucugauuuccuaugggggaggcuggcgguuccagggcucuuggaacacgggggaagagguccaggugaucgcuguugagccuggaaagaaucccaagaacgugcaaacagcaccagguacuuuuaaaaccucggaaggcgaggucggggccauugcgcuugacuucaagcccggaacaagcggcucaccuaucgugaauagagaagguaaaauaguugggcuguacggaaacggcguggucaccacuuccggcaccuacgugagugcuaucgcccaggcaaaggccucucaggaggggccauugcccgaaauugaggaugagguauuuaggaaacgaaaucuaacaaucauggaccugcacccuggaagcgguaagacgcggcgcuaucucccggcuauugugagagaagccaucaagaggaaauuacggacucugguucuugcaccaacccgagucguggcuuccgagauggccgaagcgcugaagggcaugcccauaagauaccaaacaaccgccgugaaaucagagcauacugggaaggaaauugucgaucucaugugccacgcaacauucaccaugcgcuugcugucuccuguaagggugccaaacuauaauaugaucaucauggacgaggcucauuuuacggaucccgccagcauugcugcacguggauacaucaguacucggguuggcaugggugaggccgccgcuauauucaugacagcgaccccuccgggguccguggaagcauuuccccagagcaacgccgucauucaggacgaggaaaaagauaucccagagagaucuuggaacucaggauaugacuggauuaccgauuucccuggcaagacugugugguuuguucccuccaucaagaguggcaacgacauagcuaauugucucaggaaaaacgggaagcgcgugauucagcugagccgaaaaacauucgacaccgaauaccaaaagaccaagaauaaugauugggacuaugucgugacuacggauaucucggagaugggagccaacuuuagagcagaccggguaaucgauccaaggcgcugccuuaagccugugauucuaaaggacggucccgagcguguuauccuggccggcccaaugccggucaccguggcuucugcggcccagagacgggggaggauuggacgcaaucagaacaaagaaggcgaucaguacauauacaugggucaaccuuugaauaacgacgaggaucacgcacacuggacagaagcuaagauguuacuggacaauaucaacacucccgaggggauuaucccagcccucuucgagcccgaacgagagaaauccgcagccaucgauggcgaauauagacugcggggagaggcuaggaagaccuucguggaacuuaugcgcagaggcgaccugccugucuggcucagcuacaaaguugccucagagggguuucaguauagugauaggcgguggugcuucgacggagagcguaauaaccagguguuggaagagaauauggacguagaaauuuggacaaaggagggugaacgcaaaaagcugcgaccaagauggcuagaugcgaggaccuacucugacccccuggcacuccgggaguuuaaggaguucgccgcuggccgcagauccgugagcucagaucuuauacuggaaaucgggaaauuaccucagcauuugacucaaagggcccagaacgcucuggacaaucucgucaugcugcacaacagugagcagggaggcaaggcauaucggcaugccauggaggaacuuccggauacgauugaaaccaucaugcugcucgcuuugauugccgugcugacaggugggguuacuuuauuuuuccuaagcggccgaggacugggcaaaaccuccaucgggcuccuuugugugacaucuagcuccgcacuguuguggauggcgaaugucgagccacacuggauagccgcuucaaucauucuggaguuuuuccucaugguacugcuuauccccgaaccugacagacagcgcacaccccaagauaaccagcucgccuacgugguuauuggacuguuguuuaugauccugacuguggcagcuaacgagauggguuuacuagaaacaacgaagaaagaccugggcauagggcacaccgccgcagagaaucaucaccaugccgcuaugcucgaugucgaccuucacccagcgucugccuggacucuguaugcaguggcuacaaccauuaucaccccuaugaugaggcauacaauugagaacacuacggccaauaucaguuugaccgccauagcaaaccaggcugccauccugaugggacucgauaagggcuggcccauuucgaagauggacaucggugucccacugcuugcguuagggugcuacagccaagugaauccucugacacucacugcugccguuuugaugcugguggcacacuacgccauuaucggcccgggacuacaggcuaaagcaacccgggaagcccagaagcguacagcggcuggcauaaugaaaaaccccaccguagaugggauuguggccaucgaccuggacccagucguuuaugaugcaaaguucgagaaacagcucggacaaaucaugcuucugauuuuguguacuucccagauccugcucaugagaacgacaugggcccugugcgaaucuauaaccuuagcuacuggcccucuuaccacacugugggaggguucacccgggaaguuuuggaauacuaccauugccgugagcauggcaaacaucuucaggggauccuaccucgcuggcgccggucuagcguuuagucugaugaagucuuugggcgggggacgccggggcacaggggcccagggagaaacgcugggcgagaaauggaagcgacagcucaaucaacuuagcaaaucagaguucaacaccuauaagagauccgguauuaucgaagucgacaggagugaggcacgcgaagggcugaaacggggagagacuacaaagcacgcugugagcagaggcaccgccaaguugcguugguucguagaaaggaaucuggugaaaccagaggguaagguuauagaucucggcugugggcggggaggcuggucuuacuauugcgcagggcugaaaaaggugacugaggucaaaggauacacaaagggcgguccugggcaugaggagcccaucccgauggcuaccuauggauggaaccuagugaaacuucacuccggcaaggacgucuuuuucauuccaccugaaaagugugauacgcugcuaugcgacaucggcgagucaagccccaauccaaccauugaagaggggcgcacacuccgagugcugaaaaugguugagcccugguugagaggaaaccaguuuuguaucaagauucugaauccuuacaugccgucgguaguggaaacucucgagcagaugcagaggaaacaugguggcaugcuuguccggaacccccugucucgcaauaguacccacgaaauguacuggguguccugcgggacaggaaacaucguuagcgccgugaacaugacuucaagaauguuacugaauagguucaccauggcccaccgaaagccaacauaugagcgggaugucgacuugggcgcggguacccgucauguggcuguagagccugaaguggcaaaccucgauauaauugggcaaagaaucgagaauaucaaaaacgaacacaaguccacuuggcauuacgacgaggauaaucccuauaagacgugggccuaccacggaucuuaugaaguuaaaccuagcggcagugcuuccagcauggucaacggcguggugcgccugcuaacaaagccaugggacgucauucccaugguuacccagauagccaugacugacaccacaccuuuugggcagcaaaggguguucaaagagaagguagauacgcggaccccaaaagcaaagagaggaacugcccagaucauggaggugacagcuaaguggcuuugggguuuucugucucgcaauaaaaagcccaggauuuguacccgagaagaguucacucggaaagucagaucaaacgcggccaucggcgcaguguuuguugacgaaaaucaguggaacagugcuaaggaggccguggaagaugagagguucugggaccucguccgccgugagcgggaacugcauaaacaggggaagugcgcaacaugcguguacaauaugaugggaaagagagagaaaaaguugggcgaauuugguaaagccaagggguccagggcuauuugguauauguggcugggagcccgcuuccucgaguuugaagcgcuuggcuucaugaacgaggaucacugguucagccgagaaaauucucugucgggcguagaaggggagggauuacacaaacuggguuacaucuugcgggacauaucaaagaucccgggcgggaacauguacgcagaugacaccgccggaugggauacaagaauuacugaagaggaccuccaaaaugaggcuaaaaucaccgauauuauggaaccugagcaugcccugcuagcaacgagcaucuuuaaacuuaccuaucagaacaagguugugaggguccagcgcccagcuaaaaacggcacagugauggacgugauauccagacgggaucagagggguagugggcaagucggaacuuacggccugaauaccuucacaaacauggaagcccagcucauucgucagauggagucugaaggcaucuuuagccccuccgagcuggagacuccuaauuuggcugggcgaguuuuagacuggcuggaaaagcacggaaucgagcgccucagacggauggccauuucaggugacgauugugugguaaaaccaauagacgauagguucgcaaccgcgcuuacggcccugaacgacaugggcaaggugcgcaaagauaucccccagugggaaccgaguaagggguggaaugacuggcaacaggucccuuuuugcucucaucacuuccaccagcuaauuaugaaggauggaagagagaucgugguucccugucggaaccaggacgaacuggugggcagggcucgagucagccaaggugccggguggucccuccgugagacagcaugcuugggaaaaucauaugcucagauguggcagcugauguacuuucauagacgcgaucuucggcuggccgcaaaugccauuuguagcgcggugccaguagacuggguuccuaccucuaggacuacaugguccauccacgcucaucaccaauggaugaccacugaggauaugcucaguguguggaacagagucuggauagaagagaaucccuggauggaagacaagacccaugugagcucgugggaggacguuccauauuuaggcaaacgcgaagaucaguggugcggcucccugaucggguugacagcccgggcaacgugggccaccaacauucagguggcuaucaaucaggucaggcgacugauuggaaacgagaauuaccucgacuauaugacuucuaugaagagauucaaaaacgagucagaucccgaaggugcccuuugguga

SEQ ID NO: 14180 - RNA, 9879 nt, Artificial Sequence
  derived and/or modified CDS sequence (opt3) from DENV-1__JQ915073__SS-prME
agcgugaccaugcugcucaugcuucugcccaccgucuugacuuuccacuuaacgaccaggggcggggagccucauaugaucguuuccaagcaggaaaggggaaaaucucuguuauuuaagacaucagcuggugugaacaugugcacucucauugcaauggaccugggcgagcuuugugaugacaccaugacauacaaaugcccgcggauaaccgaaacugagccggaugacguagauuguuggugcaaugcaacagaaaccugggugacguaugggacuuguuuccaaaccggagagcaccgccgagacaagcguagugucgcccuggcgccccaugugggcuugggucucgagacaagaacugaaaccuggaugagcuccgagggggcuuggaggcagauccagaaaguugaaacaugggcccugcggcacccuggauuuaccgugauugcacuguuccucgcccaugcuaucggcacgucuauuacucagaagggcaucauauuuaucuuacugaugcuugucacaccaucgauggcaaugcgcugcguggggauuggaaacagagauuucguagaggguuugucaggcgccaccuggguugacgugguccuggagcacgggagcugugugacuacaauggcuaaggauaaacccaccuuggacaucgaacuccugaagacggaggugaccaauccugccguccuuaggaaacugugcauugaagcgaagaucaguaacacaacuaccgauucccgguguccaacacaaggagaggcaacuuugguugaagaacaagacaccaauuuugugugccgccgaacauucguagauagaggcugggguaacggguguggacucuuuggcaaaggcucucugauaaccugcgccaaguucaagugcgugacuaaauuagaggggaagauuguccaguacgaaaaucugaaauauagcgugaucguuacggugcacacaggagaccagcaucaagucgguaacgagaccacugaacacggcaccauugcuacaaucacaccccaggccccuacuuccgagauccagcucacagacuacggggcacuuacgcuggauuguucaccaaggaccggauuggacuuuaaugaaauggugcuacugacuaugaaggagaaaaguuggcucguacauaagcagugguuccuggaucuuccgcugcccuggacaaccggcgcuagcacaucucaagagacuuggaaccggcaggacuugcucguuaccuuuaaaacggcccacgcgaagaagcaggaaguggucgugcuggguucccaagagggggccaugcacaccgcauuaacaggcgcuacugaaauucagaccucaggaacaacuaccauauucgccggccaucugaaaugccgucuaaagauggauaaacucacgcugaaggggaucagcuaugucauguguacaggaaguuucaaacuugagaaggaaguggcugagacccagcacgguacuguuuuggugcagguaaaguacgagggcacagacgccccuugcaaaauuccauuuucuucccaagaugaaaagggggucacccagaauggacgccuggugacugcaaaccccaucguuaccgacaaagagaagccugugaauauagaagccgagccacccuucggcgagagcuauauugucgugggugcuggggaaaaagcgcucaagcugucgugguuuaagaaaggaucuuccaucggaaagauguucgaggcaacagccagaggcgcuaggcggauggccauccuuggggauacggcaugggacuuuggaucaauugguggcguauucaccaguguggggaaacugguucaucagaucuuuggaacugccuacggcgucuuguucagcgguguguccuggacaaugaagauugggauaggcauccuccugaccugguuaggacugaacucucgaagcacaucacuaaguaugacuuguauugcugugggcauggucacccucuaccuggggguuauggugcaggccgauuccggaugcgugaucaauuggaaaggccgcgaacuuaagugugguagcgggaucuuuguaacgaacgagguccacacauggaccgaacaauauaaguuccaggcagacucuccgaaaagauugucagcggcuauuggaaaggccugggaggagggcgugugcgguauaaggagugcaacucggcuggaaaacaucauguggaaacagauuagcaaugagcucaaccauauccuguuagaaaaugacaugaaguuuaccguuguggucggcgauguguccgggauucuggcccagggcaagaaaacaauccgcccucaacccauggagcacaaauacucuuggaagucguggggcaaggcuaaaauaaucggggccgacguucagaacacuaccuucauuaucgauggaccaaauacaccugaaugucccgacgaucagagagcauggaacauuugggagguggaggacuauggcuuugguaucuucacgaccaauauauggcuuaaguugagggauagcuacacucagguaugcgaccaccgucucauguccgcugccauuaaagauucaaaggcgguccaugccgacaugggguauuggaucgaaagugagaaaaacgaaacauggaagcuggcucgggcaucuuucauugaggugaagaccuguguguggccaaaaagccacacucuaugguccaauggaguccuggaaucagagaugaucauacccaagaucuacggcgguccuauuagccaacauaacuaucgaccaggcuacuuuacacagaccgccgggccguggcaccucggaaaacuggagcuugauuucgacuugugcgaaggcacgacuguugugguagaugagcacugcgggcauagaggacccucucugaggaccacaaccgugacuggcaagaucauucacgaaugguguugccgcuccuguacauuaccuccacuccgguuuaaaggugaggacgggugcugguacggaauggagaucagacccgucaaggaaaaggaggaaaaucuggugaaaaguaugguuagcgcuggcucuggugagguggacuccuucucacuuggccuguuguguauaaguauuaugaucgaagaggucaugaggagccgcuggucgcgaaagaugcucaugaccgggacacuggugguuuuucuacugcucacucugggacagcuuaccuggaacgauuugauccggcugugcauuauggugggcgccaaugcauccgacaacauggggaugggaacgacauauuuagcgcucauggccaccuuccguaugagaccuauguuugcugucggccugcuuuucaggcgccugacuucucgggagguacuacuccugaccguggguuugagccugguugccucaguggaauuaccaaauagucucgaugagcugggggacggacuugcaaugggcaucaugauucugaaauugcucacagauuuucaaucccaucagcugugggcuacucuacugucucuuaccuucgucaagacgacacucagccugcacuacgccuggaaaaccauggcaaugauauuguccaucgugucacuguuaccccucugucugagcacuacaagucagaagaccacuuggcuuccgguacuguugggcucucucgggugcaagccucugacaauguuucuaauuaccgaaaacaaaaucuggggaagaaaguccuggccacugaacgaggguauuauggccgugggcaucgucagcauacuucucucgucacuguugaaaaaugacguucccuuagcugggccucugaucgcgggaggcaugcucauugccuguuaugugaucucugguaguuccgcagaucugagccuugaaaaggcugccaaagugucuugggaggaggaagccgagcauagcggggcuucccacaacauucuggucgaaauccaggacgauggaacgaugaagauaaaagacgaggaaagggaugacacuauuaccaucuugcuaaaggcaacacugcucgccaucucaggcguguaccccaugaguauuccagcgacccuguucguuuggcacuuuuggcaaaagaaaaagcagcgaagcggcguacuuugggauacaccuucucccccagagguggagaaagcugucuuagacgacgggauauaucgcauccugcagcggggacucuuggguagaucccaggugggcguugggguguuccaagaaggagucuuccauacuauguggcacgugaccaggggcgccguacugauguaccaggguaagcgucucgagccgucaugggcaagugucaaaaaggaucugauuagcuaugggggaggcuggcgcuuucagggcuccuggaauacgggggaagaggugcagguuaucgccguggagccuggaaagaaccccaaaaauguccaaacaacuccagguaccuucaagacaucugaaggcgaggugggggcuauugcacuugacuuuaaacccggaaccucgggcagcccuaucguuaaccgggaagguaagauaguggggcuguacggaaauggcgucgugacuaccucaggcacauacguauccgccaucgcgcaggcuaaagccagucaggaggggccauugcccgaaauugaggaugagguguucagaaagaggaaccuaacgaucauggaccugcauccuggaucugguaagacucgacgguaucucccggcaauuguucgcgaagccaucaaaagaaaguuaaggacccugguccuugcuccaacacgggugguggccagcgagauggcagaagcucugaaaggcaugcccauacgauaccaaaccacugccgucaaguccgagcacacagggaaagaaauuguagaucucaugugccaugcgaccuuuacgaugagauugcugucaccugugcgcguuccaaauuauaacaugaucaucauggacgaggcccacuucacugaucccgcaucuauugcugccaggggauacaucagcacacgugugggcaugggugaggcugcagccauauuuaugaccgccaccccuccggggagugcugaagcguucccccaguccaaugcagucauucaggacgaggaaaaggauaucccagagcggagcuggaacucuggauaugacuggauuacugauuuuccuggcaagacagugugguucguucccucaaucaaauccggcaaugacauagccaacugucucagaaagaaugggaaaagggugauucagcugagucgcaagaccuuugacacagaauaccagaaaacuaagaacaacgauugggacuaugucgugacgaccgauaucagcgagaugggagcuaauuuccgagccgacagaguaaucgauccacggaggugccuuaagccugugauucuaaaagacggucccgagcgcguuauccuggcaggcccaaugccggucacaguggccucggcugcgcagcguagagggcggauuggaaggaaccagaauaaggaaggcgaucaguacauauacaugggucaaccuuugaacaaugacgaggaucacgcccauuggacugaagcaaaaauguuacuggacaacaucaauacccccgaggggauuaucccagcucucuucgagcccgaacgcgagaagucugccgcaaucgauggcgaauaucgacugagaggagaggcccggaaaacauuuguggaacuuaugaggcgcggcgaccugccugucuggcucuccuacaagguugcuagcgagggguuccaguauucagauagaagguggugcuuugacggagagcggaacaaucagguguuggaagagaacauggacguagaaauuuggaccaaagagggugaacguaagaagcugcgcccacgauggcuagaugccagaacuuacagugacccccuggcgcucagggaguucaaagaguuugcagccggccggcgcucuguguccggggaucuuauacuggaaaucggaaaguuaccucagcacuugacgcaaagagcucagaaugcccuggacaaccucgucaugcugcauaauagcgagcagggcgguaaggcuuauaggcacgcaauggaggaacuuccggauaccauugaaacaaucaugcugcucgccuugauugcugugcugacugggggcguuaccuuauucuuucuaucaggacggggccuggggaagacaaguaucggacuccuuugugugaccagcuccucugcccuguuguggauggcaagcgucgagccacacuggauagcggccuccaucauucuggaguucuuucucaugguacugcuuauccccgaaccugaccgacagagaacuccccaagauaaccagcucgcuuacgugguuauuggucuguuguucaugauccugacaguggccgcaaaugagaugggcuuacuagaaacgaccaaaaaggaccuggggauaggacauacugcugccgagaaccaccaucacgcagccaugcucgaugucgaccuucauccagcuucagcguggacacuguaugccguggcaaccaccauuaucacaccuaugaugcgccacacuauugagaacacgaccgcuaauaucucuuugacagccauagccaaccaggcagcuauccugaugggccucgauaaggguuggcccauuaguaaaauggacaucggggucccacugcuugccuuaggcugcuacucgcaagugaauccucugacucucaccgcggcuguuuugaugcugguggcccacuacgcaauuaucggaccgggccuacaggccaaggcuacaagggaagcacagaaacggaccgccgcggggauaaugaagaaccccacuguagauggaauuguggcuaucgaccuggacccagucguuuaugaugccaaauuugagaagcagcucggccaaaucaugcuucugauuuuguguacgagccagauccugcucaugcguacaaccugggcacugugcgaauccauaacuuuagccaccgguccucuuacaacucugugggaggggucucccggaaaguucuggaauaccacaauugcugugucaauggccaacaucuuuagaggcagcuaccucgccggugcuggccuagccuucucccugaugaaaagucuagggggaggcaggcgcgggacgggagcgcagggcgaaacccugggugagaaguggaaacggcagcucaaucaacuuucuaagagcgaguucaacacuuauaaacgaucagggauuaucgaagucgacagauccgaggccaaggaaggacugaagaggggcgagacaaccaaacaugcagugagucgcgguacugcuaaguugcggugguuuguagaaagaaaucuggugaaaccagagggcaagguuauagaucucggguguggacguggcggguggagcuacuauugcgccggacugaaaaaggugacagaggucaaaggcuacaccaagggugggccuggacacgaggaacccaucccgauggcaacguauggcuggaaccuagugaaacuucauucuggcaaagacgucuucuuuauuccaccugaaaagugugauacccugcuaugcgacaucggggaguccucacccaauccaacaauugaagagggaaggacucuccgggugcugaaaaugguugagcccugguugcgcgguaaccaguucuguaucaagauucugaauccuuacaugccgagcguaguggaaacccucgagcagaugcagcgaaaacacggcgggaugcuugucagaaacccccugucgagaaauucuacacacgaaauguacugggugaguugcggaacuggcaacaucguuuccgcugugaauaugaccagccggauguuacugaaccgcuuuacaauggcccauagaaagccaaccuaugagagggaugucgacuugggugccgggacucgacacguggcgguagagccugaaguggcuaaccucgauauaauuggacaacggaucgagaauaucaagaacgaacauaaaucaacguggcacuacgacgaggauaaucccuauaagacaugggcauaccauggcuccuaugaaguuaaaccuucuggcagcgccaguuccauggucaacgggguggugcgucugcuaaccaagccaugggacgucauucccaugguuacucagauagcuaugaccgacacaacgccuuucggacagcaaagaguguuuaaagagaagguagauacccgcacuccaaaggccaaaagggguacagcacagaucauggaggugaccgccaaguggcuuuggggcuuccugagccggaauaaaaagcccagaauuuguacucgcgaagaguuuacaaggaaaguccgaucuaacgcugcgaucggggccguguucguugacgaaaaucaguggaacucagcaaaggaggcuguggaagaugagcgguuuugggaccucgucagaagggagcgcgaacugcacaagcagggaaaaugcgcaaccugcguguacaauaugaugggcaagcgugagaaaaaguugggugaguucgggaaagcaaagggaagucgggccauuugguauauguggcugggcgcuagauuucucgaguucgaagcccuuggcuucaugaacgaggaucacugguuuuccagggagaauagccugucugggguagaaggagaggguuuacauaaacugggcuacaucuugcgcgacauaucgaagaucccagggggaaacauguacgcggaugacacagcaggcugggauacucgaauuaccgaagaggaccuccaaaaugaggccaagaucacggauauuauggaaccugagcacgcucugcuagccaccucaaucuucaaacuuacauaucagaacaagguugugcggguccagagaccagccaaaaaugguacugugauggacgugauaagcaggcgcgaucagagaggguccggacaagucggcaccuacggccugaacacauuuacuaacauggaagcucagcucauucggcagauggagagugaagggaucuucucucccagcgagcuggagaccccuaauuuggccggaaggguuuuagacuggcuggaaaagcaugguaucgagcgucuccgacgcauggcuauuuccggcgacgauugugugguaaaaccaauagacgauagauuugccacggcacuuacagcgcugaacgacauggggaaggugcggaaggauaucccccagugggaaccgucaaaaggauggaaugacuggcaacaggucccuuucugcagucaccacuuucaucagcuaauuaugaaggauggcagggagaucgugguucccugucgcaaccaggacgaacugguggguagagcccgggucucucaaggggcuggauggagccucagggagaccgccugcuugggcaaauccuaugcacagauguggcagcugauguacuuccaccgacgugaucuuagacuggcugccaaugcaauuuguucagccgugccaguagacuggguuccuacuagccgcacaaccuggucuauccaugcgcaccaucaauggaugacuaccgaggauaugcucuccguguggaaccgggucuggauagaagagaaucccuggauggaagacaagacacacgugaguagcugggaggacguuccauauuuaggcaaaagggaagaucaguggugcgggucgcugaucggauugacggcuagagccaccugggcaacuaacauucagguggccaucaaucagguccgccggcugauugguaacgagaauuaccucgacuauaugacauccaugaagagguuuaagaacgagucugaucccgaaggcgcucuuugguga

SEQ ID NO: 14181 - RNA, 9879 nt, Artificial Sequence
  derived and/or modified CDS sequence (opt3) from DENV-1__JQ915075__SS-prME
agcgugaccaugcugcucaugcuucugcccaccgucuugacuuuccacuuaacgaccagaggcggggagccucauaugaucguuuccaagcaggaaaggggaaaaucucugcuauuuaagacaucagccggugugaauaugugcacucucauugcuauggaccugggcgagcuuugugaugacaccaugacauacaaaugcccacggauaaccgaaacugagccggaugacguagauuguuggugcaaugcaacagaaaccugggugacguaugggacuuguagucaaaccggagagcaccgccgagacaagcguuccgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguagaggguuugagcggcgccaccuggguugacgugguccuggagcacgggaguugugugacuacaauggcuaaggauaaacccacccuagacaucgaacuccugaagacggaggugaccaauccugccguccuuaggaaacugugcauugaagcgaagaucuccaacacaacuaccgauucucgguguccaacacaaggagaggcaacuuugguugaggaacaggacaccaauuucgugugccgccgaacauuuguagauagaggcugggguaacggguguggacucuucggcaaaggcagccugauaaccugcgccaaguuuaagugcgcuacuaaauuagaggggaagauugugcaguacgaaaaucugaaauauuccgucaucgugacgguucacacaggagaccagcaucaaguggguaacgagaccacugaacacggcaccauugccacaaucacaccccaggcaccuacuucagagauccagcucacagacuacggggcucuuacgcuggauuguaguccaaggaccggauuggacuucaaugaaaugguccuacugacuaugaaggagaaaagcuggcucgugcauaagcagugguuucuggaucuuccgcugcccuggacaaccggcgccucuacaucccaagagacuuggaaccggcaggacuugcucguaaccuucaaaacggcgcacgccaagaagcaggaaguugugguccuggguucacaagagggggcaaugcacaccgcuuuaacaggcgccacugaaauucagaccagcggaacaacuaccauauuugcuggccaucugaaaugccgucuaaagauggauaaacucacgcugaaggggaucaguuaugugauguguacaggaucuuucaaacuugagaaggaagucgccgagacccagcacgguacuguguugguucaggugaaguacgagggcacagacgcaccuugcaaaauuccauucuccagccaagaugaaaaggggguaacccagaauggacgccuggucacugccaaccccaucgugaccgacaaagagagaccuguuaauauagaagcugagccacccuuuggcgagucguauauuguggucggugcgggggaaaaggcacucaaacugucuugguucaagaagggcuccucaaucggaaaaauguuugaggccacagcuaggggcgcccggcgaauggcaauccuuggggauacggccugggacuucggaaguauugguggcguguuuaccagcguagggaagcuggugcaucagaucuucggaacugcuuacggcguuuuguuuuccggugucucuuggacaaugaaaauugggauaggcauccuccugaccugguuaggacugaacagccgcucaacaagucuauccaugacuuguauugccgugggcauggugacccucuaccugggggucaugguucaggcagauagcggaugcgugaucaauuggaagggcagagaacuuaaaugugguucugggaucuucgugacgaacgagguacacacauggaccgaacaauauaaguuucaggcggacucaccgaagagguugagugcugccauuggaaaagcaugggaggagggcgucugcgguauacggagcgccacucgccuggaaaacaucauguggaagcagauuuccaaugagcucaaccauauccuguuagaaaaugacaugaaauucaccgugguugugggcgaugucucugggauucuggcucagggaaagaaaacaaucagaccucaacccauggagcacaaguacucguggaaaagcuggggcaaggccaagauaaucggggcagacgugcagaacacuaccuuuauuaucgauggaccaaauacaccugaaugucccgacgaucagagggcuuggaacauuugggagguugaggacuauggcuucgguaucuuuacgaccaauauauggcuuaaauugcgugauuccuacacucaggugugcgaccaccggcucaugucagccgcgauuaaggauaguaaagccguacaugcugacaugggguauuggaucgaaucugagaagaacgaaacauggaaacuggcacgagccagcuucauugaggucaagaccuguguguggccaaagucccacacucuauggucaaauggagugcuggaaagcgagaugaucauacccaaaaucuacggcgguccuauuucucaacauaacuauagaccaggcuacuucacacagaccgcugggccguggcaccucggaaagcuggagcuugauuuugacuugugcgaaggcacgacugucguuguggaugagcacugcgggaauaggggacccucccugcgcaccacaaccguaacuggcaaaaucauucaugaaugguguugccggaguuguacauuaccuccacucagauucaagggugaggacgggugcugguacggaauggagaucaggcccgugaaagaaaaggaggaaaaccuggucaagagcauggugucugccggcuccggugagguugacucauuuagucuuggccuguuguguauaagcauuaugaucgaagaggugaugcgcucgcgauggucccggaaaaugcucaugaccgggacacuggucguguuccuacugcucacucugggacagcuuaccuggaaugauuugauccgucugugcauuaugguuggcgcaaacgcgucugacaauauggggaugggaacgacauauuuagcccucauggcuaccuuuagaaugaggccuauguucgccgugggccugcuuuuucgccggcugacuagcagagagguccuacuccugaccguagguuugucacugguggcaaguguugaauuaccaaacucccucgaugagcugggggacggacuugcuaugggcaucaugauucugaaguugcucacagauuuccaaucucaccagcugugggccacucuacugagccuuaccuuugugaaaacgacacucucccugcauuacgcauggaagaccauggccaugauauugucaaucgucagccuguuccccuuaugucucaguacuacaucucagaaaaccacuuggcugccggugcuucugggcuccuuggggugcaagccucucacaauguuucugauuaccgaaaacaagaucuggggaaggaaaagcuggccacuaaaugaggguauuauggcuguaggcaucgugucgauacugcuuucaucucuccugaagaacgacguccccuuggcggggccuuuaaucgccggaggcaugcugauugcauguuauguuaucagugguuccagcgcugaucucucucuggaaaaagccgccaaggugagcugggaggaggaagcugagcacuccggggcaucacauaauauucuuguggaaauccaggacgauggaacgaugaaaauaaaggacgaggaacgagaugacacuauuaccauccuguugaaagccacacuacuggcgaucaguggcgucuaccccaugagcauuccagcuacccucuucguguggcacuuuuggcaaaagaagaaacagcgcucuggcguucugugggauacaccuucacccccagagguagagaaggccgugcuugacgacgggauauaucggaucuuacagagaggacugcucgguaggagccaggucggcguggggguuuuccaagaaggaguguuccacacuauguggcaugucacccguggcgcaguguugauguaccaggguaaacgccuggagccgaguugggccagcguaaagaaagaucucauuuccuaugggggaggcuggcgguuucagggcucuuggaacacgggggaagagguccaggugaucgcuguugagccuggaaagaaucccaagaacgugcaaacagcaccagguauuuucaaaacuucggaaggcgaggucggggccaucgcgcuggacuuuaagcccggaaccagcggcucaccuauagugaauagagaagguaaaaucguugggcuuuacggaaacggcguggucacaaccuccggcacuuacgugagugcuauugcccaggcaaaggccucucaggaggggccacugcccgaaaucgaggaugagguauucaggaaacgaaauuugaccauuauggaccuacacccuggaagcgguaagacacggcgcuaucugccggcuaucgugagagaagccauaaagaggaaacuccggacguuaguucuggcaccaacucgagucguggcuuccgagauggccgaagcgcuuaagggcaugcccauuagauaccaaaccacagccgugaaaucagagcauaccgggaaggaaaucgucgaucugaugugccacgcaacuuuuacaaugcgccucuugucuccuguaagggugccaaacuauaauaugaucauuauggacgaggcucauuucaccgaucccgccagcaucgcugcacguggauacauaaguacgcggguuggcaugggugaggccgccgcuauuuuuaugacugcgacaccuccgggguccguggaagcauucccccagagcaacgccgucauccaggacgaggaaaaagauauuccagagagaucuuggaacucaggauaugacuggaucaccgauuuuccuggcaagaccgugugguucguucccuccauaaagaguggcaacgacauugcuaauugucugaggaaaaacgggaagcgcgugauccagcucagccgaaaaacuuuugacacagaauaccaaaagaccaaaaacaaugauugggacuaugucgugacaacugauaucucggagaugggagccaacuucagagcagaccggguaauugauccaaggcgcugccugaagccugugauccuuaaggacggucccgagcguguuauucuagccggcccaaugccggucacgguggcuucugcggcccagagacgggggaggauaggacgcaaucagaacaaagaaggcgaucaguacaucuacaugggucaaccucugaauaacgacgaggaucacgcacacuggaccgaagcuaagauguuguuagacaauauuaacacacccgaggggaucaucccagcccuguucgagcccgaacgagagaaauccgcagccauugauggcgaauauagacuccggggagaggcuaggaagacuuuuguggaacugaugcgcagaggcgaccuuccugucuggcugagcuacaaaguugccucagagggguuccaguauagugauaggcgguggugcuuugacggagagcguaauaaccaggugcucgaagagaauauggacguagaaauauggaccaaggagggugaacgcaaaaaguugcgaccaagauggcuggaugcgaggacauacucugacccccuagcacugcgggaguucaaggaguuugccgcuggccgcagauccgugagcucagaucucauccuugaaauugggaaacugccucagcauuuaacccaaagggcccagaacgcuuuggacaaucuggucaugcuccacaacagugagcagggaggcaaggcauaucggcaugccauggaagaacugccggauacuaucgaaacgauuaugcuucuggcucucaucgccguguugaccggugggguuacacuguucuuuuuaagcggccgaggacuaggcaaaacuuccauagggcugcucugugugaccucuagcuccgcacuucuguggauggcgaaugucgagccacacuggaucgccgcuucaauuaucuuggaguucuuucugaugguacuccugauucccgaaccugacagacagcgcacaccccaagauaaccagcuugccuacgugguuaucggacuccuguucaugauauugaccguggcagcuaacgagaugggucuguuagaaacuacaaagaaagaccuaggcauugggcacacggccgcagagaaucaucaccaugccgcuaugcuggaugucgaccuccacccagcgucugccuggacccuuuaugcaguggcuacuacaaucauuaccccuaugaugaggcauaccaucgagaacacaacugccaauauaagucugacggccauggcaaaccaggcugccaucuugaugggacuggauaagggcuggcccauuucgaagauggacaucggugucccacuccuggcgcuugggugcuacagccaagugaauccuuuaacccugacagcugccguucucauguugguggcacacuacgccauuaucggcccgggacugcaggcuaaagcaacucgggaagcccagaagcguaccgcggcuggcauaaugaaaaaccccacaguagaugggauuguggccaucgaccuagacccagucguuuaugaugcaaaguuugagaaacagcugggacaaaucaugcuccuuauucuguguaccucccagaucuugcugaugagaacuacgugggcccucugcgaaucuauaacacuggcuaccggcccuuuaacuacccuuugggaggguucacccgggaaguucuggaauacaacuauugccgugagcauggcaaacaucuuuaggggauccuaccuggcuggcgccggucucgcguucagucuaaugaagucucugggcgggggacgccggggcaccggggcccagggagaaacauugggcgagaaauggaagcgacagcugaaucaacucagcaaaucagaguucaacacguauaagagauccgguauuaucgaagucgacaggagugaggcacgcgaagggcuuaaacggggagagaccacuaagcacgcugugagcagaggcacagccaagcugcguugguuuguagaaaggaauuuggugaaaccagaggguaagguuauagaucugggcugugggcggggaggcuggucuuacuauugcgcagggcucaaaaaggugaccgaggucaaaggauacacuaagggcgguccugggcaugaggaacccaucccgauggcuacauauggauggaacuuagugaaacugcacuccggcaaggacgucuucuuuauuccaccugaaaagugugauacccuucugugcgacaucggcgagucaagccccaauccaacgauugaagaggggcgcacccuacgagugcucaaaaugguugagcccuggcugagaggaaaccaguucuguaucaagauuuugaauccuuacaugccgucgguaguggaaacacuggagcagaugcagaggaaacaugguggcaugcucguccggaacccccuuucucgcaauaguacucacgaaauguacuggguguccugcgggaccggaaacaucguuagcgccgugaacaugacaucaagaaugcuguuaaauagguuuacuauggcccaccgaaagccaaccuaugagcgggaugucgaccugggcgcggguacacgucauguggcuguagagccugaaguggcaaacuuggauauaauugggcaaagaaucgagaauaucaaaaacgaacacaaguccaccuggcauuacgacgaggauaaucccuauaagacuugggccuaccacggaucuuaugaaguuaaaccuagcggcagugcuuccagcauggucaacggcguggugcgccuccugacgaagccaugggacgucauucccaugguuacacagauagccaugaccgacacuaccccuuucgggcagcaaaggguguuuaaagagaagguagauacacggacgccaaaagcaaagagaggaaccgcccagaucauggaggugacugcuaaguggcuaugggguuuccuuucucgcaauaaaaagcccaggauuuguacacgagaagaguuuacccggaaagucagaucaaacgcggccaucggcgcaguguucguugacgaaaaucaguggaacagugcuaaggaggccguggaagaugagagguuuugggaccugguccgccgugagcgggaacuccauaaacaggggaagugcgcaacuugcguguacaauaugaugggaaagagagagaaaaagcugggcgaguucgguaaagccaagggguccagggcuauuugguauaugugguugggagcccgcuuucuggaguucgaagcgcucggcuucaugaacgaggaucacugguuuagccgagaaaauucucuuucgggcguagaaggggagggacugcacaaauuagguuacauccugcgggacauaucaaagaucccgggcgggaacauguacgcagaugacacagccggaugggauaccagaauuacagaagaggacuugcaaaaugaggcuaaaaucacugauauuauggaaccugagcaugcccuccuggcaaccagcaucuucaagcuaacguaucagaacaagguugugaggguccagcgcccagcuaaaaacggcaccgugauggacgugauauccagacgggaucagagggguagugggcaagucggaacauacggccuuaauacuuuuaccaacauggaagcccagcugauucgucagauggagucugaaggcaucuucagccccuccgagcucgagacaccuaaucuggcugggcgaguuuuggacugguuagaaaagcacggaaucgagcgccugagacggauggccauuucaggugacgauugugugguaaaaccaauagacgauagguuugcaacugcgcucaccgcccuuaacgacaugggcaaggugcgcaaagauaucccccagugggaaccgaguaagggguggaaugacuggcaacaggucccuuucugcucucaucacuuucaccagcugauuaugaaggauggaagagagaucgugguucccugucggaaccaggacgagcuagugggcagggcucgagucagccaaggugccggguggucccugcgugagacggcaugccucggaaaaucauaugcucagauguggcaguugauguacuuccauagacgcgaucugcggcuugccgcaaaugccauuuguagcgcggugccaguagacuggguuccuacaucuaggaccacuugguccauccacgcucaucaccaauggaugacaaccgaggauaugcugaguguguggaacagagucuggauagaagagaaucccuggauggaagacaagacucaugugagcucgugggaggacguuccauaucucggcaaacgcgaagaucaguggugcggcuccuuaaucgggcugaccgcccgggcaacaugggccacgaacauucagguggcuaucaaucaggucaggcgauugauuggaaacgagaauuaccuggacuauaugaccucuaugaagagauuuaaaaacgagucagaucccgaaggugcccucugguga

SEQ ID NO: 14182 - RNA, 9879 nt, Artificial Sequence
  derived and/or modified CDS sequence (opt3) from DENV-1__JQ915076__SS-prME
uccgugaccaugcugcucaugcuucugcccaccgucuugacuuuccacuuaacgaccagaggaggggagccucauaugaucguuuccaagcaggaaaggggaaaaucucuguuauuuaagacaucagccggugugaacaugugcacucucauugcuauggaccugggcgagcuuugugaugacaccaugacauacaaaugcccacggauaaccgaaacugagccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguugaggguuugagcggcgccaccuggguugacgugguccuggagcacgggaguugugugacuacaauggcuaaggauaaacccaccuuggacaucgaacuccugaagacggaggugaccaauccugccguccuuaggaaacugugcauugaagcgaagaucuccaacacaacuaccgauucucgguguccaacacaaggagaggcaacuuugguugaggaacaagacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaaccggcgcuucuacaucccaagagacuuggaaccggcaggacuugcucguuaccuucaaaacggcccacgcgaagaagcaggaaguggucgugcuggguucacaagagggggccaugcacaccgcauuaacaggcgcuacugaaauucagaccagcggaacaacuaccauauuugccggccaucugaaaugccgucuaaagauggauaaacucacgcugaaggggaugaguuaugucauguguacaggaucuuucaaacuugagaaggaaguggcugagacccagcacgguacuguuuuggugcagguaaaguacgagggcacagacgccccuugcaaaaucccauucuccagccaagaugaaaagggggucacccagaauggacgccuggugacugcaaaccccauuguuaccgacaaagagaagccugugaauaucgaagccgagccacccuuuggcgagucguauauagucgugggugcuggggaaaaagcgcucaagcugucuugguucaagaaaggcuccucaauuggaaagauguuugaggcaacagccagaggcgcuaggcggauggccauccuuggggauacggcaugggacuucggaaguaucgguggcguauuuaccagcguggggaaacugguucaucagauuuucggaacugccuacggcgucuuguuuuccggugugucuuggacaaugaagaucgggauuggcauacuccugaccugguuaggacugaacagccgaucaacaagucuauccaugacuuguaucgcugugggcauggucacccucuaccuggggguuauggugcaggccgauagcggaugcgugauuaauuggaaaggccgcgaacuuaagugugguucugggaucuucguaacgaacgagguccacacauggaccgaacaauauaaguuucaggcagacucaccgaaaagauugagugcggcuaucggaaaggccugggaggagggcgugugcgguauuaggagcgcaacucggcuggaaaacauaauguggaaacagaucuccaaugagcucaaccauauucuguuagaaaaugacaugaaguucaccguuguggucggcgaugugucugggauccuggcccagggcaagaagacaauucgcccucaacccauggagcacaaauacucguggaaaagcuggggcaaggcuaaaaucauaggggccgacguucagaacacuaccuuuaucauugauggaccaaauacaccugaaugucccgacgaucagagagcauggaacaucugggagguggaggacuauggcuucgguauuuuuacgaccaauaucuggcuuaaguugagggauuccuacacucagguaugcgaccaccgucucaugucagcugccauaaaagauaguaaggcgguccaugccgacaugggguauuggauugaaucugagaaaaacgaaacauggaagcuggcucgggccagcuucaucgaggugaagaccuguguguggccaaaaucccacacucuauggucaaauggaguccuggaaagcgagaugauuauccccaagauauacggcgguccuaucucucaacauaacuaucgaccaggcuacuucacacagaccgcagggccguggcaccucggaaaacuggagcuugauuuugacuugugcgaaggcacgacuguugugguagaugagcacugcgggcauagaggacccucccugaggaccacaaccgugacuggcaagauuauccacgaaugguguugccgcaguuguacauuaccuccacuccgguucaaaggugaggacgggugcugguacggaauggagauuagacccgucaaggaaaaggaggaaaaucuggugaaaagcaugguuucugcuggcuccggugagguggacucauuuagucuuggccuguuguguaucagcauaaugauugaagaggucaugaggucgcgcuggucccgaaagaugcucaugaccgggacacuggugguuuuccuacugcucacucugggacagcuuaccuggaacgauuugauccggcugugcaucauggugggcgccaaugcaucugacaacauggggaugggaacgacauauuuagcgcucauggccaccuuucguaugagaccuauguucgcugucggccugcuuuuuaggcgccugacuagccgggagguacuacuccugaccguggguuugucacugguugccaguguggaauuaccaaauucccucgaugagcugggggacggacuugcaaugggcauuaugauccugaaauugcucacagauuuccaaucucaucagcugugggcuacucuacugagccuuaccuuugucaagacgacacucucccugcacuacgccuggaaaaccauggcaaugauuuugucaauagugagccuguuaccccucugucugaguacuacaucucagaagaccacuuggcuuccgguacuguugggcucccucgggugcaagccucugacaauguuccuaaucaccgaaaacaaaauuuggggaagaaagagcuggccacugaacgaggguaucauggccgugggcauugucucgauccuucucucaucucuguugaaaaaugacguucccuuagcugggccucugauagcgggaggcaugcucaucgccuguuaugugauuagugguuccagcgcagaucugucucuugaaaaggcugccaaagugagcugggaggaggaagccgagcauuccggggcuucacacaacauccuggucgaaauucaggacgauggaacgaugaagaucaaagacgaggaaagggaugacacuauaaccauuuugcuaaaggcaacacugcucgccaucaguggcguguaccccaugagcaucccagcgacccuguuuguuuggcacuucuggcaaaagaaaaagcagcgaucuggcguacuuugggauacaccuucacccccggagguggagaaagcugucuuagacgacgggauuuaucgcauacugcagcggggacucuuggguagaagccaggugggcguugggguguuucaagaaggagucuuccauacuauguggcacgugaccaggggcgccguacugauguaccaggguaagcgucucgagccgaguugggcaagcgucaaaaaggaucugaucuccuaugggggaggcuggcgcuuccagggcucuuggaauacgggggaagaggugcagguuauugccguggagccuggaaagaaccccaaaaauguccaaacagcuccagguacuuuuaagaccucggaaggcgaggugggggcaaucgcccuugacuucaaacccggaacaagcggcucaccuauuguuaaccgggaagguaagaucguggggcuguacggaaauggcgucgugaccacuuccggcaccuacguaagugcgauagcucaggccaaaacaucucaggaggggccauugcccgaaaucgaggaugagguguuuagaaagaggaaccuaacgauuauggaccugcauccuggaagcgguaagacucgacgguaucucccggcaaucguucgcgaagccauuaaaagaaaguuaaggacccugguccuugcuccaacacgggugguggccuccgagauggcagaagcucugaaaggcaugcccauccgauaccaaaccacugccgucaagucagagcacacagggaaagaaauaguagaucucaugugccaugcgaccuucacgaugagauugcugucuccugugcgcguuccaaauuauaacaugauuaucauggacgaggcccacuuuacugaucccgcaagcaucgcugccaggggauacauuaguacacgugugggcaugggugaggcugcagccaucuucaugaccgccaccccuccgggguccgucgaggcuuuuccccagagcaaugcggugauacaggacgaggaaaaggauauuccagagcggucuuggaacucaggauaugacuggaucacugauuucccuggcaagacaguuugguuugugcccuccauuaaaaguggcaaugacaucgcaaacugucucagaaagaaugggaaaagggucauacagcugagccgcaagaccuucgacacagaauaccagaaaacuaagaacaacgauugggacuaugugguaacgaccgauauuucggagaugggagccaauuuucgagcugacagagugaucgauccacggaggugccuuaagccuguuauccuaaaagacggucccgagcgcgucauucuggccggcccaaugccggugacaguggcaucugccgcucagcguagagggcggaucggaaggaaccagaauaaggaaggcgaucaguacgucuacaugggucaaccuuugaacaaugacgaggaucacgcgcauuggacugaagccaaaauguuacuggacaacauuaauacccccgaggggauaaucccagcacucuucgagcccgaacgcgagaaguccgcugccauugauggcgaauaucgacugagaggagaggcacggaaaacauucguugaacuuaugaggcgcggcgaccugccuguguggcucagcuacaagguagccucagagggguuucaguauagugauagaagguggugcuucgacggagagcggaacaaucagguguuggaagagaacauggacgucgaaaucuggaccaaagagggugaacguaagaagcugcgcccacgauggcuagaugcuagaacuuacucugacccccuggcccucagggaguuuaaagaguucgcggcaggccggcgcuccgugagcggggaucuuauccuggaaauuggaaaguuaccucagcacuugacgcaaagagcccagaaugcucuggacaaccucguuaugcugcauaauucagagcagggcgguaaagccuauaggcacgcuauggaggaacuuccggauaccauagaaacaaucaugcugcucgcauugauugccgugcugacugggggcgucaccuuauuuuuccuaaguggacggggccuggggaagacaagcaucggacuccuuuguguaaccuccucuagcgcucuguuguggauggccuccguggagccacacuggauugcagcgucaaucauacuggaguuuuuccucaugguucugcuuauccccgaaccugaccgacagagaacuccccaagauaaccagcucgccuacguggucauuggucuguuguuuaugauccugacaguggcugccaaugagaugggcuuacuagaaacgaccaaaaaggaccuggggauuggacauacugcagcugagaaccaccaucacgccgcaaugcucgaugucgaccuucauccagccucugcuuggacacuguaugcgguggccaccaccaucauaacaccuaugaugcgccacacuauugagaacacgaccgcaaauaucaguuugacagcuauugccaaccaggccgcaauccugaugggccucgauaaggguuggcccauaucgaaaauggacaucgggguuccacugcuugcuuuaggcugcuacagccaagugaauccucugacucucaccgccgcgguauugaugcugguggcucacuacgccauuaucggaccgggccuacaggcaaaggccacaagggaagcucagaaacggaccgcagccgggauuaugaagaaccccacugucgauggaaucguugcgauagaccuggacccaguggucuaugaugcuaaauucgagaagcagcucggccaaauuaugcuucugaucuuguguacgucccagauccugcucaugcguacaaccugggcccugugcgaaucuauuacuuuagcaaccgguccucuuacaacucugugggaggggucacccggaaaguuuuggaauaccacaaucgccgugagcauggcuaacauauucagaggcuccuaccucgccggugcaggccuagcuuuuagucugaugaaaucucuagggggaggcaggcgcgggacgggagcccagggcgaaacccugggugagaaguggaaacggcagcucaaucaacuuagcaagucagaguucaacauuuauaaacgauccgggaucauugaaguagacagaagugaggcgaaggaaggacugaagaggggcgagacuacaaaacaugccgugagccgcgguaccgcaaaguugcggugguucguugaaagaaaucuggugaaaccagagggcaaggucaucgaucucggguguggacguggcggguggucuuacuauugcgcuggacuaaagaaggugacugaggucaaaggcuacacaaagggugggccuggacacgaggaacccauaccgauggccaccuauggcuggaaccuggugaaacuucauuccggcaaagacguauuuuucaucccaccugaaaagugugauacgcugcuaugcgacauuggggagucaagccccaauccaaccaucgaagagggaaggacacuccggguacugaaaaugguggagcccugguugcgcgguaaccaguuuuguauuaagauccugaauccuuacaugccgucggucguggaaacucucgagcagaugcagcgaaaacacggcgggaugcuuguuagaaacccccugucuaggaauaguacccacgaaauguacuggguguccugcggaacaggcaacauugucagcgcagugaauaugacuucacggauguuacugaaccgcuucaccauggcucauagaaagccaacauaugagagggauguagacuugggugccgggacccgacacguggccguugagccugaagucgcgaaccucgauaucauaggacaacggauugagaauaucaagaacgaacauaaauccacuuggcacuacgacgaggauaaucccuauaagacgugggcuuaccauggcucuuaugaagugaaaccuagcggcagugcauccagcauggugaacggggucguucgucugcuaacaaagccaugggacgugauccccaugguaacccagauugccaugacugacaccacaccuuuuggacagcaaagaguguucaaagagaaggucgauacgcgcaccccaaaggcuaaaagggguacugcccagauaauggaggugacagcaaaguggcuuuggggcuuucugucucggaauaaaaagcccagaaucuguacccgcgaagaguucacuaggaaaguucgaucaaacgccgcuauuggggcgguguuugucgacgaaaaucaguggaacagugccaaggaggcaguggaagaugagcgguucugggaccucguaagaagggagcgcgaacugcacaagcagggaaaaugcgcuacaugcguuuacaauaugaugggcaagcgugagaaaaaguugggugaauuugggaaagccaagggaucccgggcaaucugguauauguggcugggcgccagauuccucgaguuugaagcucuuggcuucaugaacgaggaucacugguucagcagggaaaauucucugucggggguggaaggagaggguuuacauaaacugggcuacauuuugcgcgacaucucaaagauaccagggggaaacauguacgccgaugacaccgcgggcugggauacacgaaucacugaagaggaccuccaaaaugaggcaaagauuaccgauaucauggaaccugagcacgcccugcuagcuacgagcauuuuuaaacuuaccuaucagaacaaggucgugcgggugcagagaccagccaaaaaugguacagucauggacguuaucuccaggcgcgaucagagagggaguggacaagugggcacuuacggccugaacaccuucacaaacauggaagcacagcucauacggcagauggagucugaagggauuuuuagccccuccgagcuggagacuccuaauuuggcuggaaggguauuagacuggcuggaaaagcaugguaucgagcgucuccgacgcauggccaucucaggcgacgauuguguggucaaaccaauugacgauagauucgcuaccgcccuuacggcacugaacgacauggggaaggugcggaaggauauaccccagugggaaccgaguaaaggauggaaugacuggcaacagguuccuuuuugcucucaccacuuccaucagcuaaucaugaaggauggcagggagauugugguccccugucgcaaccaggacgaacugguggguagagcgcggguaagccaaggggccggauggucccucagggagacagcuugcuugggcaaaucauaugcccagauguggcagcugauguacuuucaccgacgugaucuuagacuggcagcuaaugccaucuguagcgcaguuccaguggacugggucccuaccucucgcacuacaugguccauucaugcccaccaucaauggaugaccacugaggauaugcucaguguguggaaccggguuuggaucgaagagaaucccuggauggaagacaagacccacgugagcucgugggaggacgucccauauuuaggcaaaagggaagaucaguggugcgggucccugauaggauugacagcgagagcuacgugggccaccaacauccagguggcaauuaaucagguacgccggcugaucgguaacgagaauuaccucgacuauaugacuucuaugaagagguucaagaacgagucagaucccgaaggcgcccuuugguga

SEQ ID NO: 14183 - RNA, 9879 nt, Artificial Sequence
  derived and/or modified CDS sequence (opt3) from DENV-1__KF289072__SS-prME
agcgugaccaugcugcucaugcuucugcccacugcauuggcuuuccacuuaacuacgagaggaggggagccucauaugaucgucuccaagcaggaaagaggaaaaucucuguuguuuaagaccucagccgguguuaacaugugcacacucauugccauggaccugggagagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaaaaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaagggugaggaugggugcugguacggaauggagaucaggcccguuaaagaaaaggaggaaaaccuugugcgcaguaugguaagcgcgggcucuggugagguggacuccuucucacugggcuugcucugugucaguauaaugauugaagaggugaugcgaagccgguggucgcguaagaugcugaugacagggacccuagccguauuuuuccugcucaucaugggacagcugacauggaaugaccuuaucagauugugcauuauggugggcgcuaacgucuccgauaggauggggaugggaacuaccuaucuggccuuaauggcaacguuuaaaaugcgcccuauguucgcugugggccuccuguuucggagacuuacaucuagggagguucugcuacucaccaucggucugagcuugguggccucagucgaacugccaaacaguuuagaggaacucggggacggacuggcaaugggcauuaugaugcuuaagcuguugacugauuuccaaucccaccagcucuggaccacacugcuaucucugacuuuuauaaaaaccacgcuuagccucgacuacgccuggaagacaauggcuaugguacuguccaucgugucauuguucccccuguguuuaagcaccacaagucagaaaacaaccuggcucccgguucugcuuggcucuuuugggugcaagccucugacuauguucuugauuacagagaauaagaucuggggacgaaaauccuggccacucaacgaagguauuauggcggugggcaucgucagcauacugcuaucgucacugcuuaagaaugaugugccccucgccgggccucugaucgcaggaggcauguugauugcuuguuauguaaucucugguaguuccgccgacuuaagccuggagcgcgccgcugaggugucuugggaagaggaagcagagcauagcggggccucccacaacauucucgucgaaguucaggaugacggaaccaugaaaaucaaggaugaggagcgggacgauacgcugacuauacuucugaaagcgaccuugcuagcugugucaggcguguaccccaugaguauuccagccacacuguuugucugguauuucuggcaaaagaaaaagcagagaagcggcgugcucugggacaccccuucucccccagaaguugagagggcaguacuggaugacgggaucuaccguauccuucagcgcggauuacugggucggucccaggugggcgucgggguguuccaagacggaguuuuucauacaauguggcacgugacuagaggcgccguccucauguaucaggguaagagguuggaaccgucaugggcuagugugaaaaaggaucugauuagcuacgggggaggcuggcgauuccagggcuccuggaauaccggggaggagguacaggucauagcaguggaaccuggcaagaaccccaagaauguucaaacgacaccagguacuuuuaaaacccccgagggcgccgugggggcgaucgcucucgacuucaagccuggaacaucuggcucgccaauugucaaccgggaagguaagaucguggggcuguacggaaauggcguugugaccacuagcggcaccuaugucucagccauugcacaggccaaggcuucccaggaggggccccuuccugaaaucgaggaugagguguuuaagaaacgcaaccugacaauaauggacuugcacccgggaagugguaagacgagaagguaccuaccagccaucguacgggaagcaauuaaacgaaagcugagaacucucaucuuagcucccacccgcgugguugccucugagauggcggaagcccugaagggcaugccuauuagguaucaaacaaccgcagucaaaagcgagcauacugggaaggaaaucguggaucuuaugugccacgcuacauucaccaugcgucugcucuccccagugcggguccccaauuacaacaugauaauuauggacgaggcccauuuuacggauccugcuucaaucgcagccagaggauauaucucuacuaggguaggcaugggugaggccgcugcgauuuucaugacagcaaccccgcccgggagcguggaagccuuuccacagaguaaugcuguuauccaggacgaggaacgcgauauaccugagcgauccuggaacagcggauacgacuggauuaccgauuuccccggcaaaacugugugguuugucccaucuaucaagucaggcaaugacauugccaacuguuugaggaagaacgggaagcgggugauccagcuguccaggaagacauucgacaccgaauaucagaaaacuaagaauaacgauugggacuacguugugacuacggauauaagugagaugggagcaaauuuccgcgccgaccgugucauugauccuagacggugccucaaacccgugauccugaaggacgguccagagaggguaauccuugcuggcccgaugccugugaccgcggccagcgcagcucaacgccgagggagaauuggacggaaccagaauaaagaaggcgaucaguacaucuauaugggucaaccccuaaacaaugacgaggaucacgcccauuggacagaagcaaagaugcuguuggacaacauuaauacuccagaggggauaauccccgccuuauuugagccugaaagggagaagucggcugccauugauggcgaauaccgccugagaggagaggcgaggaaaaccuucguugaacucaugcggcguggcgaccugccagucuggcuuucuuauaagguggcauccgagggguuucaguacagcgaucgccgauggugcuucgacggagagagaaacaaucaggugcuggaagagaacauggacgucgaaaucuggacaaaagagggugaaaggaagaaacuccggccccgcugguuggaugccagaaccuauucagacccucuggcucuaagggaguuuaaggaguucgccgcuggccggcgaaguguuucuggggaucugauccucgaaauuggaaaacuuccgcagcaccugacuuuaagagcacaaaaugccuuggacaaccuggugaugcuccacaauuccgagcagggcgguaaggcuuaccgccaugccauggaggaacugccagauacgauagaaacccuuaugcugcucgcauugaucgcgguacugacagggggcgugacuuuauuuuuccuaagcggaaagggccuggggaaaaccucaauuggacuccuuugugucauggccaguagcgugcuguuguggauggcuuccguugagccccacuggaucgccgcaucuauuauccuggaguuuuuccucauggugcugcuuauaccugaacccgacaggcagcggacaccacaggauaaccaacucgcuuaugucguaaucggucuguuguuuaugauucugaccguggccgcaaacgagaugggcuuacuagaaacuacaaagaaagaccuggggaucggacauguuguggccgagaaucaccaccaugcuacgaugcucgauauugaccuucacccugcgagcgccuggacccuguacgcagucgcuacuacaaucauaacccccaugaugcgucauaccauugagaacacaacugccaauaucuccuugacggccauugcaaaccaggcugccauccugaugggccucgauaaggguuggccaauaucaaaaauggacaucggggugccucugcuugcguuaggcugcuacucucaggucaauccgcugacccucacagcugccguguugaugcugguugcacacuaugccauuaucggacccggccuacaagcuaaggcaacuagagaagcccagaagaggaccgcggcugggauuaugaaaaacccaacaguggauggaaucguagccauagaccuggacccuguggucuacgaugcaaaguucgagaaacagcucggccagauuaugcuucugaucuuguguaccagucaaauccugcucaugcgcacuacgugggcccugugcgaaucgauuacauuagcuaccgguccccuuacuacccugugggaggggagcccaggacgguuuuggaauacaacuaucgccguuuccauggcaaacauauuccgaggcucuuaucucgcuggugccggccuagcguucucacugaugaaaagccuagggggaggcagaagggggaccggagcccagggcgaaacacugggugagaaauggaagcgccagcucaaucagcuuuccaagagugaguuuaacacguacaaacggucugggauuauggaaguggacagaagcgaggcaaaggaaggacugaaacguggcgagaccacuaagcaugcugucucaagggguacagccaaauugcggugguucguggaacgcaaucugguaaagccugagggcaaggugaucgaucucggguguggacgaggcgggugguccuauuacugcgcaggacugaaaaagguuaccgaggugaaaggcuauacuaagggugggcccggacacgaggaaccgauuccaauggcuacauacggcuggaacaucgucaaacuacacaguggcagagacguguuuuucaccccucccgaaaagugugauacgcuucugugcgacauaggggagagcucuccaaaucccaccaucgaagagggaaggacacuacggguccucaaaaugguggagccuuggcugcgcgguaaccaauuuuguauuaagaucuugaauccguacaugcccuccguuguagaaacucuggagcagaugcagagaaagcauggcgggaugcucgugaggaacccacuuucacgaaauagcacccacgaaauguauugggucucgugcggaacaggcaacauugugucugccguuaacaugacaagucggaugcuguuaaaucguuucaccaugacacauagaaaaccuaccuacgagcgcgauguggaccugggugccgggacuaggcacgucgcgguggagcccgaaaucgcuaacuuggauauuaucggacagcggauagagaauauuaagaacgaacacaaauccacguggcauuaugacgaggauaauccuuacaagacaugggcauaucacggcagcuacgaaguaaaaccaucaggcuccgccucuagcauggugaacgggguugucagacuccugaccaagcccugggacgugaucccuauggugacucaaaucgcuaugaccgacacaacgccauuuggacagcagcgcgucuucaaggagaaaguugauaccaggacuccccgaccgaagcgggguacagcccaaauuauggaggugaccgcaaaauggcuauggggcuuucuuaguagaaauaagaaaccuaggauauguacucgcgaagaguucacacguaagguacgguccaacgccgcuaucggggcgguguuugucgacgaaaaucaguggaacagcgccaaggaggcaguggaagaugagagauucugggaccugguucauagggagcgcgaacuccacaaacagggaaagugcgcuaccugcguguauaauaugaugggcaaacgagagaagaaacugggugaauuugggaaggccaagggaucucgggcaauuugguacaugugguugggcgccagauuccuggaguucgaagcucucggcuuuaugaacgaggaucauugguucucaagggagaauagucuuuccggggucgaaggagagggucugcacaaauuaggcuacauccugcgcgacauuagcaagaucccagggggaaacauguaugccgaugacacagcgggcugggauacuagaauaaccgaagacgauuugcagaaugaggcaaaaaucacggacauuauggagcccgaacacgcccuccuggcuaccucuaucuuuaagcuaacauaccaaaacaaagugguacggguucagaggccugccaagucggguacugugauggaugucauuucacgucgagaccagcgcgggagcggacaggugggcaccuauggccuuaacacauucacuaauauggaggugcaacugaucagacagauggaauccgaggggauauuuaguccaucugaacucgagaacagcaaucuggcagagcgggucuuggacugguuagaaaaacauggaguugagaggcugaagcgcauggcuauuuccggugaugacugugugguaaagcccaccgaugacagauucgccacggcucucacagcccuuaacgauaugggcaaagugcggaaggacaucccgcagugggaaccuucaaaaggguggaaugauuggcagcaaguccccuuuugcagucaccauuuccaccagcugaucaugaaggacggaagggagauugugguuccaugucgaaaccaggaugaguuagugggccgugcaagagucucucagggugcgggguggagccugcgcgagaccgccugccucggaaaauccuacgcucaaauguggcaguugauguauuuucaccggagggaccugagacuugccgcaaaugcuauauguucagccgugccuguagauuggguucccacuagccgcacaaccuggucuauccaugcacaccaucaguggaugacuaccgaggacaugcuguccguguggaaccgggucuggauugaagagaauccauggauggaagacaagacacacgugaguagcugggaggauguucccuaccucggcaagagggaagaccaauggugcggcucguuaaucgggcugacggcccgagcgaccugggcuacuaacauucagguggccaucaaucaggucagacgguugauaggaaacgagaauuaucuggauuacaugacauccaugaaaagguucaagaacgagucugacucagaaggugcacucugguga

SEQ ID NO: 14184 - RNA, 9879 nt, Artificial Sequence
  derived and/or modified CDS sequence (opt3) from DENV-1__JQ692085__SS-prME
agcgugaccaugcugcucaugcuucugcccacagcauuggcuuuccacuuaacuacgagaggaggggagccucauaugaucgucuccaagcaagaaaggggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaggaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaaaaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgccgugggggcgaucgcucucgacuucaaaccuggaacaucuggcucgccaauugucaaccgcgaagguaagaucguggggcuguacggaaauggcguugugaccacuagcggcaccuaugucucagccauugcacaggccaaggcuucccaggaggggccccuuccugaaaucgaggaugagguguuuaaaaagagaaaccugacaauaauggacuugcacccgggaagugguaaaacgaggcgguaccuaccagccaucguacgagaagcaauuaagagaaaacugcgcacucucaucuuagcucccaccagggugguugccucugagauggcggaagcccugaagggcaugccuauucguuaucaaacaaccgcagucaagagcgagcauacugggaaagaaaucguggaucuuaugugccacgcuacauucaccaugcggcugcucuccccagugagaguccccaauuacaacaugauaauuauggacgaggcccauuuuacggauccugcuucaaucgcagccaggggauauaucucuacucgcguaggcaugggugaggccgcugcgauuuucaugacagcaaccccgcccgggagcguggaagccuuuccacagaguaaugcuguuauccaggacgaggaacgagauauaccugagagauccuggaacagcggauacgacuggauuaccgauuuccccggcaagacugugugguuugucccaucuaucaaaucaggcaaugacauugccaacuguuugcggaagaacgggaaaagggugauccagcugucccgcaagacauucgacaccgaauaucaaaagacuaagaauaacgauugggacuacguugugacuacggauauaagugagaugggagcaaauuuccgugccgacagagucauugauccucggaggugccucaagcccgugauccugaaagacgguccagagcgcguaauccuugcuggcccgaugccugugaccgcggccagcgcagcucagcgaagagggcggauuggaaggaaccagaauaaggaaggcgaucaguacaucuauaugggucaaccccuaaacaaugacgaggaucacgcccauuggacagaagcaaaaaugcuguuggacaacauuaauacuccagaggggauaauccccgccuuauuugagccugaacgcgagaagucggcugccauugauggcgaauacagacugaggggagaggcgcggaagaccuucguugaacucaugcgucgcggcgaccugccagucuggcuuucuuauaaaguggcauccgagggguuucaguacagcgaucgaagauggugcuucgacggagagaggaacaaucaggugcuggaagagaacauggacgucgaaaucuggacaaaggagggugaacggaaaaagcuccgccccagaugguuggaugccaggaccuauucagacccucuggcucuacgggaguuuaaagaguucgccgcuggccgaagaaguguuucuggggaucugauccucgaaauuggaaaacuuccgcagcaccugacuuuacgcgcacaaaaugccuuggacaaccuggugaugcuccacaauuccgagcagggcgguaaggcuuacaggcaugccauggaggaacugccagauacgauagaaacccuuaugcugcucgcauugaucgcgguacugacagggggcgugacuuuauuuuuccuaagcggaaagggccuggggaagaccucaauuggacuccuuugugucauggccaguagcgugcuguuguggauggcuuccguugagccccacuggaucgccgcaucuauuauccuggaguuuuuccucauggugcugcuuauaccugaacccgaccggcagcguacaccacaggauaaccaacucgcuuaugucguaaucggucuguuguuuaugauucugaccguggccgcaaacgagaugggcuuacuagaaacuacuaaaaaggaccuggggaucggacauguuguggccgagaaucaccaccaugcuacgaugcucgauauugaccuucacccugcgagcgccuggacccuguacgcagucgcuacuacaaucauaacccccaugaugagacauaccauugagaacacaacugccaauaucuccuugacggccauugcaaaccaggcugccauccugaugggccucgauaaagguuggccaauaucaaagauggacaucggggugccucugcuugcguuaggcugcuacucucaggucaauccgcugacccucacagcugccguguugaugcugguugcacacuaugccauuaucggacccggccuacaagcuaaagcaacuagggaagcccagaagcgcaccgcggcugggauuaugaagaacccaacaguggauggaaucguagccauagaccuggacccuguggucuacgaugcaaaauucgagaagcagcucggccagauuaugcuucugaucuuguguaccagucaaauccugcucaugcggacuacgugggcccugugcgaaucgauuacauuagcuaccgguccccuuacuacccugugggaggggagcccaggacgauuuuggaauacaacuaucgccguuuccauggcaaacauauucagaggcucuuaucucgcuggugccggccuagcguucucacugaugaaaagccuagggggaggcaggcgcgggaccggagcccagggcgaaacacugggugagaaguggaaacggcagcucaaucagcuuuccaagagugaguuuaacacguacaagagaucugggauuauggaaguggaccguagcgaggcaaaagaaggacugaagaggggcgagaccacuaaacaugcugucucacgggguacagccaaguugcgcugguucguggaacgaaaucugguaaaaccugagggcaaggugaucgaucucggguguggaagaggcgggugguccuauuacugcgcaggauuaaagaaaguuaccgaggugaagggcuauacuaaaggugggcccggacacgaggaaccgauuccaauggcuacauacggcuggaacaucgucaagcugcacaguggcagggacguguuuuucaccccucccgaaaaaugugauacgcuucugugcgacauaggggagagcucuccaaaucccaccaucgaagagggacggacacuacgcguccucaagaugguggagccuuggcugagagguaaccaauuuuguauuaaaaucuugaauccguacaugcccuccguuguagaaacucuggagcagaugcagaggaagcauggcgggaugcucgugcgaaacccacuuucacggaauagcacccacgaaauguauugggucucgugcggaacaggcaacauugugucugccguuaacaugacaagucguaugcuguuaaauagauucaccaugacacaucgcaagccuaccuacgagagggauguggaccugggugccgggacucggcacgucgcgguggagcccgaaaucgcuaacuuggauauuaucggacagagaauagagaauauuaaaaacgaacacaaguccacguggcauuaugacgaggauaauccuuacaaaacaugggcauaucacggcagcuacgaaguaaagccaucaggcuccgccucuagcauggugaacgggguuguccgccuccugaccaaacccugggacgugaucccuauggugacucaaaucgcuaugaccgacacaacgccauuuggacagcagagggucuucaaggagaagguugauacccgaacuccccggccgaaaagagguacagcccaaauuauggaggugaccgcaaaguggcuauggggcuuucuuaguaggaauaaaaagccucgcauauguacucgugaagaguucacacggaaaguaagauccaacgccgcugugggggcggucuuuguggacgaaaaucaguggaacagcgccaaggaggcaguugaagaugagagguucugggaccuggugcaucgcgagcgagaacuccacaagcagggaaaaugcgcuaccugcgucuauaauaugaugggcaagcgggagaaaaagcugggugaauuugggaaagccaagggaucuagagcaaucugguacaugugguugggcgccagguuccuggaguucgaagcucucggcuuuaugaacgaggaucauugguucucacgcgagaauagucuuuccgggguggaaggagagggucugcacaaguuaggcuacauucugagagacaucagcaaaauuccagggggaaacauguaugccgaugacacagcgggcugggauacucggaucaccgaagacgauuugcagaaugaggcaaagauaacggacaucauggagcccgaacacgcccuccuggcuaccucuauuuuuaaacuaacauaccaaaacaagguaguuagggugcagcguccugccaaaucggguacugucauggaugugaucucacgacgcgaccagagagggagcggacaggugggcaccuauggccuuaacacauucacuaauauggagguccaacugauucggcagauggaauccgaggggaucuuuaguccaaacgaacucgaaaauucuaaccuggcagagaggguuuuggacugguuagaaaagcauggaguggagcgccugaaaagaauggcuauaagcggugaugacuguguagugaagcccaccgaugaccgguucgccacggcucucacagcccuuaaugauaugggcaaggucaggaaagacauuccgcagugggaaccuuccaagggguggaacgauuggcagcaagugcccuuuugcucacaccauuuccaccagcugaucaugaaagacggacgagagaucguugugccaugucguaaucaggaugaguuggucggcagagcacgcgugagucagggugcgggguggucucugcgggagaccgccugccucggaaagagcuacgcucaaauguggcaguugauguauuuucacaggagagaccugcgccuugccgcaaacgcuauuuguuccgccguaccuguugauugggugcccacuucacggacaaccuggagcauacaugcacaccaucaguggaugacuaccgaggacaugcugucugucuggaauaggguguggaucgaagagaacccauggauggaagacaaaacacacguuuccaguugggaggaugugcccuaccucggcaagcgagaagaccaauggugcggcagcuuaauugggcugacggccagagcgaccugggcuacuaauauccaggucgccauuaaccaggugcggagguugaucggaaaugagaacuaucuggauuacaugacaucgaugaagcgcuucaaaaaugaguccgacucugaaggugcacucugguga

SEQ ID NO: 14185 - RNA, 9879 nt, Artificial Sequence
  derived and/or modified CDS sequence (opt3) from DENV-1__JQ917404__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaagcuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguuuuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacuagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcaaaaaaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagagcgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacaaaaaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacacgggaaggugagcgcaagaaacucagacccaggugguuggaugcacggaccuauucagacccucuggcccuacgagaguuuaaggaauucgcugccggcagacgcaguguuucuggggaucugauccucgagauuggaaaacuuccgcagcaccugacuuuaagggcucaaaaugcauuggacaaccuggugaugcuccacaauuccgaacagggcgguaaggccuaccggcaugcuauggaggaacugccagauacgauagagacccuuaugcugcucgccuugaucgcaguacugacagggggcgugacuuuauuuuuccuaagcggaaaaggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccgucagagaacaccacaggauaaccaacucgcauaugucguaaucggucuguuguuuaugauucugaccguggcugccaacgaaaugggcuuacuagagacuacaaagaaagaccuggggaucggacauguuguggcagagaaucaccaccaugccacgaugcucgauauugaccuucacccugcuagcgcguggacccuguacgccgucgcaacuacaaucauaacccccaugaugaggcauaccauugaaaacacaacugcuaauaucuccuugacggccauugccaaccaggcagcuauccugaugggccucgauaaggguuggccaauaucaaaaauggacaucggggugccucugcuugccuuaggcugcuacucucaggucaauccgcugacccucacagcggcuguguugaugcugguugcccacuaugcaauuaucggacccggccuacaagccaaggcuacucgcgaggcacagaaacggaccgccgcggggauuaugaagaacccaacaguggauggaaucguagcuauagaccuggacccuguggucuacgaugccaaguucgaaaaacagcucggccagauuaugcuucugaucuuguguaccagucaaauccugcucaugcgaacuacgugggcacugugcgagucgauuacauuagccaccgguccccuuacuacccugugggaagggagcccaggaagauuuuggaauacaacuaucgcuguuuccauggccaacauauucaggggcucuuaucucgcaggugcuggccuagccuucucacugaugaagagcuuggggggaggccgccgggggaccggagcgcagggcgagacacugggugagaaauggaagagacagcucaaucagcuuuccaaaagugaauuuaacacguacaagcguucugggauuauggagguggacaggagcgaagccaaggagggacugaaacggggcgaaaccacuaagcaugcagucucacgcgguacagcuaaauugcgaugguucguggagagaaaucugguaaagccugagggcaaagugaucgaucucggguguggaaggggcgggugguccuauuacugcgccggauuaaagaagguuaccgaagugaaaggcuauacuaagggugggcccggacacgaggaaccgauuccaauggcaacauacggcuggaacaucgucaaacugcacaguggccgggacguguuuuucaccccucccgagaagugugauacgcuucugugcgacauaggggaaagcucuccaaaucccaccaucgaggagggacgcacacuaagaguccucaaaaugguggaaccuuggcugagggguaaccaauuuuguauuaagaucuugaauccguacaugcccuccguuguagagacucuggaacagaugcagcgaaaacauggcgggaugcucgugcggaacccacuuucacguaauagcacccacgagauguauugggucucgugcggaacaggcaacauugugucugcuguuaacaugacuaguagaaugcuguuaaaucgcuucaccauggcccauaggaagccuacauacgagcgggauguggaccugggugccgggaccagacacgucgcgguggaacccgagaucgcuaacuuggauauuaucggacagcgcauagaaaauauuaagaacgagcacaaauccacuuggcauuaugacgaagauaauccuuacaagacgugggcauaucacggcagcuacgagguaaaaccaucaggcuccgccucuagcauggugaacgggguugucaggcuccugacaaagcccugggacgugaucccuauggugacccaaaucgcuaugacugacaccacaccauuuggacagcagcgagucuucaaagagaagguugauacgcggacccccagaccgaagagggguacugcccaaauuauggaagugacagcaaaauggcuauggggcuuucuuagucgcaauaagaaaccucguauauguacccgggaggaauucacuagaaagguaagguccaacgccgcuaucggggcgguguuugucgacgagaaucaguggaacagcgccaaagaagcaguggaggaugagcgcuucugggaccugguucaucgagaacgggagcuccacaagcagggaaagugcgcuacaugcguguauaauaugaugggcaaaagagaaaagaaacugggugaguuugggaaggccaaaggaucuagggcaauuugguacaugugguugggcgcccgcuuccuggaauucgaggcucucggcuuuaugaacgaggaucauugguucucaagagaaaauagucuuuccggggucgagggagaaggucugcacaaguuaggcuacauccugcgggacauuagcaagaucccagggggaaacauguaugccgaugacaccgcgggcugggauacaaggauaacugaggacgauuugcagaaugaggcaaaaaucaccgacauuauggaacccgagcacgcccuccuggcuacgucuaucuuuaagcuaaccuaccaaaacaaagugguacguguucagcgaccugccaagucggguacagugauggaugucauuucacgcagagaccagcgggggagcggacaggugggcacuuauggccuuaacaccuucacaaauauggaagugcaacugaucaggcagauggaguccgaagggauauuuaguccaucugagcucgagaacagcaaucuggcagaacgcgucuuggacugguuagagaaacauggaguugaaagacugaagcggauggcuauuuccggugaugacugugugguaaaacccacugaugacagguucgccaccgcucucacggcccuuaacgauaugggcaaggugcgaaaggacaucccgcagugggagccuucaaaaggguggaaugauuggcagcaaguccccuuuugcagucaccauuuccaccagcugaucaugaaggacggacgugaaauugugguuccauguagaaaccaggaugagcuagugggccgcgcacgggucucucagggugcgggguggagccugagggagacagccugccucggaaaauccuacgcucaaauguggcaguugauguauuuucacagacgcgaccugcggcuugccgcaaaugcuauauguucagccgugccuguaaacuggguucccaccagcaggacuacauggucuauccaugcacaccaucaguggaugaccacugaagauaugcuguccguguggaaucgagucuggauugaggaaaacccauggauggaggacaagacccacgugaguagcugggaagacguucccuaccucggcaaaagagaggaucaauggugcggcucguuaaucgggcugacagcccgggcgacgugggcuaccaauauucagguggccaucaaccaggucaggcgcuugauaggaaaugagaacuaucuggacuacaugacuuccaugaagcguuucaagaaugaaucugauccugagggugcacucugguga

SEQ ID NO: 14186 - RNA, 9879 nt, Artificial Sequence
  derived and/or modified CDS sequence (opt3) from DENV-1__GU370048__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacucuuaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuagacaucgaacuccugaagacagaggugaccaacccugccgugcuuaggaaacugugcauugaagcuaagaucucuaauacgaccacagauagccgguguccaacucaaggagaggccaccuuggucgaagagcaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauugaacuucaaugaaaugguccuacugacgaugaaggagaaaucuuggcucgugcauaagcagugguuucuggaccuuccgcugcccuggaccuccggcgcaucaacuacacaagagaccuggaaccggcaggauuugcucguaacauucaaaacugcucacgccaagaagcaggaaguugugguccuggguagccaagagggggcuaugcacaccgccuuaacgggcgcaaccgaaauccagacaaguggaacuaccacaauuuuugccggccaucugaaaugccgucuaaagauggacaaacucacucugaaggggaugucuuaugugauguguaccggauccuucaaacuugagaaggaagucgcugagacgcagcacgguacaguguugguucagauaaaguacgagggcaccgaugcgccuugcaaaaucccauucagcacucaagacgaaaagggggugacacagaauggacgccugauuaccgcaaaccccaucguaacugauaaagagaagccugucaauauagaagccgagccacccuuuggcgagucguauauugugaucggugcuggggaaaaagcccucaagcugucuugguucaagaaaggcuccucaaucggaaagauguuugaggcaaccgccagaggcgcuaggcggauggccauucuuggggacacagcaugggauuucggaaguaucgguggcguuuuuacgagcguggggaaacugguccaucagauuuucggaaccgcguacggcguguuguuuuccgguguaucuuggacuaugaagauagggaucggcgugcuccugacaugguuaggacugaacagccgaucaaccagucuauccaugacauguauugcuguuggccucgucacucuguaccuuggggugauggugcaggccgacagcggaugcgucaucaauuggaaaggccgcgaauugaagugugguucugggaucuucguuaccaacgaggugcacacguggacagaacaauauaaguuucaggcagauucaccgagaaggcugagugccgcuauuggaaaagccugggaggagggcgugugcgguauacggagcgcaacccgccucgaaaacaucauguggaagcagauuuccaaugagcugaaccauaucuuacuggaaaaugacaugaaauucacuguagucgugggcgacguugcugggauucuugcccagggaaagaaaaugaucagaccucaacccauggagcacaaguacucuuggaaaucguggggcaaggcgaagauaaucggggccgaugugcagaacaccacauuuauuaucgacggaccaaauacuccugaaugucccgaugaccagagggcuuggaacauuugggaggucgaggauuauggcuucgguaucuuuaccacaaauauaugguugaaacuccgugacagcuacacgcaggugugcgaucaccggcugauguccgcagccauuaaggacucaaaagcuguucaugccgauaugggguauuggaucgaaagugagaagaacgaaaccuggaaacuagcacgagcgucuuucauugaggugaagacuuguaucuggccaaagagccacacacugugguccaauggaguacucgaaucagagaugauaauccccaaaauuuacggcgguccuaucagccaacauaacuauagaccaggcuacuucacccagacugccgggccguggcaccugggaaagcuugaguuggacuuugaucugugcgaaggcacaaccgucgugguggacgagcacugcgggaauaggggacccucuuuacgcacgacuaccgucacaggcaaaauuauccaugaaugguguugccgguccuguacccucccuccacugagauucaggggugaggaugggugcugguacggaauggagauacgccccguuaaggaaaaagaggaaaaccuugugaagaguaugguaagcgcuggcucuggugagguggacuccuuuucacugggcuugcucuguauuaguaucaugaucgaagaggucaugcgaagccgguggucgcguaagaugcugauuacugggacacuagccguguucuuucugcucaucaugggacagguuaccuggaaugaccugauuagacuuugcauaauggugggcgcaaacgcuuccgauaggauggggaugggaacaacuuauuuggcccugauggcaaccuucaaaaugcgcccuauguuugccgucggcuuacucuuccggagacugacgucuagggaggugcuucugcuaacaaucggucucagccugguugcuucaguggaauugccaaauagucuggaggaauuaggggacggacucgcgaugggcauuaugauccugaagcuucugaccgauuuucaaccccaccaguugugggccacucuccugucccuaaccuucauuaaaacaacuuuuucucugcauuacgcauggaagaccauggcuaugguccuuagcaucguaucccucuucccgcuguguuugucaacgacaagccagaaaaccacuuggcugccuguguuacucggcagucuggggugcaagccacuuacaauguuucugauagccgagaacaagaucuggggacgaaaaucuuggcccuugaacgaagguauuauggccguuggcaucguguccauucuccugagcucgcuacugaagaaugacgucccucuugcugggccccucaucgcaggaggcaugcugauagccuguuaugugauuucagguucuagugcggauuuguccuuagagaaagcugccgagguaagcugggaagaggaagcagagcacucuggggccagccauaacauccugguggaaguccaggacgauggaaccaugaagaucaaagacgaggagcgcgaugacacucucacaauucugcuuaaggcuacccuguuggcaguuuccggcguguacccacuaucaauaccugccacgcuguucgugugguauuucuggcaaaaaaagaagcagcggaguggcguccucugggauacucccagcccaccggaaguggagagagcgguucuggacgaugggaucuacaggauuaugcagcguggacuuuuaggucgcucucagguaggcgugggggucuuucaagaaaauguguuccacaccauguggcacguuacacggggagcugugcugauguaucagggcaaaagacucgagccuuccugggccucagucaagaaagacuugaucaguuacggugggggauggaggcugcagggcagcuggaacaccggcgaggaagugcagguaauugcagucgagcccgggaagaauccaaaaaacgugcaaacagcccccggaacuuuuaagaccccugaaggugagguuggcgcuaucgcccucgacuucaagccagggacguccggaucucccauagugaaucgagaaggcaaaaucgucggucuguacgggaacggagugguuacaacuucgggcaccuaugugagcgcaauugcucaggccaaggcgucacaggagggcccucuuccggagaucgaagaugaggucuuucggaaacgcaaucugacaauuauggacuugcauccaggguccggaaagaccagaagguaccuacccgccaucgugcgggaagcaauaaaacgaaagcugagaacucucauuuuagcuccuacccgcguaguggccagugagauggcugaagcacugaaggguaugccaaucagguaucaaacaacggccguuaaaucugagcacacuggcaaggagaucgucgaucuuaugugccaugccaccuucacaaugcgucugcucagccccgugcgggugccuaacuacaauaugauuaucauggacgaagcucacuuuaccgauccguccucaauagcggcaagaggguauauuucuacuagggucggaaugggcgaggccgcugccaucuucaugacagcaacccccccagguagcguagaagccuuuccucagaguaacgcugugauucaggacgaggaacgcgauauccccgagcgauccuggaauagcggguacgaguggauaacggacuucccaggaaaaacuguuugguuugugccuucuauuaagucaggcaacgauaucgcgaauuguuugagaaaaaacggcaagcgggucauccagcuguccaggaagacauucgacaccgaauaucaaaaaaccaagaacaaugauugggacuacgugguuacuacagacauuagugagaugggggccaacuuccgcgcagaucgugugaucgaccccagacggugccucaaaccagucauucugaaggauggaccggaaagggugauacuugcugguccuaugcccguaaccguggccagcgcagcccagcgccgaggcagaaucgggcggaaucauaacaaagagggagaccaguacauuuauaugggccagccacuaaauaacgaugaggaccacgcucacuggacagaagccaagaugcuguuggauaauaucaacacucccgaggguaucauuccugcguuauuugaaccagagagggaaaagucggcagccauagacggggaguaccgccugagaggcgaggcuaggaaaacguucguugaacucaugcggcguggagaucugcccgucuggcuuucuuauaagguggccuccgagggcuuucaauacagcgaccgccgauggugcuucgauggggaaagaaauaaccaggugcuggaggaaaauauggacgucgagaucuggaccaaagagggagaaaggaagaaacuccggccucgcugguuggaugcuagaacauauucagacccgcuggcacuaagggaguuuaaggaauucgccgcuggucggcgaaguguuucuggcgaccugauucucgagaucgggaaacuuccacagcaucugacucagagagcccaaaacgcauuagauaauuuggugaugcugcacaacuccgaacagggaggccgcgcguacaggcaugccauggaggagcuccccgacaccauugaaacacugaugcuucuggcucucaucgccguauugaccgguggggugacucuguuuuucuuaagcggccggggacuaggcaagacgucaauagggcugcucugugucauggcaaguagcgugcuucuguggauggcuuccguugagccucacuggaucgccgcaucuauuaucuuggaauuuuuccugauggugcuccugauucccgagccagaucgucagagaaccccucaggacaaucaacuugccuaugucguaaucggacuccuguuuaugauauugacaguggcugcgaacgagaugggucuguuagaaacuaccaagaaagaucuaggcauugggcacguugccguggagaaccaucaccaugcagcuaugcuggacgucgaucuccaccccgccagcgccuggacacuuuacgcaguggcuaccacuaucauuacaccaaugaugaggcauacgaucgaaaauaccacugccaacauaucccugacagcgaucgcuaaucaggccgcaauuuugaugggacuggacaagggcuggccuaucucaaaaauggauauuggugucccgcuccuggcccuugggugcuacucucaggugaaccccuuaacccugaccgcugcaguucucauguugguggcccacuaugcgaucauaggcccaggacugcaagcuaaggccacacgcgaggcacagaaacggacugccgcuggcauuaugaagaauccuacgguagacgggaucguggccaucgaucuagaccccgucguuuacgaugcaaaguucgaaaaacagcugggacagauuaugcuccuuauccuguguaccagucaaauauugcugaugcgaacaacuugggcucucugcgagucgauuacccuggccacaggcccauuaaccacucuuugggaggguagcccugggaaguuuuggaacacgacaaucgcgguguccauggccaauauuuucagaggaucuuaucuggcaggcgcuggucucgccuucucacuaaugaaaagccugggcgggggaaggcgcggcaccggggcacagggagaaacuuugggcgagaaguggaaacggcagcugaaccagcucuccaagagugaauuuaauaccuacaagagaucugguaucauggaggucgaccguagcgaagcuaaagaggggcuuaagaggggagagacaacuaaacacgccgugucacggggcaccgccaagcugcgcugguucguagaacgaaacuuggugaaacccgaggguaagguuauagaccugggcugugggagaggaggcugguccuauuacugcgcggggcucaagaaagugacagaagucaagggauauacgaaaggcgguccggggcaugaggaaccaaucccuauggcuaccuacggauggaauuuagugaagcugcacaguggcaaagaugucuuuuucauucccccagagaagugugacacucuucugugcgauaucggcgagagcucucccaacccuacaauugaagaggggaggacccuacgggugcucaaaaugguugaaccguggcugcgcggaaaucaauuuuguaucaagauuuugaaccccuacaugccauccguaguggagacucuggagcagaugcagagaaagcaugguggcaugcucgucaggaauccucuuucacgaaacagcacacacgaaauguauugggugucgugcgggaccggaaauaucguuucugcagugaacaugacgagucggaugcuguuaaaccguuucaccauggcccacagaaaacccacauacgagcgcgacgucgaucugggcgcugguacuaggcauguggccguagaaccugagguggcaaauuuggacauaauugggcagcggaucgaaaacaucaagcacgagcauaaauccaccuggcacuaugaugaggacaauccauacaagacaugggccuaucauggaagcuacgaaguuaaacccucaggcuccgcuucuagcauggucaacggcguggugaagcuccugacuaagccuugggaugucauuccaaugguuacccaaauagcgaugacagacaccacucccuuugggcagcagagaguguucaaagagaagguagauacgcgcacaccgaaagccaagaggggaaccgcacaaaucauggaagugacugcucgauggcuaugggguuuucuuagucggaauaaaaagccuagaauuuguaccagggaggaauucacacgcaagguccguuccaacgccgcaaucggcgccguguuuguugacgagaaucaguggaacagcgcuaaagaggccguggaagacgagcgguucugggaucugguccacagagaaagggagcuccacaagcaggggaaaugcgcgacgugcguguauaauaugaugggaaagcgcgaaaaaaagcugggcgaguuugguaaggcaaaagggucucgagccauuugguacaugugguugggagcucgguuccuggaguucgaagcccucggcuuuaugaacgaggaccauugguucucaagagaaaauagucuuuccggcguagagggggagggacugcacaaguuagguuacauccugagggauauaagcaaaaucccaggcgggaacauguaugcagacgauaccgcuggaugggacacucgcauuacagaagaugacuugcagaaugaggccaagaucaccgauauuauggaacccgagcaugcucuccuggccaaagcaaucuuuaagcuaacuuaccaaaacaaaguugugagaguccagcggccugcgaagaauggcacagugauggacgugauaucuaggcgugaucagcgagguucggggcaggucggaaccuauggccuuaacacauucacuaacauggaagcccaacugauucgccagauggagucagagggcaucuuuagcccauccgaacucgagacccccaaucuggcugaaagaguuuuguacugguuagagaaguaugggguggaacggcugaaaaggauggccaucaguggagacgauuguguagugaagccgauugacgaccgcuucgcaacggcucucaccgcccuuaacgauauggguaaagucagaaaggacauaccucagugggagcccucuaaaggcuggaaugauuggcagcaagugccauuuugcagccaccacuuccaucagcugaucaugaaggacgggcgggagauuguugugccuuguaggaaccaggaugaacuagucggacgagcacgugugucccagggcgccgguuggucacugagagagacagcgugccucgggaagaguuacgcucaaauguggcaguugauguauuuucaccgccgggaccugaggcuugccgcaaaugccaucuguucugcuguacccguugauugggugccaacuagcagaaccacaugguccauucaugcccaccaucaguggaugacuaccgaagacaugcugucagucuggaaccgcguguggaucgaggaaaaucccuggauggaggauaaaacgcacauaagcucuugggaggacguuccuuaccucggaaagcgggaagaucaauggugcggcuccuuaaucggccugacagcaagggcuaccugggccacuaacauucagguggcgaucaaucagguccgaagauugauugggaacgagaauuaccuggacuauaugacaaguaugaaacgguucaagaacgaaagcgacccagagggagcucucugguga

SEQ ID NO: 14187 - RNA, 9879 nt, Artificial Sequence
  derived and/or modified CDS sequence (opt3) from DENV-1__KM403627__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauauucagaacaccacauucaucauugacggaccagauacuccugaaugucccgacgaucagagagcguggaauaucugggaggucgaggacuauggcuuugguguguucaccacaaacauaugguugaagcucagggauagcuacacgcagaugugcgaccaccgucugauguccgccgcuauuaaagauucaaaggcaguucaugccgacaugggguauuggaucgaaagugagaaaaaugaaaccuggaagcuagcucgggccucuuuuauugaggugaagacuuguaucuggccacgaagccacacacugugguccaacggaguacucgaaucagagaugauaauccccaaaauuuacggcgguccuaucagccaacauaauuauagaccaggcuacuucacccagacugcagggccguggcaccugggaaagcuugaguuggauuucaaccugugcgaaggcacaaccgucgugguggacgagcacugcgggaauaggggacccucuuuacgcacgacuaccgucacaggcaaaauuauccaugaaugguguugccgguccuguacccucccuccacugagauuuaggggugaggaugggugcugguacggaauggagauacgccccguuaaggaaaaagaggaaaaccuugugcgaaguaugguaagcgcgggcucuggugagguggacuccuucucacugggcuugcucugugucaguauuaugaucgaagaggugaugcggagccguuggucgagaaagaugcugaugacugggacacuagccguuuuuuuccugcucaucaugggacagcugaccuggaaugaccuuauuagguugugcaucauggugggcgcuaacgucuccgaucgcauggggaugggaacaacuuaucuggccuuaauggcaaccuuuaagaugcggccuauguucgcugugggccuccuguuuagaaggcuuacgucucgagagguucugcuacucacaauuggucugagcuugguggccucagucgaacugccaaacaguuuagaggaacucggggacggacuggcaaugggcauaaugaugcuuaaacuguugaccgauuuccaaucccaccagcucuggacuacccugcuaucucugacauuuaucaagacuacccuuagccucgacuacgccuggaaaacgauggcuaugguacuguccauugugucauuguucccccuguguuuaagcacaaccagucagaagacuacauggcucccgguucugcuuggcucuuuugggugcaaaccucugaccauguucuugaucacugagaauaagauuuggggacgcaaguccuggccacucaacgaagguaucauggcggugggcauagucagcauccugcuaucgucacugcuuaaaaaugaugugccccucgccgggccucugauugcaggaggcauguugaucgcuuguuauguaauuucugguaguuccgccgacuuaagccuggagcgggccgcugaggugucuugggaagaggaagcagagcauagcggggccucccacaacauccucgucgaaguucaggaugacggaacaaugaagauaaaagaugaggagagagacgauacccugacgauucuucugaaggcgacuuugcuagcugugucaggcguguaccccaugaguaucccagccacccuguuugucugguauuucuggcaaaaaaagaaacagaggagcggcgugcucugggacacaccuucucccccagaaguugagcgugcaguacuggaugacgggaucuaccgcauucuucagcggggauuacuggguagaucccaggugggcgucgggguguuccaagacggaguuuuucauaccauguggcacgugacaaggggcgccguccucauguaucaggguaagcgauuggaaccgucaugggcuagugugaagaaagaucugauaagcuacgggggaggcuggcgguuccagggcuccuggaauacuggggaggagguacaggucaucgcaguggaaccuggaaagaaccccaaaaauguucaaaccacgccagguacauuuaagacucccgagggcgaagugggggccauugcgcucgacuucaaaccuggaaccucuggcucgccaaucgucaaccgcgaggguaagauuguggggcuguacggaaauggcguugugacaaccagcggcacuuaugucucagcuaucgcccaggcaaaggccucccaggaagggccccuuccugagauagaggaugaaguguuuaaaaagagaaaccugaccaucauggacuugcacccgggaagugguaaaacaaggcgguaccuaccagcuauuguacgagaggccaucaagagaaaacugcgcacgcucauuuuagcacccacuagggugguugcuucugaaauggccgaggcgcugaagggcaugccuauccguuaucaaaccacagccgucaagagcgaacauaccgggaaagagauaguggaucuuaugugccacgcaacuuucacaaugcggcugcucuccccagugagaguccccaauuacaacaugauuaucauggacgaggcucauuuuaccgauccugccucaaucgcugcaaggggauauauuucuacgcgcguaggcaugggugaagccgccgcuaucuucaugacugcgacaccgcccgggagcguggagaguuuuccacaguccaaugcaguuauacaggacgaagagcgagauauuccugaaagaagcuggaacucuggauacgacuggaucaccgauuuccccggcaagaccgugugguuugucccaucaauuaaauccggcaaugacaucgccaacuguuugcggaagaacgggaaaagggugauacagcugagucgcaagacuuucgacacagaguaucaaaagaccaaaaauaacgauugggacuacguugugacaacugauauuagcgagaugggagcuaauuuccgugccgacagagucaucgauccucggaggugccucaagcccgugauccugaaagacgguccagaacgcguaauucuugcaggcccgaugccugugacggccgcuucggcggcccagcgaagagggcggaucggaaggaaccagaauaaggagggcgaucaguacauuuauaugggucaaccccuaaacaaugacgaagaucacgcacauuggaccgaggcuaaaaugcuguuggacaacauaaauacaccagaggggaucauucccgccuuauuugaaccugagcgcgaaaagucugcagccaucgauggcgaguacagacugaggggagaagcucggaagacuuucguugagcucaugcgucgcggcgaccugccagucuggcuuuccuauaaaguggccagcgagggguuucaguacucagaucgaagauggugcuucgacggagaaaggaacaaucaggugcuggaggaaaacauggacgucgagaucuggaccaaggaaggugagcggaaaaagcuccgccccagaugguuggaugcgaggacauauagugacccucuggcacuacgggaguuuaaagaauucgccgcuggccgaagaucuguuuccggggaucugauucucgagauaggaaagcuuccgcagcaccugaccuuacgcgcccaaaaugcuuuggacaaccuggugaugcuccacaauagcgaacagggcgguaaagcauacaggcaugccauggaggaacugccagauacuaucgagacgcuuaugcugcucgcuuugauugccguacugaccgggggcgugacauuauuuuuccuaucaggaaagggccuggggaagacuaguaucggacuccuuugugucauggcaagcuccgugcuguuguggauggcgucuguugagccccacuggauugccgcuagcaucauacuggaauuuuuccucauggugcugcuuaucccugagcccgaccggcagcguaccccacaggauaaccaacucgccuaugucguaauuggucuguuguuuaugauccugacaguggcagcuaacgaaaugggcuuacuagagaccacuaaaaaggaccuggggauuggacauguuguggccgagaaucaccaccaugcaacaaugcucgauaucgaccuucacccugccuccgcuuggacgcuguacgcggucgccaccacuauaauuacacccaugaugagacauaccaucgaaaacaccacagcaaauauuucauugacugcuaucgccaaccaggccgcaauacugaugggccucgauaaagguuggccaaucucuaagauggacauuggggugccucugcuugcuuuaggcugcuacagucaggucaauccgcugacgcucaccgccgcgguguugaugcugguugcucacuaugccaucauuggacccggccuacaagcaaaagccacaagggaggcucagaagcgcacugcagccgggaucaugaagaacccaaccguggauggaauaguagcgauugaccuggacccuguggucuacgaugcuaaauucgaaaagcagcucggccagaucaugcuucugaucuuguguacaucgcaaauucugcucaugcggaccacuugggcccugugcgagagcaucacguuagcaacagguccccuuaccacucugugggaaggguccccaggaaaauuuuggaauaccacaauagccguuucuauggcuaacauuuuccgaggcucauaucucgccggugcaggccuagcuuucagccugaugaaguccuuggggggaggcagaagggggacuggagcccagggcgagacccugggugagaaauggaagcgccagcucaaucagcuuaguaagucugaauuuaacacauacaaacggagcgggaucauggagguggacagaucagaagcgaaggagggacugaaacguggcgaaacgaccaagcaugccgucuccagggguacugcaaaauugcggugguucguggagcgcaaucugguaaagccugagggcaaggugauugaucucggguguggacgaggcggguggaguuauuacugcgcuggauuaaaaaagguuacagaagugaaaggcuauaccaagggugggcccggacacgaggaaccgaucccaauggccacuuacggcuggaacauagucaaacugcacagcggcagagacguguuuuucacaccucccgagaagugugauacccuucugugcgacaucggggaaucuuccccaaaucccacgauugaggagggaaggacccuacggguccucaaaaugguggaaccuuggcugcgcgguaaccaauuuuguaucaagauuuugaauccguacaugcccucaguuguagagacacuggaacagaugcagagaaagcauggcgggaugcucgugaggaacccacuuagccgaaauucgacucacgagauguauugggucucuugcggaaccggcaacaucgugagugcaguuaacaugacaucccggaugcuguuaaaucguuucacuauggcucauagaaaaccuaccuacgagcgcgauguggaccugggugccgggacaaggcacgucgccguggaacccgagauugcgaacuuggauaucauaggacagcggauugaaaauaucaagaacgagcacaaaagcaccuggcauuaugacgaagauaauccuuacaagacuugggcuuaucacggcucauacgagguaaaaccauccggcucugcaagcaguauggugaacgggguugucagacuccugacgaagcccugggacgugaucccuauggugacacaaauugccaugaccgacacuaccccauuuggacagcagcgcgucuucaaggagaaaguugauacaaggacgccccgaccgaagcgggguaccgcucaaauaauggaagugacugccaaauggcuauggggcuuucuuuccagaaauaagaaaccuaggaucuguacacgcgaggaauucacccguaagguacggagcaacgcagccauuggggcuguguuugucgacgagaaucaguggaacucugcgaaggaagccguggaggaugagagauucugggaccugguucauagggaacgcgagcuccacaaacagggaaagugcgcaacuugcguguauaauaugaugggcaaacgagaaaagaaacugggugaguuugggaaggcuaagggaucacgggccaucugguacaugugguugggcgcaagauuccuggaauucgaggcccucggcuuuaugaacgaggaucauugguucaguagggaaaauucccuuagcggggucgagggagaaggucugcacaaauuaggcuacauucugcgcgacaucucuaagauaccagggggaaacauguaugcugaugacacagccggcugggauaccagaaucacagaggacgauuugcagaaugaggcgaaaauuacugacaucauggaacccgagcacgcacuccuggccaccucgauuuuuaagcuaacguaccaaaacaaagugguacggguucagaggccugcuaagucagguaccgugauggaugucaucagccgucgagaccagcgcggguccggacaggugggcacauauggccuuaacacuuucaccaauauggaagugcaacugauaagacagauggagagugaagggauuuuuucuccaagcgagcucgagaacuccaaucuggccgaacgggucuuggacugguuagagaaacauggaguugaaaggcugaagcgcauggcaaucucaggugaugacugugugguaaagcccacagaugacagauucgcuacugcccucaccgcucuuaacgauaugggcaaagugcggaaggacaucccgcagugggagccuaguaaaggguggaaugauuggcagcaaguccccuuuugcucucaccauuuccaccagcugauuaugaaggacggaagggaaauagugguuccaugucgaaaccaggaugagcuagugggccgugccagagucagccagggugcaggguggucccugcgcgagacggcgugccucggaaaaucauacgcccaaauguggcaguugauguauuuucaccggagggaccugagacuugcugccaaugcaaucuguagcgcugugccuguaaacuggguucccacaucucgcaccacuugguccauucaugcccaccaucaguggaugacaaccgaagauaugcugaguguguggaaucgggucuggaucgaggaaaacccauggauggaggacaagacucacgugagcucgugggaagacguucccuaccucggcaagagggaggaucaauggugcggcuccuuaauugggcugaccgcacgagccacaugggcgacgaauauccagguggcuauaaaccaggucagacgguugaucggaaaugagaacuaucuggacuacaugaccucuaugaaaagguucaagaaugaaucagauccugagggugcccucugguga

SEQ ID NO: 14188 - RNA, 9879 nt, Artificial Sequence
  derived and/or modified CDS sequence (opt3) from DENV-1__KM403584__SS-prME
agcgugaccaugcugcucaugcuucugcccaccgcauuggcuuuccacuuaacuacgagaggaggggaaccucauaugauagucuccaagcaagaaaggggaaaaucucuguuguuuaagaccucagccgguguuaacaugugcacacucauugcaauggaccugggcgaacuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagguccagcuuacagacuacggggcccugaccuuggacuguaguccaaggacuggacuagauuucaacgaaauggugcugcucacaaugaaggagaaaagcuggcugguacauaagcagugguuucuugaccugccguugcccuggacgucuggcgcauccaccucacaagagacuuggaaucggcaggaucuccugguuacauucaaaaccgcucacgccaagaagcaggaaguggucguguuagguagccaagagggggcuaugcacacagcccugacuggcgcaaccgaaauccagacgaguggaaccacaacuaucuuugccggccaucuaaaaugccgucucaagauggacaaacugacccuuaagggggucucuuaugugauguguacaggauccuucaaauuggagaaggaaguugcugagacucagcacgguaccgugcugguacaggucaaguacgagggcacggaugcgccuugcaaaauuccaauaagcacacaagacgaaaagggggugacccagaacggacgccucaucacugcaaaucccauuguuacagauaaagagaagccugugaacaucgaaaccgagccacccuucggcgagucguauauagucauuggugccggggaaaaagcucugaaacuuucuugguuuaagaaaggcuccucaaucggaaagauguucgaggccacugcaagaggcgccaggcggauggcuauccugggggacaccgccugggauuuuggaaguauugguggcguguucacaagcguagggaaauuggugcaucagguuuuuggaacggcauacggcguccucuucuccggugugucuuggaccaugaagaucgggauuggcauacuguuaacuuggcugggacuaaauagccgaucaacaagucucuccaugaccuguaucgcggugggcauggucacacuguaccuugggguuauggugcaggcugacagcggaugcgugauuaacuggaaaggccgcgaauugaagugugguucugggaucuuuguaacuaacgagguccacaccuggacggaacaauauaaguuccaggccgauucaccgaaaagacugagugcagccaucggaaaggcuugggaggagggcgugugcgguauuaggagcgccacacggcucgaaaauauaauguggaaacagaucuccaacgagcugaaucauauuuuacuggaaaacgacaugaaguuuaccguuguggucggcgacgcauacgggauccuuacucagggcaagaaaaugauucgcccucaacccauggagcacaaauauucuuggaagucguggggcaaggcuaaaaucauaggggccgauacccagaauacaacuuucaucauugacggaccagauaccccugaaugucccgacgaucagagagcguggaacaucugggagguggaggacuacggcuuugguguuuucacaacgaauauuugguugaagcucagggauagcuauacccagaugugcgaccaccgucugauguccgccgcuaucaaagauucaaaggcagugcaugccgacaugggguacuggauagaaagugagaaaaacgaaacuuggaagcuagcucgggccucuuuuauugagguaaagacauguaucuggccacgaagccacacccugugguccaauggaguccucgaaucagagaugauuauccccaaaauauauggcgguccuaucagccaacauaacuacagaccaggcuacuucacucagacagcagggccguggcaccugggaaaacuugaguuggauuucaaucugugcgaaggcaccacggugguggucgacgagcacugcgggaacaggggacccucuuuacgcacuaccacaguuaccggcaaaauuauccaugaaugguguugccgguccuguacucucccuccacugagauuuaggggugaggaugggugcugguauggaauggagauucgccccgugaaggaaaaagaggaaaaucuuguacgaaguauggugagcgcgggcucuggugaggucgacuccuucucacugggcuugcucugugugaguaucaugauagaagagguuaugcggagccguuggucgagaaagaugcugaugacagggacccuagccguguuuuuccugcucauuaugggacagcugacauggaacgaccuuaucagguugugcaucauggucggcgcuaauguguccgaucgcauggggaugggaacuaccuaccuggccuuaauggcaacguuuaagaugcggccuauguucgcuguuggccuccuguuuagaaggcuuacaucucgagaggugcugcuacucaccauuggucugagcuuggucgccucaguagaacugccaaacaguuuagaggaacucggggacggacuggcaaugggcaucaugaugcuuaaacuguugacugauuuccaaucccaccagcucuggaccacacugcuaucucugacuuuuauuaagaccacgcuuagccucgacuaugccuggaaaacaauggcuauggugcuguccauaguuucauuguucccccuguguuuaagcaccacaagucagaagacaaccuggcucccggugcugcuuggcucuuuugggugcaaaccucugacuauguucuugaucacagagaacaagauuuggggacgcaaguccuggccacucaaugaagguaucauggcggucggcauugugagcauccugcuaucgucacugcuuaaaaacgauguaccccucgccgggccucugauagcaggaggcauguugaucgcuuguuacgugauuucugguaguuccgccgacuuaagccuggagcgggccgcugaggucucuugggaagaggaagcagagcauagcggggccucccacaauauccucguugaagugcaggaugacggaaccaugaagauuaaagaugaggagagagacgauacgcugacuauccuucugaaggcgaccuugcuagcugugucaggcgucuaucccaugaguauaccagccacacuguuugugugguacuucuggcagaagaagaaacagaggagcggcguucucugggacaccccuucucccccagaaguagagcgugcagugcuggaugacgggauuuaucgcauccuucagcggggauuacuggguagaucccaggucggcguggggguuuuccaagacggaguguuucauacaauguggcacgucacuaggggcgccgugcucauguaccaggguaagcgauuggaaccgucaugggcuaguguaaagaaagaucugaucagcuacgggggaggcuggcgguuccagggcuccuggaacaccggggaggagguccaggugauugcaguugaaccuggaaagaaucccaaaaacgugcaaacgacaccagguacuuuuaagacccccgagggcgaagucggggccauagcgcucgacuucaaaccuggaacaucuggcucgccaaucgugaaucgcgaggguaagauuguugggcuguauggaaacggcguggucaccacuagcggcaccuacgugucagcuaucgcccaggcaaaggccucccaggaagggccccuuccugagauugaggaugaaguauuuaaaaagagaaaucugacaaucauggacuugcacccgggaagugguaaaacgaggcgguaucuaccagcuauagugcgagaggccaucaagagaaaacugcgcacucucauuuuagcacccaccaggguugucgcuucugaaauggccgaggcgcugaagggcaugccuauccguuaccaaacaaccgccguaaagagcgaacauacugggaaagagauuguggaucuuaugugccacgcaacauucaccaugcggcugcucuccccagucagaguacccaacuauaauaugaucauaauggacgaggcucauuuuacggauccugccucaauugcugcaaggggauacaucucuacucgcgugggcaugggugaagccgccgcuaucuucaugacagcgaccccgcccgggagcguugaggcauuuccacagaguaacgccgugauucaggacgaagaacgagauaucccugaaagauccuggaauagcggauaugacuggauaaccgauuuccccggcaagacugucugguuugugccaucuauuaaaucaggcaacgacaucgcuaauuguuugcggaagaacgggaaaaggguuauucagcugucccgcaagacauucgacaccgaguaccaaaagacuaagaacaaugauugggacuacguggucacuacggauaucagugagaugggagccaacuuccgugcagacagagugauagauccucggaggugccucaagcccguaauucugaaagacgguccagaacgcgugauccuugccggcccgaugccuguuaccgcugcgagcgccgcacagcgaagagggcggaucggaaggaaucagaacaaggagggcgaucaguauauuuacaugggucaaccccuaaauaacgacgaagaucacgcucauuggacagaggccaaaaugcuguuggacaauaucaacacuccagaggggauuauacccgcauuauuugaaccugagcgcgaaaagucggccgcuaucgauggcgaguauagacugaggggagaagcccggaagaccuucgucgagcucaugcgucgcggcgaccugccaguguggcuuucuuacaaaguggcguccgagggguuucaguauagcgaucgaagauggugcuucgacggagaaaggaauaaccagguccuggaggaaaauauggacguugagauuuggacaaaggaaggugagcggaaaaagcuccgccccagaugguuggaugcaaggaccuacucagacccucuggcccuacgggaguuuaaagaguucgcugccggccgaagaagugugucuggggaucugauccucgagaucggaaaacuuccgcagcaccugacuuuacgcgcucaaaacgcauuggacaaucugguaaugcuccacaacuccgaacagggcgguaaagccuauaggcaugcuauggaggaacugccagauacgauugagacccuuaugcugcucgccuugauagcagugcugacagggggcgucacuuuauuuuuccuaagcggaaagggccuggggaagaccucaaucggacuccuuugugugauggcgaguagcguucuguuguggauggccuccguggagccccacuggauugcugccucuaucauucuggaauuuuuccucaugguccugcuuaucccugagcccgaccggcagcguacaccacaggauaaucaacucgcauacguagugauaggucuguuguuuaugauccugaccguugcugccaacgaaaugggcuuacuagagacuacuaaaaaggaccuggggauuggacauguggucgcagagaaccaccaccaugccacgaugcucgauaucgaccuucacccugcuagcgcguggacccuguacgccguggcaacuacaauuaucacccccaugaugagacauaccauagaaaauacaacugcuaacauuuccuugacggccaucgccaaucaggcagcuauucugaugggccucgauaaagguuggccaaucucaaagauggacauaggggucccucugcuugccuuaggcugcuauucucaggugaacccgcugacccucacagcggcuguuuugaugcugguggcccacuacgcaaucauuggacccggccuacaagccaaagcuacuagggaggcacagaagcgcaccgccgcggggaucaugaagaauccaacaguagauggaauuguggcuaucgaccuggacccugucguuuaugaugccaaauucgaaaagcagcucggccagauaaugcuucugauuuuguguaccagucaaauccugcucaugcggacuacgugggcacugugcgagucgaucacauuagccaccgguccccuuacuacccugugggaagggagcccaggacgauuuuggaacacaacuauugcuguguccauggccaauaucuucagaggcucuuaccucgccggugcuggccuagccuucucacugaugaaaagccuagggggaggcaggcgcgggaccggagcgcagggcgagacacugggugagaaguggaagcggcagcucaaccagcuuuccaagagugaauuuaauacguauaagagaucugggauaauggaggucgaccguagcgaagccaaagagggaaugaagaggggcgaaaccacuaaacaugcagugucacgggguacagcuaagcugcgcugguucguagagcgaaacuuggugaaaccugagggcaagguuauugaucugggguguggaagaggcgggugguccuacuauugcgccggacucaagaaagugaccgaagucaagggcuacacuaaaggugggcccggacacgaggaaccgaucccaauggcaacauacggcuggaauauugugaaguuacacaguggcagggacgucuuuuucaccccucccgagaaaugugauacgcugcuuugcgacaucggggaaagcucuccaaaccccaccauagaggagggacggacacugcgcgugcuaaagaugguugaaccuuggcucagagguaaucaauuuuguaucaaaauucugaacccguauaugcccuccguaguggagacuuuggaacagaugcagaggaagcauggcgggaugcugguccgaaauccacucucacggaacagcacccacgagauguacugggugucgugcggaacaggcaauaucguuucugcugugaacaugacaagucguaugcuucugaacagauucaccauggcccaucgcaagccuacauaugagagggaugucgacuuaggugccgggacccggcacguggcgguagaacccgagauugcuaaucuggauaucauuggacagagaaucgaaaacaucaaaaaugagcacaaguccacuuggcauuacgacgaagauaacccuuauaaaacgugggcauaccacggcagcuaugaggugaagccaucaggcuccgccucuagcaugguuaauggggucgugcgcuugcucacaaaacccugggacgugauuccuauggucacccaaaucgcuaugacugacaccacaccauuuggacagcagaggguuuucaaggagaagguggauacgcgaacaccccggccgaaaagagguacugcccaaaucauggaaguaacagcaaaguggcuguggggcuuucuaaguaggaacaaaaagccucgcauuuguacccgugaggaguucacucggaaagugagauccaaugccgcuauaggggcggucuuuguggacgagaaccaguggaauagcgccaaggaagcaguugaggaugagagguucugggaccuugugcaucgcgaacgagagcugcacaagcagggaaaaugcgcuacaugcgucuacaacaugaugggcaagcgggagaaaaagcucggugaguuugggaaagccaagggaucuagagcaaucugguacauguggcugggcgccagguucuuggaguucgaggcucugggcuuuaugaaugaggaucauugguucucacgcgaaaacagucucuccgggguggagggagaaggucuucacaagcugggcuauauuuuaagagacaucagcaaaauuccagggggaaauauguacgccgaugacaccgcgggcugggauacacggaucacugaggacgaucugcagaacgaggcaaagauaaccgacaucauggaacccgagcacgccuugcucgcuacgucuauuuuuaaacugaccuaucaaaauaagguaguuagggugcagcguccugccaaaucggguacagucauggaugugaucucacgacgcgaccagagagggagcggacaggugggcacuuacggccuaaacaccuucacaaacauggaaguccaacuuauucggcagauggaguccgaagggaucuuuaguccaucugagcuggagaauagcaaccucgcagaaaggguucuggacugguuggagaagcauggaguggaacgcuuaaaaagaauggcuauauccggugaugacuguguagugaagcccacugaugaccgguucgccaccgcucugacggcccucaaugauaugggcaaggucaggaaagacauuccgcagugggagccuucaaagggguggaacgauuggcagcaagugcccuuuugcagucaccauuuccaccagcuuaucaugaaagacggacgagaaaucguugugccaugucguaaucaggaugagcuggucggcagagcacgcgugucucagggugcgggguggagccuacgggagacagccugccugggaaaguccuaugcucaaauguggcagcucauguacuuucacaggagagacuugcgccuggccgcaaacgcuauuuguucagccguaccuguuaauugggugcccaccagccggacuacauggucuauacaugcacaccaucaguggaugaccacugaagauaugcuuuccgucuggaacaggguguggaucgaggaaaauccauggauggaggacaaaacccacguuaguagcugggaagacgugcccuaucugggcaagcgagaggaucaauggugcggcucgcucauuggguuaacagccagagcgacgugggcuaccaacauccaggucgccauuaaucaggugcggaggcugaucggaaacgagaauuacuuggacuacaugacuuccaugaagcgcuucaaaaacgaaucugauccugagggugcacugugguga

SEQ ID NO: 14189 - RNA, 9879 nt, Artificial Sequence
  derived and/or modified CDS sequence (opt3) from DENV-1__KM403633__SS-prME
agcgugaccaugcugcucaugcuucugcccacugcauuggcuuuccacuuaacuacgagaggaggggaaccucauaugaucgucuccaagcaggaaaggggaaaaucucuguuguuuaagaccucagccgguguuaacaugugcacucucauugcaauggaccugggcgaacuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugcgggagaaaagcuggcuggugcauaaacagugguuucuugaccugccguugcccuggacgucuggcgcauccaccucacaagaaacuuggaaucgucaggaucuccugguaacauucaagaccgcucacgccaaaaagcaggaaguuguggucuuagguagccaagagggggcuaugcacacagcccugacuggcgcaaccgaaauccagacgaguggaaccacaacuauuuuugccggccaucuaaagugccgccucaaaauggacaagcugacccuuaaaggggugucuuaugucauguguacaggauccuucaaguuggagaaagaaguggcugagacucagcacgguaccguucuggugcagguaaaguacgagggcacggaugcgccuugcaagauaccaaucagcacacaagacgaaaaaggggucacccagaacggaagacucauuacugcaaaucccaucgugacagauaaggagaaaccuguuaacauagaaaccgagccacccuucggcgagucguauauugugaucggugccggggaaaaggcucugaaacuuucuugguuuaagaagggcuccucaaucggaaaaauguucgaggccacugcaaggggcgcccggcgaauggcuauucugggggacaccgccugggauuuuggaaguaucgguggcgucuucacaagcguggggaaguugguacaucagguguuuggaacggcauacggcguucucuucuccggugucucuuggaccaugaaaauugggauaggcauccuguuaacuuggcugggacuaaauagccgcucaacaagucucuccaugaccuguauugcggugggcauggugacacuguaccuuggggucaugguucaggcugacagcggaugcgugaucaacuggaagggcagagaauugaaaugugguucugggaucuuugugacuaacgagguacacaccuggacggaacaauauaaguuccaggccgauucaccgaagaggcugagugcagccauuggaaaggcuugggaggagggcgucugcgguauacggagcgccacacgccucgaaaauaucauguggaagcagauuuccaacgagcugaaucauaucuuacuggaaaacgacaugaaauuuaccgugguugugggcgacgcaaaugggauucuuacucagggaaagaaaaugaucagaccucaacccauggagcacaaguacucuuggaaaucguggggcaaggcuaagauaaucggggccgauacccagaacacaacuuucauuaucgacggaccagauaccccugaaugucccgacgaucagagggcguggaauauuugggaggucgaggacuauggcuuugguguguucacaacgaacaucugguugaaacuccgugauagcuacacccagaugugcgaccaccggcugauguccgccgcuauaaaggauucaaaagcaguucaugccgacaugggguauuggauugaaagugagaagaaugaaacuuggaaacuagcucgagccucuuuuaucgaggugaagacauguauuuggccaagaagccacacccugugguccaacggaguacucgaaucagagaugaucauacccaagaucuacggcgguccuauuagccaacauaauuauaggccaggcuacuucacucagacagcagggccguggcaccugggaaaacuugaguuggauuucaaccugugcgaaggcaccacggucgugguggacgagcacugcgggaaucgcggacccucuuuacggacuaccacagucaccggcaagaucauucaugaaugguguugcagauccuguacucucccuccacugagguuucgcggugaggaugggugcugguacggaauggagauccgacccguuaaagaaaaggaggaaaaccuugugcggaguaugguaagcgcgggcucuggugagguggacuccuucucacugggcuugcucugugucaguauaaugauugaagaggugaugcguagcagauggucgaggaaaaugcugaugacagggacccuagccguauuuuuccugcucaucaugggacagcugacauggaaugaccuuauccgcuugugcauuauggugggcgcuaacgucuccgaucggauggggaugggaacuaccuaucuggccuuaauggcaacguuuaagaugagaccuauguucgcugugggccuccuguuuaggcgacuuacaucucgcgagguucugcuacucaccaucggucugagcuugguggccucagucgaacugccaaacaguuuagaggaacucggggacggacuggcaaugggcauuaugaugcuuaagcuguugacugauuuccaaucccaccagcucuggaccacacugcuaucucugacuuuuauaaaaaccacgcuuagccucgacuacgccuggaagacaauggcuaugguacuguccaucgugucauuguucccccuguguuuaagcaccacaagucagaaaacaaccuggcucccgguucugcuuggcucuuuugggugcaagccucugacuauguucuugauuacagagaauaaaaucuggggacggaaguccuggccacucaacgaagguauuauggcggugggcaucgucagcauacugcuaucgucacugcuuaagaaugaugugccccucgccgggccucugaucgcaggaggcauguugauugcuuguuauguaaucucugguaguuccgccgacuuaagccuggagagagccgcugaggugucuugggaagaggaagcagagcauagcggggccucccacaacauucucgucgaaguucaggaugacggaaccaugaaaaucaaggaugaggagagggacgauacgcugacuauacuucugaaagcgaccuugcuagcugugucaggcguguaccccaugaguauuccagccacacuguuugucugguauuucuggcaaaagaaaaagcagcguagcggcgugcucugggacaccccuucucccccagaaguugagcgcgcaguacuggaugacgggaucuaccggauccuucagagaggauuacuggguaggucccaggugggcgucgggguguuccaagacggaguuuuucauacaauguggcacgugacucgaggcgccguccucauguaucaggguaaacgguuggaaccgucaugggcuagugugaagaaggaucugauuagcuacgggggaggcuggcgcuuccagggcuccuggaauaccggggaggagguacaggucauagcaguggaaccuggcaaaaaccccaagaauguucaaacgacaccagguacuuuuaaaacccccgagggcgaagugggggccaucgcgcucgacuucaagccuggaacaucuggcucgccaauugucaacagagaggguaaaaucguggggcuguacggaaauggcguugugaccacuagcggcaccuaugucucagcuauugcccaggcaaaggccucccaggaagggccccuuccugagaucgaggaugaaguguuuaagaaaaggaaccugacaauaauggacuugcacccgggaagugguaagacgcggcgauaccuaccagcuaucguaagagaggccauuaaacgcaagcugaggacucucaucuuagcacccacccgugugguugcuucugaaauggccgaggcgcugaaaggcaugccuauucgguaucaaacaaccgccgucaagagcgaacauacugggaaggagaucguggaucuuaugugccacgcaacauucaccaugagacugcucuccccagugaggguccccaauuacaacaugauaauuauggacgaggcucauuuuacggauccugccucaaucgcugcacgcggauauaucucuacucgaguaggcaugggugaagccgccgcuauuuucaugacagcgaccccgcccgggagcguggaggcauuuccacagaguaaugccguuauccaggacgaagagagagauauaccugaacgguccuggaacagcggauacgacuggauuaccgauuuccccggcaaaacugugugguuugucccaucuaucaagucaggcaaugacauugcuaacuguuugaggaaaaacgggaagcgcgugauccagcugucccguaaaacauucgacaccgaguaucaaaagacaaagaauaacgauugggacuacguugugacuacggauauaagugagaugggagccaauuucagagcagaccgggucauugauccuaggcgcugccucaaacccgugauccugaaggacgguccagaacgaguaauccuugccggcccgaugccugugaccgcugcgagcgccgcacagagacgggggaggauuggacgcaaccagaauaaagagggcgaucaguacaucuauaugggucaaccccuaaacaaugacgaagaucacgcucauuggacagaggccaagaugcuguuggacaacauuaauacuccagaggggauaauccccgcauuauuugaaccugagagagaaaaaucggccgcuauugauggcgaguacaggcugcggggagaagcccguaagaccuucguugagcucaugcgccgaggcgaccugccagucuggcuuucuuauaagguggcguccgagggguuucaguacagcgauagaagguggugcuucgacggagaacggaacaaucaggugcuggaggaaaacauggacgucgagaucuggacaaaagaaggugagcgcaagaaacucagacccaggugguuggaugcacggaccuauucagacccucuggcccuacgagaguuuaaggaguucgcugccggcagacgcaguguuucuggggaucugauccucgagauuggaaaacuuccgcagcaccugacuuuaagggcucaaaaugcauuggacaaccuggugaugcuccacaauuccgaacagggcgguaaggccuaccggcaugcuauggaggaacugccagauacgauagagacccuuaugcugcucgccuugaucgcaguacugacagggggcgugacuuuauuuuuccuaagcggaaaaggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccgucagagaacaccacaggauaaccaacucgcauaugucguaaucggucuguuguuuaugauucugaccguggcugccaacgaaaugggcuuacuagagacuacaaagaaagaccuggggaucggacauguuguggcagagaaucaccaccaugccacgaugcucgauauugaccuucacccugcuagcgcguggacccuguacgccgucgcaacuacaaucauaacccccaugaugaggcauaccauugaaaacacaacugcuaauaucuccuugacggccauugccaaccaggcagcuauccugaugggccucgauaaggguuggccaauaucaaaaauggacaucggggugccucugcuugccuuaggcugcuacucucaggucaauccgcugacccucacagcggcuguguugaugcugguugcccacuaugcaauuaucggacccggccuacaagccaaggcuacucgcgaggcacagaaacggaccgccgcggggauuaugaagaacccaacaguggauggaaucguagcuauagaccuggacccuguggucuacgaugccaaguucgaaaaacagcucggccagauuaugcuucugaucuuguguaccagucaaauccugcucaugcgaacuacgugggcacugugcgagucgauuacauuagccaccgguccccuuacuacccugugggaagggagcccaggaaaguuuuggaauacaacuaucgcuguuuccauggccaacauauucagaggcucuuaucucgccggugcuggccuagccuucucacugaugaaaagccuagggggaggcaggcgcgggaccggagcgcagggcgagacacugggugagaaguggaaacggcagcucaaucagcuuuccaagagugaauuuaacacguacaagagaucugggauuauggagguggaccguagcgaagccaaagagggacugaagaggggcgaaaccacuaaacaugcagucucacgggguacagcuaaguugcgcugguucguggagcgaaaucugguaaaaccugagggcaaggugaucgaucucggguguggaagaggcgggugguccuauuacugcgccggauuaaagaaaguuaccgaagugaagggcuauacuaaaggugggcccggacacgaggaaccgauuccaauggcaacauacggcuggaacaucgucaagcugcacaguggcagggacguguuuuucaccccucccgagaaaugugauacgcuucugugcgacauaggggaaagcucuccaaaucccaccaucgaggagggacggacacuacgcguccucaagaugguggaaccuuggcugagagguaaccaauuuuguauuaaaaucuugaauccguacaugcccuccguuguagagacucuggaacagaugcagaggaagcauggcgggaugcucgugcgaaacccacuuucacggaauagcacccacgagauguauugggucucgugcggaacaggcaacauugugucugcuguuaacaugacaagucguaugcuguuaaauagauucaccauggcccaucgcaagccuacauacgagagggauguggaccugggugccgggacccggcacgucgcgguggaacccgagaucgcuaacuuggauauuaucggacagagaauagaaaauauuaaaaacgagcacaaguccacuuggcauuaugacgaagauaauccuuacaaaacgugggcauaucacggcagcuacgagguaaagccaucaggcuccgccucuagcauggugaacgggguuguccgccuccugacaaaacccugggacgugaucccuauggugacccaaaucgcuaugacugacaccacaccauuuggacagcagagggucuucaaggagaagguugauacgcgaacaccccggccgaaaagagguacugcccaaauuauggaagugacagcaaaguggcuauggggcuuucuuaguaggaauaaaaagccucgcauauguacccgugaggaguucacucggaaaguaagauccaacgccgcuaucggggcgguguuugucgacgagaaucaguggaacagcgccaaggaagcaguggaggaugagagguucugggaccugguucaucgcgaacgagagcuccacaagcagggaaaaugcgcuacaugcguguauaauaugaugggcaagcgggagaagaaacugggugaguuugggaaagccaagggaucuagagcaauuugguacaugugguugggcgccagguuccuggaguucgaggcucucggcuuuaugaacgaggaucauugguucucacgcgaaaauagucuuuccggggucgagggagaaggucugcacaaguuaggcuacauccugagagacauuagcaaaaucccagggggaaacauguaugccgaugacaccgcgggcugggauacacggauaacugaggacgauuugcagaaugaggcaaagaucaccgacauuauggaacccgagcacgcccuccuggcuacgucuaucuuuaaacuaaccuaccaaaacaaggugguaaggguucagcguccugccaaaucggguacagugauggaugucauuucacgacgcgaccagagagggagcggacaggugggcacuuauggccuuaacaccuucacaaauauggaagugcaacugauccggcagauggaguccgaagggauauuuaguccaucugagcucgagaacagcaaucuggcagaaagggucuuggacugguuagagaagcauggaguugaacgccugaaaagaauggcuauuuccggugaugacugugugguaaagcccacugaugaccgguucgccaccgcucucacggcccuuaacgauaugggcaaggugaggaaagacaucccgcagugggagccuucaaagggguggaaugauuggcagcaaguccccuuuugcagucaccauuuccaccagcugaucaugaaagacggacgagaaauugugguuccaugucguaaccaggaugagcuagugggcagagcacgcgucucucagggugcgggguggagccugcgggagacagccugccucggaaaguccuacgcucaaauguggcaguugauguauuuucacaggagagaccugcgccuugccgcaaaugcuauauguucagccgugccuguaaacuggguucccaccagccggacuacauggucuauccaugcacaccaucaguggaugaccacugaagauaugcuguccguguggaauagggucuggauugaggaaaacccauggauggaggacaaaacccacgugaguagcugggaagacguucccuaccucggcaagcgagaggaucaauggugcggcucguuaaucgggcugacagccagagcgacgugggcuaccaauauucagguggccaucaaccagguccggagguugauaggaaaugagaacuaucuggacuacaugacuuccaugaagcgcuucaaaaaugaaucugauccugagggugcacucugguga

SEQ ID NO: 14190 - RNA, 9879 nt, Artificial Sequence
  derived and/or modified CDS sequence (opt3) from DENV-1__KM403592__SS-prME
agcgugaccaugcugcucaugcuucugcccacagcauuggcuuuccacuuaacuacgagaggcggggaaccucauaugaucgucuccaagcaagaaaggggaaaaucucuguuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucgcacagaacggacgccucauuaccgccaaucccaucgugacugauaaagagaagccuguuaacauagaaacagagccacccuucggcgagucguauauugugaucggugcuggggaaaaagcccugaaacuuucuugguuuaagaaaggcuccucaaucggaaagauguucgaggcaaccgccagaggcgcuaggcggauggccauucugggggacacugcaugggauuuuggaaguaucgguggcgucuucaccagcguggggaaauugguacaucagguguuuggaacagcguacggcguucucuucuccggugucucuuggacgaugaagauugggauaggcauccuguuaaccuggcugggacuaaauagccgaucaacaagucucuccaugacauguauugcugugggcauggugacccuguaccuuggggucaugguucaggccgacagcggaugcgugaucaacuggaaaggccgcgaauugaagugugguucugggaucuuugugacaaacgagguacacacuuggaccgaacaauauaaguuccaggcagauucaccgaaaagacugagugccgcuauuggaaaggccugggaggagggcgucugcgguauaaggagcgcaacgcggcucgaaaauaucauguggaaacagauuuccaacgagcugaaucauaucuuacuggaaaacgacaugaaguuuacagugguugugggcgacgcuaaugggauucuuacccagggcaagaaaaugauccgcccucaacccauggagcacaaauacucuuggaagucguggggcaaggccaaaauaaucggggcggauacucagaacaccacauucauuaucgacggaccagauacuccugaaugucccgacgaucagagagccuggaauauuugggaggucgaggacuauggcuuugguguguucaccacaaacaucugguugaagcucagggauagcuacacgcagaugugcgaccaccgucugauguccgcugcaauaaaagauucaaaggccguucaugcugacaugggguauuggauugaaagugagaaaaaugaaaccuggaagcuagcccgggcaucuuuuaucgaggugaagacuuguauuuggccacgaagccacacacugugguccaacggaguacucgaaucagagaugaucauacccaaaaucuacggcgguccuauuagccaacauaauuauagaccaggcuacuucacccagacugcggggccguggcaccugggaaaacuugaguuggauuucaaccugugcgaaggcacaaccgucgugguggacgagcacugcgggaauaggggacccucuuuacgcacgacuaccgucacaggcaaaaucauucaugaaugguguugccgguccuguacccucccuccacugagauuuaggggugaggaugggugcugguacggaauggagauccgccccguuaaggaaaaagaggaaaaccuugugcgaaguaugguaagcgccggcucuggugagguggacuccuucucacugggcuugcucugugucaguauaaugauugaagaggugaugcggagccguuggucgagaaagaugcugaugacugggacacuagcuguauuuuuccugcucaucaugggacagcugaccuggaaugaccuugugagguugugcaucauggucggcgccaacguguccgaucgcauggggaugggaacaacuuaucuggcauuaauggcuaccuuuaagaugcggccuauguucgccguuggccuccuguuuagaaggcuuacgucucgagaggugcugcuacucacaauuggucugagcuuggucgcaucaguagaacugccaaacaguuuagaggaacucggggacggacuggccaugggcaucaugaugcuuaaacuguugaccgauuuccaaucccaccagcucuggacuacccugcuaucucugacauuuauuaagacuacccuuagccucgacuacgcuuggaaaacgauggcgauggugcuguccauaguuucauuguucccccuguguuuaagcacaaccagucagaagacuacauggcucccggugcugcuuggcucuuuugggugcaaaccucugaccauguucuugaucacugagaauaagauuuggggacgcaaguccuggccacucaacgaagguaucauggccgucggcauugugagcauccugcuaucgucacugcuuaaaaaugauguaccccucgcagggccucugauagcuggaggcauguugaucgccuguuaugugauuucugguaguuccgccgacuuaagccuggagcgggcugcagaggucucuugggaagaggaagccgagcauagcggggcgucccacaacauccucguugaagugcaggaugacggaacaaugaagauuaaagaugaggagagagacgauacccugacgauccuucugaaggcuacuuugcuagccgugucaggcgucuaccccaugaguauaccagcaacccuguuugugugguauuucuggcagaagaagaaacagaggagcggcguucucugggacacaccuucucccccagaaguagagcgugccgugcuggaugacgggauuuaccgcauccuucagcggggauuacuggguagaucccaggucggcguggggguuuuccaagacggaguguuucauaccauguggcacgucacaaggggcgcugugcucauguaucaggguaagcgauuggaaccgucaugggcaaguguaaagaaagaucugaucagcuacgggggaggcuggcgguuccagggcuccuggaauacuggggaggagguccaggugauugccguugaaccuggaaagaaccccaaaaaugugcaaaccaugccagguacguuuaagacacccgagggcgaagucggggcgauagcucucgacuucaaaccuggaacuucuggcucgccaaucgugaaccgcgaggguaagauuguugggcuguacggaaauggcguggucaccacaagcggcaccuaugugucagccaucgcacaggccaaggcuucccaggaagggccccuuccugagauugaggaugaaguauuuaaaaagagaaaccugacuaucauggacuugcacccgggaagugguaaaaccaggcgguaccuaccagccauagugcgagaggcaaucaagagaaaacugcgcacacucauuuuagcucccacgaggguugucgccucugaaauggcggaggcccugaagggcaugccuauccguuaucaaacuaccgcaguaaagagcgaacauacagggaaagagauuguggaucuuaugugccacgcuaccuucacuaugcggcugcucuccccagucagaguacccaauuacaacaugaucauaauggacgaggcccauuuuacagauccugcuucaauugcagccaggggauauaucucuacccgcgugggcaugggugaagccgcugcgaucuucaugacggcaacuccgcccgggagcguugaggccuuuccacagaguaaugcugugauucaggacgaagaacgagauaucccugaaagauccuggaacagcggauacgacuggauaacagauuuccccggcaagaccgucugguuugugccaucuauuaaaucaggcaaugacaucgccaacuguuugcggaagaacgggaaaaggguuauucagcugucccgcaagaccuucgacacugaguaucaaaagacuaagaauaacgauugggacuacguggucaccacagauaucagugagaugggagcaaauuuccgugccgacagagugauagauccucggaggugccucaagcccguaauucugaaagacgguccagaacgcgugauccuugcuggcccgaugccuguuacugcggccagcgcagcucagcgaagagggcggaucggaaggaaccagaauaaggagggcgaucaguacauuuauaugggucaaccccuaaacaaugacgaagaucacgcccauuggacggaggcaaaaaugcuguuggacaacaucaauaccccagaggggauuauacccgccuuauuugaaccugagcgcgaaaagucggcugccaucgauggcgaguacagacugaggggagaagcgcggaagacauucgucgagcucaugcgucgcggcgaccugccaguguggcuuucuuauaaaguggcauccgagggguuucaguacagcgaucgaagauggugcuucgacggagaaaggaacaaucagguccuggaggaaaacauggacguugagauuuggacuaaggaaggugagcggaaaaagcuccgccccagaugguuggaugccaggaccuauucagacccucuggcucuacgggaguuuaaagaguucgccgcuggccgaagaagugugucuggggaucugauccucgagaucggaaaacuuccgcagcaccugacauuacgcgcacaaaaugccuuggacaaccugguaaugcuccacaauuccgaacagggcgguaaggcuuacaggcaugccauggaggaacugccagauaccauugagacucuuaugcugcucgcauugauagcggugcugaccgggggagucaccuuauuuuuccuaagcggaaagggccuggggaagacaucaaucggacuccuuugugugauggccaguagcguucuguuguggauggcuuccguggagccccacuggauugccgcaucuaucauucuggaauuuuuccucaugguccugcuuaucccugagcccgaccggcagcguacuccacaggauaaccaacucgcuuauguagugauaggucuguuguuuaugauccugaccguugccgcaaacgaaaugggcuuacuagagacaaccaaaaaggaccuggggauuggacauguggucgccgagaaucaccaccaugcuacuaugcucgauaucgaccuucacccugcgagcgccuggacacuguacgcaguggcuacgaccauuaucacucccaugaugagacauacaauagaaaacaccaccgccaauauuuccuugacagccaucgcaaaccaggcugccauucugaugggccucgauaaagguuggccaaucucaaagauggacauaggggucccucugcuugcguuaggcugcuacucucaggugaauccgcugacucucacggcugccguuuugaugcugguggcacacuaugccaucauuggacccggccuacaagcuaaagcaaccagggaggcccagaagcgcacagcggcugggaucaugaagaacccaacuguagauggaauuguggccaucgaccuggacccugucguuuacgaugcaaaauucgaaaagcagcucggccagauaaugcuucugauuuuguguaccagucaaauccugcucaugcggacaaccugggcccugugcgagucgaucacuuuagcuacggguccccuuacaacccugugggaagggagcccaggaaaauuuuggaauacuaccauugccguguccauggcaaacaucuuccgaggcucuuaucucgcuggugccggccuagcguucucacugaugaaaagccuagggggaggcagaagggggacaggagcccagggcgagacucugggugagaaauggaagcgccagcucaaucagcuuuccaagagugaauuuaacaccuacaaacggucugggauaauggaggucgacagaagcgaagcaaaggagggacugaaacguggcgaaacaacgaagcaugcugugucaagggguaccgccaaauugcggugguucguagagcgcaaucuggugaagccugagggcaagguuauugaucucggguguggacgaggcgggugguccuauuacugcgcaggacuaaagaaggugacugaagucaaaggcuauacaaagggugggcccggacacgaggaaccgaucccaauggcuaccuacggcuggaacauugugaaacugcacaguggcagagacgucuuuuucacuccucccgagaagugugauacacuucugugcgacaucggggaaagcucuccaaaucccaccauagaggagggaaggacgcuacgggugcucaaaaugguugaaccuuggcugcgcgguaaccaauuuuguaucaagauuuugaauccguacaugcccuccguaguggagacccuggaacagaugcagagaaagcauggcgggaugcucgucaggaacccacuuucacgaaauagcacacacgagauguauugggugucgugcggaacuggcaacaucguuucugccgugaacaugaccagucggaugcuguuaaaucguuucacaauggcccauagaaaaccuacuuacgagcgcgaugucgaccugggugcggggaccaggcacguggcuguagaacccgagauugcaaacuuggauaucauuggacagcggaucgaaaauauaaagaacgagcacaaauccacauggcauuaugacgaagauaauccuuacaagaccugggccuaucacggcagcuacgaggugaaaccaucaggcuccgcuucuagcaugguuaacggggucgugagacuccugacuaagcccugggacgugauuccuauggucacgcaaaucgccaugacagacaccacuccauuuggacagcagcgcguuuucaaggagaaaguggauaccaggacaccccgaccgaagcgggguacggcacaaaucauggaaguaaccgccaaauggcuauggggcuuucuuaguagaaauaagaaaccuaggauuuguacucgcgaggaguucacacguaaggugcgguccaacgcugcgauaggggccgucuuuguggacgagaaucaguggaacagcgcaaaggaagcuguugaggaugagagauucugggaccuggugcauagggaacgcgagcuccacaaacagggaaagugcgccacgugcgucuauaauaugaugggcaaacgagaaaagaaacugggugaguuugggaaggcaaagggaucucgggccaucugguacaugugguugggcgcuagauuccuggaguucgaggcccucggcuuuaugaacgaggaucauugguucucaagggaaaauagucuuuccgggguggagggagaaggucugcacaaauuaggcuacauucugcgcgacaucagcaagauuccagggggaaacauguaugcggaugacacugcaggcugggauacaagaaucaccgaggacgauuugcagaaugaggccaaaauaacagacaucauggaacccgagcacgcucuccuggccacuucuauuuuuaagcuaaccuaccaaaacaaaguaguucgggugcagaggccugcaaagucggguacggucauggaugugaucucacgucgagaccagcgcgggagcggacaggugggcaccuauggccuuaacacauucacuaauauggaaguccaacugauuagacagauggaguccgaagggaucuuuaguccaucugagcucgagaacagcaaucuggcugaacggguuuuggacugguuagagaaacauggaguggaaaggcugaagcgcauggccauauccggugaugacuguguagugaagcccaccgaugacagauucgcuacagcccucacugcacuuaacgauaugggcaaaguccggaaggacauuccgcagugggagccuucaaaaggguggaaugauuggcagcaagugcccuuuugcagucaccauuuccaccagcugaucaugaaggacggaagggaaaucguugugccaugucgaaaccaggaugagcuagucggccgugcgagagugucucagggugccggguggagccugcgcgagaccgcuugccucggaaaauccuacgcccaaauguggcaguugauguauuuucaccggagggaccugagacuugcagcuaaugccauuuguucagcaguaccuguuaacugggugcccacgagccgcacaaccuggucuauacaugcccaccaucaguggaugacuacagaagauaugcuguccgucuggaaucggguguggaucgaggaaaacccauggauggaggacaagacccacguuaguagcugggaagacgugcccuaccucggcaagagggaggaucaauggugcggcucguuaauugggcugacugcgcgagcuaccugggccacaaauauccaggucgcaauuaaccaggugagacgguugaucggaaaugagaacuaucuggacuacaugacguccaugaaaagguucaagaaugaaucugauccugagggugcccucugguga

SEQ ID NO: 14191 - RNA, 9879 nt, Artificial Sequence
  derived and/or modified CDS sequence (opt3) from DENV-1__KM403593__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucgcacagaacggacgccucauuaccgccaaucccaucgugacugauaaagagaagccuguuaacauagaaacagagccacccuucggcgagucguauauugugaucggugcuggggaaaaagcccugaagcuuucuugguuuaagaaaggcuccucaaucggaaagauguucgaggcaaccgccagaggcgcuaggcggauggccauucugggggacacugcaugggauuuuggaaguaucgguggcgucuucaccagcguggggaaauugguacaucagguguuuggaacagcguacggcguucucuucuccggugucucuuggacgaugaagauugggauaggcauccuguuaaccuggcugggacuaaauagccgaucaacuagucucuccaugacauguauugcugugggcauggugacccuguaccuuggggucaugguucaggccgacagcggaugcgugaucaacuggaaaggccgcgaauugaagugugguucugggaucuuugugacaaacgagguacacacuuggaccgaacaauauaaguuccaggcagauucaccgaaaagacugagugccgcuauuggaaaggccugggaggagggcgucugcgguauaaggagcgcaacgcggcucgaaaauaucauguggaaacagauuuccaacgagcugaaucauaucuuacuggaaaacgacaugaaguuuacagugguugugggcgacgcuaaugggauucuuacccagggaaaaaagaugauccgcccucaacccauggagcacaaauacucuuggaagucguggggcaaggccaaaauaaucggggcggauacucagaacaccacauucauuaucgacggaccagauacuccugaaugucccgacgaucagagagccuggaauauuugggaggucgaggacuauggcuuugguguguucaccacaaacaucugguugaagcucagggauagcuacacgcagaugugcgaccaccgucugauguccgcugcaauaaaagauucaaaggccguucaugcugacaugggguauuggauugaaagugagaaaaaugaaaccuggaagcuagcccgggcaucuuuuaucgaggugaagacuuguauuuggccacgaagccacacacugugguccaacggaguacucgaaucagagaugaucauacccaaaaucuacggcgguccuauuagccaacauaauuauagaccaggcuacuucacccagacugcggggccguggcaccugggaaagcuugaguuggauuucaaccugugcgaaggcacaaccgucgugguggacgagcacugcgggaauaggggacccucuuuacgcacgacuaccgucacaggcaaaaucauucaugaaugguguugccgguccuguacccucccuccacugagauuuaggggugaggaugggugcugguacggaauggagauccgccccguuaaggaaaaagaggaaaaccuugugcgaaguaugguaagcgccggcucuggugagguggacuccuucucacugggcuugcucugugucaguauaaugauugaagaggugaugcggagccguuggucgagaaagaugcugaugacugggacacuagcuguuuuuuuccugcucaucaugggacagcugaccuggaaugaccuuaucagguugugcauuauggugggcgccaacgucuccgaucgcauggggaugggaacaacuuaucuggcauuaauggcuaccuuuaagaugcggccuauguucgccgugggccuccuguuuagaaggcuuacgucucgagagguucugcuacucacaaucggucugagcuugguggcaucagucgaacugccaaacaguuuagaggaacucggggacggacuggccaugggcauuaugaugcuuaaacuguugaccgauuuccaaucccaccagcucuggacuacccugcuaucucugacauuuauaaagacuacccuuagccucgacuacgcuuggaaaacgauggcgaugguacuguccaucgugucauuguucccccuguguuuaagcacaaccagucagaagacuacauggcucccgguucugcuuggcucuuuugggugcaaaccucugaccauguucuugauuacugagaauaagaucuggggacgcaaguccuggccacucaacgaagguauuauggccgugggcaucgucagcauacugcuaucgucacugcuuaaaaaugaugugccccucgcagggccucugaucgcuggaggcauguugauugccuguuauguaaucucugguaguuccgccgacuuaagccuggagcgggcugcagaggugucuugggaagaggaagccgagcauagcggggcgucccacaacauucucgucgaaguucaggaugacggaacaaugaagaucaaagaugaggagagagacgauacccugacgauacuucugaaggcuacuuugcuagccgugucaggcguguaccccaugaguauuccagcaacccuguuugucugguauuucuggcaaaaaaagaaacagaggagcggcgugcucugggacacaccuucucccccagaaguugagcgugccguacuggaugacgggaucuaccgcauccuucagcggggauuacuggguagaucccaggugggcgucgggguguuccaagacggaguuuuucauaccauguggcacgugacaaggggcgcuguccucauguaucaggguaagcgauuggaaccgucaugggcaagugugaagaaagaucugauuagcuacgggggaggcuggcgguuccagggcuccuggaauacuggggaggagguacaggucauagccguggaaccuggaaagaaccccaaaaauguucaaaccacgccagguacauuuaagacucccgagggcgaagugggggcgaucgcucucgacuucaaaccuggaaccucuggcucgccaauugucaaccgcgaggguaagaucguggggcuguacggaaauggcguugugacaaccagcggcacuuaugucucagccauugcacaggccaaggcuucccaggaagggccccuuccugagaucgaggaugaaguguuuaaaaagagaaaccugaccauaauggacuugcacccgggaagugguaaaacaaggcgguaccuaccagccaucguacgagaggcaauuaagagaaaacugcgcacgcucaucuuagcucccacuagggugguugccucugaaauggcggaggcccugaagggcaugccuauucguuaucaaaccacagcagucaagagcgaacauaccgggaaagagaucguggaucuuaugugccacgcuacuuucacaaugcggcugcucuccccagugagaguccccaauuacaacaugauaauuauggacgaggcccauuuuaccgauccugcuucaaucgcagccaggggauauaucucuacgcgcguaggcaugggugaagccgcugcgauuuucaugacugcaacaccgcccgggagcguggaggccuuuccacagaguaaugcuguuauccaggacgaagagcgagauauaccugaaagauccuggaacagcggauacgacuggauuaccgauuuccccggcaagaccgugugguuugucccaucuaucaaaucaggcaaugacauugccaacuguuugcggaagaacgggaaaagggugauccagcugucccgcaagacuuucgacacagaguaucaaaagaccaaaaauaacgauugggacuacguugugacaacugauauaagugagaugggagcaaauuuccgugccgacagagucauugauccucggaggugccucaagcccgugauccugaaagacgguccagaacgcguaauccuugcuggcccgaugccugugacggcggccagcgcagcucagcgaagagggcggauuggaaggaaccagaauaaggagggcgaucaguacaucuauaugggucaaccccuaaacaaugacgaagaucacgcccauuggaccgaggcaaaaaugcuguuggacaacauuaauacaccagaggggauaauccccgccuuauuugaaccugagcgcgaaaagucggcugccauugauggcgaguacagacugaggggagaagcgcggaagacuuucguugagcucaugcgucgcggcgaccugccagucuggcuuucuuauaaaguggcauccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugccaggacauauucagacccucuggcucuacgggaguuuaaagaauucgccgcuggccgaagaaguguuucuggggaucugauccucgagauuggaaagcuuccgcagcaccugaccuuacgcgcacaaaaugccuuggacaaccuggugaugcuccacaauuccgaacagggcgguaaagcuuacaggcaugccauggaggaacugccagauacuauagagacgcuuaugcugcucgcauugaucgcgguacugaccgggggcgugacauuauuuuuccuaagcggaaagggccuggggaagacuucaauuggacuccuuugugucauggccaguagcgugcuguuguggauggcuuccguugagccccacuggaucgccgcaucuauuauccuggaauuuuuccucauggugcugcuuauaccugagcccgaccggcagcguaccccacaggauaaccaacucgcuuaugucguaaucggucuguuguuuaugauucugacaguggccgcaaacgaaaugggcuuacuagagaccacuaaaaaggaccuggggaucggacauguuguggccgagaaucaccaccaugcuacaaugcucgauauugaccuucacccugcgagcgccuggacgcuguacgcagucgcuaccacuaucauaacacccaugaugagacauaccauugaaaacaccacagccaauaucuccuugacugccauugcaaaccaggcugccauccugaugggccucgauaaagguuggccaauaucaaagauggacaucggggugccucugcuugcguuaggcugcuacucucaggucaauccgcugacgcucaccgcugccguguugaugcugguugcacacuaugccauuaucggacccggccuacaagcuaaagcaacaagggaggcccagaagcgcacugcggcugggauuaugaagaacccaaccguggauggaaucguagccauagaccuggacccuguggucuacgaugcaaaauucgaaaagcagcucggccagauuaugcuucugaucuuguguacaagucaaauccugcucaugcggaccacuugggcccugugcgagucgauuacguuagcuacagguccccuuaccacucugugggaagggagcccaggaaaauuuuggaauaccacaaucgccguuuccauggcaaacauauuccgaggcucuuaucucgcuggugccggccuagcguucucacugaugaagagcuuggggggaggcagaagggggacuggagcccagggcgagacccugggugagaaauggaagcgccagcucaaucagcuuuccaagagugaauuuaacacauacaaacggucugggauuauggagguggacagaagcgaagcaaaggagggacugaaacguggcgaaacgaccaagcaugcugucucaagggguacugccaaauugcggugguucguggagcgcaaucugguaaagccugagggcaaggugaucgaucucggguguggacgaggcgggugguccuauuacugcgcaggauuaaaaaagguuacagaagugaaaggcuauaccaagggugggcccggacacgaggaaccgauuccaauggcuacuuacggcuggaacaucgucaaacugcacaguggcagagacguguuuuucacaccucccgagaagugugauacccuucugugcgacauaggggaaagcucuccaaaucccacgaucgaggagggaaggacccuacggguccucaaaaugguggaaccuuggcugcgcgguaaccaauuuuguauuaagaucuugaauccguacaugcccuccguuguagagacacuggaacagaugcagagaaagcauggcgggaugcucgugaggaacccacuuucacgaaauagcacucacgagauguauugggucucgugcggaaccggcaacauugugucugccguuaacaugacaagucggaugcuguuaaaucguuucacuauggcccauagaaaaccuaccuacgagcgcgauguggaccugggugcggggacaaggcacgucgcuguggaacccgagaucgcaaacuuggauauuaucggacagcggauagaaaauauuaagaacgagcacaaauccaccuggcauuaugacgaagauaauccuuacaagacuugggccuaucacggcagcuacgagguaaaaccaucaggcuccgcuucuagcauggugaacgggguugucagacuccugacgaagcccugggacgugaucccuauggugacacaaaucgccaugaccgacacuaccccauuuggacagcagcgcgucuucaaggagaaaguugauacaaggacgccccgaccgaagcgggguaccgcacaaauuauggaagugacugccaaauggcuauggggcuuucuuaguagaaauaagaaaccuaggauauguacacgcgaggaauucacccguaagguacgguccaacgcugcgaucggggccguguuugucgacgagaaucaguggaacagcgcaaaggaagcuguggaggaugagagauucugggaccugguucauagggaacgcgagcuccacaaacagggaaagugcgccacuugcguguauaauaugaugggcaaacgagaaaagaaacugggugaguuugggaaggcaaagggaucucgggccauuugguacaugugguugggcgcuagauuccuggaauucgaggcccucggcuuuaugaacgaggaucauugguucucaagggaaaauagucuuuccggggucgagggagaaggucugcacaaauuaggcuacauccugcgcgacauuagcaagaucccagggggaaacauguaugcggaugacacagcaggcugggauaccagaauaacagaggacgauuugcagaaugaggccaaaaucacugacauuauggaacccgagcacgcucuccuggccaccucuaucuuuaagcuaacguaccaaaacaaagugguacggguucagaggccugcaaagucggguaccgugauggaugucauuucacgucgagaccagcgcgggagcggacaggugggcacauauggccuuaacacuuucaccaauauggaagugcaacugaucagacagauggaguccgaagggauauuuaguccaucugagcucgagaacagcaaucuggcugaacgggucuuggacugguuagagaaacauggaguugaaaggcugaagcgcauggccauuuccggugaugacugugugguaaagcccacagaugacagauucgcuacugcccucaccgcacuuaacgauaugggcaaagugcggaaggacaucccgcagugggagccuucaaaaggguggaaugauuggcagcaaguccccuuuugcagucaccauuuccaccagcugaucaugaaggacggaagggaaauugugguuccaugucgaaaccaggaugagcuagugggccgugcgagagucucucagggugccggguggagccugcgcgagacggcuugccucggaaaauccuacgcccaaauguggcaguugauguauuuucaccggagggaccugagacuugcagcuaaugccauauguucagcagugccuguaaacuggguucccacaagccgcaccacuuggucuauccaugcccaccaucaguggaugacaaccgaagauaugcuguccguguggaaucgggucuggauugaggaaaacccauggauggaggacaagacucacgugaguagcugggaagacguucccuaccucggcaagagggaggaucaauggugcggcucguuaaucgggcugaccgcgcgagcuacaugggccacgaauauucagguggcaaucaaccaggucagacgguugauaggaaaugagaacuaucuggacuacaugaccuccaugaaaagguucaagaaugaaucugauccugagggugcccucugguga

SEQ ID NO: 14192 - RNA, 9879 nt, Artificial Sequence
  derived and/or modified CDS sequence (opt3) from DENV-1__KM403603__SS-prME
agcgugacaaugcugcucaugcuucugcccacagcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagaacgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacuaagaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagcuccgccccagaugguuggaugcaaggaccuauucagacccucuggcccuacgggaguuuaaagaguucgcugccggccgaagaaguguuucuggggaucugauccucgagauuggaaaacuuccgcagcaccugacuuuacgcgcucaaaaugcauuggacaaccuggugaugcuccacaauuccgaacagggcgguaaagccuacaggcaugcuauggaggaacugccagauacgauagagacccuuaugcugcucgccuugaucgcaguacugacagggggcgugacuuuauuuuuccuaagcggaaagggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccggcagcguacaccacaggauaaccaacucgcauaugucguaaucggucuguuguuuaugauucugaccguggcugccaacgaaaugggcuuacuagagacuaccaaaaaggaccuggggaucggacauguuguggcagagaaucaccaccaugccacgaugcucgauauugaccuucacccugcuagcgcguggacccuguacgccgucgcaacuacaaucauaacccccaugaugagacauaccauugaaaacacaacugcuaauaucuccuugacggccauugccaaccaggcagcuauccugaugggccucgauaaagguuggccaauaucaaagauggacaucggggugccucugcuugccuuaggcugcuacucucaggucaauccgcugacccucacagcggcuguguugaugcugguugcccacuaugcaauuaucggacccggccuacaagccaaagcuacuagggaggcacagaagcgcaccgccgcggggauuaugaagaacccaacaguggauggaaucguagcuauagaccuggacccuguggucuacgaugccaaauucgaaaagcagcucggccagauuaugcuucugaucuuguguaccagucaaauccugcucaugcggacuacgugggcacugugcgagucgauuacauuagccaccgguccccuuacuacccugugggaagggagcccaggaaaauuuuggaauacaacuaucgcuguuuccauggccaacauauuccgaggcucuuaucucgccggugcuggccuagccuucucacugaugaagacccuagggggaggcagaagggggacaggagcgcagggcgagacgcugggugagaaauggaagcgccagcucaaucagcuuagcaaguccgaauuuaacaccuacaaacggagugggauuauggagguggacagaucugaagccaaggagggacugaaacguggcgaaacuacaaagcaugcagucagcagggguaccgcuaaauugcggugguucguggagcgcaaucugguaaagccugagggcaaggugaucgaucucggguguggacgaggcggguggucauauuacugcgccggacugaaaaagguuacugaagugaaaggcuauacaaagggugggcccggacacgaggaaccgauuccaauggcaaccuacggcuggaacaucgucaaacuacacuccggcagagacguguuuuucacgccucccgagaagugugauacccuucugugcgacauaggggaaaguagcccaaaucccacaaucgaggagggaaggacucuacggguccucaaaaugguggaaccuuggcugcgcgguaaccaauuuuguauuaagaucuugaauccguacaugcccucuguuguagagacccuggaacagaugcagagaaagcauggcgggaugcucgugaggaacccacuuucccgaaauucaacacacgagauguauugggucagcugcggaacuggcaacauugugucggcuguuaacaugaccucucggaugcuguuaaaucguuucacaauggcccauagaaaaccuaccuacgagcgcgauguggaccugggugccgggacuaggcacgucgcgguggaacccgagaucgcuaacuuggauauuaucggacagcggauagaaaauauuaagaacgagcacaaaaguacguggcauuaugacgaagauaauccuuacaagacaugggcauaucacggcuccuacgagguaaaaccaagcggcucagccuccucuauggugaacgggguugucagacuccugaccaagcccugggacgugaucccuauggugacucaaaucgcuaugaccgacacaacgccauuuggacagcagcgcgucuucaaggagaaaguugauaccaggacuccccgaccgaagcgggguacagcccaaauuauggaagugaccgcaaaauggcuauggggcuuucuuagcagaaauaagaaaccuaggauauguacucgcgaggaguucacacguaagguacggaguaacgccgcuaucggggcgguguuugucgacgagaaucaguggaacuccgccaaggaagcaguggaggaugagagauucugggaccugguucauagggaacgcgagcuccacaaacagggaaagugcgcuaccugcguguauaauaugaugggcaaacgagaaaagaaacugggugaguuugggaaggccaagggaagccgggcaauuugguacaugugguugggcgccagauuccuggaguucgaggcucucggcuuuaugaacgaggaucauugguucucuagggaaaauucacuuaguggggucgagggagaaggucugcacaaauuaggcuacauccugcgcgacauuuccaagaucccagggggaaacauguaugccgaugacacagcgggcugggauacuagaauaaccgaggacgauuugcagaaugaggcaaaaaucacggacauuauggaacccgagcacgcccuccuggcuaccagcaucuuuaagcuaacauaccaaaacaaagugguacggguucagaggccugccaagucugguacugugauggaugucauuucgcgucgagaccagcgcgggucaggacaggugggcaccuauggccuuaacacauucacuaauauggaagugcaacugaucagacagauggagagcgaagggauauuuuccccaagugagcucgagaacucuaaucuggcagaacgggucuuggacugguuagagaaacauggaguugaaaggcugaagcgcauggcuauuagcggugaugacugugugguaaagcccaccgaugacagauucgccacggcucucacagcccuuaacgauaugggcaaagugcggaaggacaucccgcagugggagccuuccaaaggguggaaugauuggcagcaaguccccuuuugcucacaccauuuccaccagcugaucaugaaggacggaagggaaauugugguuccaugucgaaaccaggaugagcuagugggccgugcaagagucagucagggugcgggguggucucugcgcgagaccgccugccucggaaaaagcuacgcucaaauguggcaguugauguauuuucaccggagggaccugagacuugccgcaaaugcuauauguuccgccgugccuguaaacuggguucccacuucacgcacaaccuggagcauccaugcacaccaucaguggaugacuaccgaagauaugcugucuguguggaaucgggucuggauugaggaaaacccauggauggaggacaagacacacguguccaguugggaagacguucccuaccucggcaagagggaggaucaauggugcggcagcuuaaucgggcugacggcccgagcgaccugggcuacuaauauucagguggccaucaaccaggucagacgguugauaggaaaugagaacuaucuggacuacaugacaucgaugaaaagguucaagaaugaauccgauccugagggugcacucugguga

SEQ ID NO: 14193 - RNA, 9879 nt, Artificial Sequence
  derived and/or modified CDS sequence (opt3) from DENV-1__KM403585__SS-prME
agcgugaccaugcugcucaugcuucugcccacugcauuggcuuuccacuuaacuacgagaggaggggaaccucauaugaucgucuccaagcaggaaaggggaaaaucucuguuguuuaagaccucagccgguguuaacaugugcacucucauugcaauggaccugggcgagcuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaggauagugcaguacgaaaaccucaaguauuccgucauugugacaguucacaccggagaucagcaucaaguggguaaugagacuacggaacacggcacaaucgccaccauuacuccccaggcgccuaccucagagguccagcuuacagacuacggggcccugaccuuggacuguaguccacggacuggacuagauuucaacgaaauggugcugcucacaaugaaagagaaaagcuggcugguacauaaacagugguuucuugaccugccguugcccuggacgucuggcgcauccaccucacaagaaacuuggaaucgucaggaucuccugguuacauucaagaccgcucacgccaaaaagcaggaaguggucguguuagguagccaagagggggcuaugcacacagcccugacuggcgcaaccgaaauccagacgaguggaaccacaacuaucuuugccggccaucuaaagugccgccucaaaauggacaagcugacccuuaaaggggucucuuaugugauguguacaggauccuucaaguuggagaaagaaguugcugagacucagcacgguaccgugcugguacaggucaaguacgagggcacggaugcgccuugcaagauuccaauaagcacacaagacgaaaaaggggugacccagaacggaagacucaucacugcaaaucccauuguuacagauaaggagaaaccugugaacaucgaaaccgagccacccuucggcgagucguauauagucauuggugccggggaaaaggcucugaaacuuucuugguuuaagaagggcuccucaaucggaaaaauguucgaggccacugcaaggggcgcccggcgaauggcuauccugggggacaccgccugggauuuuggaaguauugguggcguguucacaagcguagggaaguuggugcaucagguuuuuggaacggcauacggcguccucuucuccggugugucuuggaccaugaaaaucgggauuggcauacuguuaacuuggcugggacuaaauagccgcucaacaagucucuccaugaccuguaucgcggugggcauggucacacuguaccuugggguuauggugcaggcugacagcggaugcgugauuaacuggaagggcagagaauugaaaugugguucugggaucuuuguaacuaacgagguccacaccuggacggaacaauauaaguuccaggccgauucaccgaagaggcugagugcagccaucggaaaggcuugggaggagggcgugugcgguauucggagcgccacacgccucgaaaauauaauguggaagcagaucuccaacgagcugaaucauauuuuacuggaaaacgacaugaaauuuaccguuguggucggcgacgcauacgggauccuuacucagggaaagaaaaugauuagaccucaacccauggagcacaaguauucuuggaaaucguggggcaaggcuaagaucauaggggccgauacccagaauacaacuuucaucauugacggaccagauaccccugaaugucccgacgaucagagggcguggaacaucugggagguggaggacuacggcuuugguguuuucacaacgaauauuugguugaaacuccgugauagcuauacccagaugugcgaccaccggcugauguccgccgcuaucaaggauucaaaagcagugcaugccgacaugggguacuggauagaaagugagaagaacgaaacuuggaaacuagcucgagccucuuuuauugagguaaagacauguaucuggccaagaagccacacccugugguccaauggaguccucgaaucagagaugauuauccccaagauauauggcgguccuaucagccaacauaacuacaggccaggcuacuucacucagacagcagggccguggcaccugggaaaacuugaguuggauuucaaucugugcgaaggcaccacggugguggucgacgagcacugcgggaaccgcggacccucuuuacggacuaccacaguuaccggcaagauuauccaugaaugguguugcagauccuguacucucccuccacugagguuucgcggugaggaugggugcugguauggaauggagauucgacccgugaaagaaaaggaggaaaaucuuguacggaguauggugagcgcgggcucuggugaggucgacuccuucucacugggcuugcucugugugaguaucaugauagaagagguuaugcguagcagauggucgaggaaaaugcugaugacagggacccuagccguguuuuuccugcucauuaugggacagcugacauggaacgaccuuauccgcuugugcaucauggucggcgcuaauguguccgaucggauggggaugggaacuaccuaccuggccuuaauggcaacguuuaagaugagaccuauguucgcuguuggccuccuguuuaggcgacuuacaucucgcgaggugcugcuacucaccauuggucugagcuuggucgccucaguagaacugccaaacaguuuagaggaacucggggacggacuggcaaugggcaucaugaugcuuaagcuguugacugauuuccaaucccaccagcucuggaccacacugcuaucucugacuuuuauuaaaaccacgcuuagccucgacuaugccuggaagacaauggcuauggugcuguccauaguuucauuguucccccuguguuuaagcaccacaagucagaaaacaaccuggcucccggugcugcuuggcucuuuugggugcaagccucugacuauguucuugaucacagagaacaaaauuuggggacggaaguccuggccacucaaugaagguaucauggcggucggcauugugagcauccugcuaucgucacugcuuaagaacgauguaccccucgccgggccucugauagcaggaggcauguugaucgcuuguuacgugauuucugguaguuccgccgacuuaagccuggagagagccgcugaggucucuugggaagaggaagcagagcauagcggggccucccacaauauccucguugaagugcaggaugacggaaccaugaaaauuaaggaugaggagagggacgauacgcugacuauccuucugaaagcgaccuugcuagcugugucaggcgucuaucccaugaguauaccagccacacuguuugugugguacuucuggcaaaagaaaaagcagcguagcggcguucucugggacaccccuucucccccagaaguagagcgcgcagugcuggaugacgggauuuaucggauccuucagagaggauuacuggguaggucccaggucggcguggggguuuuccaagacggaguguuucauacaauguggcacgucacucgaggcgccgugcucauguaccaggguaaacgguuggaaccgucaugggcuaguguaaagaaggaucugaucagcuacgggggaggcuggcgcuuccagggcuccuggaacaccggggaggagguccaggugauugcaguugaaccuggcaagaaucccaagaacgugcaaacgacaccagguacuuuuaaaacccccgagggcgaagucggggccauagcgcucgacuucaagccuggaacaucuggcucgccaaucgugaauagagaggguaaaauuguugggcuguauggaaacggcguggucaccacuagcggcaccuacgugucagcuaucgcccaggcaaaggccucccaggaagggccccuuccugagauugaggaugaaguauuuaagaaaaggaaucugacaaucauggacuugcacccgggaagugguaagacgcggcgauaucuaccagcuauagugagagaggccaucaaacgcaagcugaggacucucauuuuagcacccacccguguugucgcuucugaaauggccgaggcgcugaaaggcaugccuauccgguaccaaacaaccgccguaaagagcgaacauacugggaaggagauuguggaucuuaugugccacgcaacauucaccaugagacugcucuccccagucaggguacccaacuauaauaugaucauaauggacgaggcucauuuuacggauccugccucaauugcugcacgcggauacaucucuacucgagugggcaugggugaagccgccgcuaucuucaugacagcgaccccgcccgggagcguugaggcauuuccacagaguaacgccgugauucaggacgaagagagagauaucccugaacgguccuggaauagcggauaugacuggauaaccgauuuccccggcaaaacugucugguuugugccaucuauuaagucaggcaacgacaucgcuaauuguuugaggaaaaacgggaagcgcguuauucagcugucccguaaaacauucgacaccgaguaccaaaagacaaagaacaaugauugggacuacguggucacuacggauaucagugagaugggagccaacuucagagcagaccgggugauagauccuaggcgcugccucaaacccguaauucugaaggacgguccagaacgagugauccuugccggcccgaugccuguuaccgcugcgagcgccgcacagagacgggggaggaucggacgcaaucagaacaaagagggcgaucaguauauuuacaugggucaaccccuaaauaacgacgaagaucacgcucauuggacagaggccaagaugcuguuggacaauaucaacacuccagaggggauuauacccgcauuauuugaaccugagagagaaaaaucggccgcuaucgauggcgaguauaggcugcggggagaagcccguaagaccuucgucgagcucaugcgccgaggcgaccugccaguguggcuuucuuacaagguggcguccgagggguuucaguauagcgauagaagguggugcuucgacggagaacggaauaaccagguccuggaggaaaauauggacguugagauuuggacaaaagaaggugagcgcaagaaacucagacccaggugguuggaugcacggaccuacucagacccucuggcccuacgagaguuuaaggaguucgcugccggcagacgcagugugucuggggaucugauccucgagaucggaaaacuuccgcagcaccugacuuuaagggcucaaaacgcauuggacaaucugguaaugcuccacaacuccgaacagggcgguaaggccuaucggcaugcuauggaggaacugccagauacgauugagacccuuaugcugcucgccuugauagcagugcugacagggggcgucacuuuauuuuuccuaagcggaaaaggccuggggaagaccucaaucggacuccuuugugugauggcgaguagcguucuguuguggauggccuccguggagccccacuggauugcugccucuaucauucuggaauuuuuccucaugguccugcuuaucccugagcccgaccgucagagaacaccacaggauaaucaacucgcauacguagugauaggucuguuguuuaugauccugaccguugcugccaacgaaaugggcuuacuagagacuacaaagaaagaccuggggauuggacauguggucgcagagaaccaccaccaugccacgaugcucgauaucgaccuucacccugcuagcgcguggacccuguacgccguggcaacuacaauuaucacccccaugaugaggcauaccauagaaaauacaacugcuaacauuuccuugacggccaucgccaaucaggcagcuauucugaugggccucgauaaggguuggccaaucucaaaaauggacauaggggucccucugcuugccuuaggcugcuauucucaggugaacccgcugacccucacagcggcuguuuugaugcugguggcccacuacgcaaucauuggacccggccuacaagccaaggcuacucgcgaggcacagaaacggaccgccgcggggaucaugaagaauccaacaguagauggaauuguggcuaucgaccuggacccugucguuuaugaugccaaguucgaaaaacagcucggccagauaaugcuucugauuuuguguaccagucaaauccugcucaugcgaacuacgugggcacugugcgagucgaucacauuagccaccgguccccuuacuacccugugggaagggagcccaggaagauuuuggaacacaacuauugcuguguccauggccaauaucuucaggggcucuuaccucgccggugcuggccuagccuucucacugaugaaaagccuagggggaggccgccgggggaccggagcgcagggcgagacacugggugagaaauggaagagacagcucaaccagcuuuccaaaagugaauuuaauacguauaagcguucugggauagucgagguggacaggagcgaagccaaggagggaaugaaacggggcgaaaccacuaagcaugcaguaucacgcgguacagcuaaacugcgaugguucguggagagaaacuugguuaagccugagggcaaagugauugaucugggguguggaaggggcgggugguccuacuauugcgccggacucaagaaggucaccgaagugaaaggcuacacuaagggugggcccggacacgaggaaccgaucccaauggcaacauacggcuggaauauugucaaauuacacaguggccgggacguguuuuucaccccucccgagaagugugauacgcugcuuugcgacaucggggaaagcucuccaaaccccaccauagaggagggacgcacacugagaguucuaaaaaugguagaaccuuggcucagggguaaucaauuuuguaucaagauucugaacccguauaugcccuccguggucgagacuuuggaacagaugcagcgaaaacauggcgggaugcuggugcggaauccacucucacguaacagcacccacgagauguacuggguuucgugcggaacaggcaauaucgugucugcugucaacaugacaaguagaaugcuucugaaccgcuucaccauggcccauaggaagccuacauaugagcgggauguggacuuaggugccgggaccagacacguagcgguggaacccgagauugcuaaucuggauaucauuggacagcgcaucgaaaacauaaagaaugagcacaaauccacuuggcauuacgacgaagauaacccuuauaagacgugggcauaccacggcagcuaugagguuaaaccaucaggcuccgccucuagcauggucaaugggguggugagguugcucacaaagcccugggacgucauuccuaugguuacccaaaucgcuaugacugacaccacaccauuuggacagcagcgaguguucaaagagaagguagauacgcggacccccagaccgaagagggguacugcccaaaucauggaagugacagcaaaauggcuguggggcuuucuaagucgcaacaagaaaccucguauuuguacccgggaggaguucacuagaaaggucagguccaaugccgcuauaggggcgguguuuguugacgagaaccaguggaauagcgccaaagaagcaguggaggaugagcgcuucugggaccuuguccaucgagaacgggagcugcacaagcagggaaagugcgcuacaugcguguacaacaugaugggcaaaagagaaaagaaacucggugaguuugggaaggccaaaggaucuagggcaaucugguacauguggcugggcgcccgcuucuuggaguucgaggcucugggcuuuaugaaugaggaucauugguucucaagagaaaacagucucuccgggguagagggagaaggucuucacaagcugggcuauauuuuacgggacaucagcaagauuccagggggaaauauguacgccgaugacaccgcgggcugggauacaaggaucacugaggacgaucugcagaacgaggcaaaaauaaccgacaucauggaacccgagcacgccuugcucgcuacgucuauuuuuaagcugaccuaucaaaauaaaguugugcguguccagcgaccugccaagucggguacagugauggaugugaucucacgcagagaccagcgggggagcggacaggucggcacuuacggccuaaacaccuucacaaacauggaaguucaacuuauuaggcagauggaguccgaagggaucuuuaguccaucugagcuggagaauagcaaccucgcagaacgcgugcuggacugguuggagaaacauggaguagaaagauuaaagcggauggcuauauccggugaugacuguguggucaaacccacugaugacagguucgccaccgcucugacggcccucaaugauaugggcaaggugcgaaaggacauuccgcagugggagccuucaaaaggguggaacgauuggcagcaaguucccuuuugcagucaccauuuccaccagcuuaucaugaaggacggacgugaaaucguggucccauguagaaaucaggaugagcuggugggccgcgcacggguaucucagggugcgggguggagccuaagggagacagccugccugggaaaauccuaugcucaaauguggcagcucauguacuuucacagacgcgacuugcggcuggccgcaaacgcuauuuguucagccguuccugugaauuggguccccaccagcaggacuacauggucuauacaugcacaccaucaguggaugaccacugaagauaugcuuuccguguggaaccgaguuuggaucgaggaaaauccauggauggaggacaagacccacgugaguagcugggaagacguccccuaucugggcaaaagagaggaucaauggugcggcucgcucauuggguuaacagcccgggcgacgugggcuaccaacauccagguggccauuaaucagguaaggcgccugaucggaaacgagaauuacuuggacuacaugacuuccaugaagcguuucaagaacgaaucugauccugagggugcacugugguga

SEQ ID NO: 14194 - RNA, 9879 nt, Artificial Sequence
  derived and/or modified CDS sequence (opt3) from DENV-1__KM403595__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagaccguagaagcguggcccuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauauucaucuuacugaugcuugugacgccaucaauggccaugaggugcgucgggauuggaaaccgggauuuuguggaggguuugagcggcgcgacuuggguagacguugugcuggagcacgggaguugugucacaaccauggcaaaaaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagagcaggaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacguacuggacuagauuucaacgaaaugguccugcucacaaugaaggagaaaagcuggcuggugcauaagcagugguuucuugaccugccguugcccuggacgucuggcgcauccaccucacaagagacuuggaaucgccaggaucuccugguaacauucaaaaccgcucacgccaagaaacaggaaguuguggucuuagguagccaagagggggcuaugcacacagcccugacuggcgcaaccgaaauccagacgaguggaaccacaacuauuuuugccggccaucuaaagugcagacucaagauggacaaacugacccuuaagggggugucuuaugucauguguacaggauccuucaaauuggagaaggaaguggcugagacucagcacgguaccguucuggugcagguaaaauacgagggcacggaugcgccuugcaagauaccaaucagcacacaagacgaaaagggggucacccagaacggaaggcucauuacugcaaaucccaucgugacagauaaagagaagccuguuaacauagaaauugagccacccuucggcgagucguauaucgugaucggugccggggaaaaagcucugaagcuuucuugguuuaaaaagggcuccucaauuggaaagauguucgaggccaccgcacggggcgcccgacgcauggcuauccugggggacacugccugggauuuuggaaguauugguggcgucuucaccagcguggggaaauugguacaucagguguuuggaacagcauacggcguucucuucuccggugucucuuggacgaugaagauagggaucggcauucuguuaaccuggcugggacuaaauagcagaucaacuagucucuccaugacauguaucgcggugggcauggugacccuguaccuuggggucaugguucaggcugacagcggaugcgugaucaacuggaaaggcagggaauugaagugugguucugggauuuuugugacaaacgagguacacacuuggaccgaacaauauaaauuccaggccgauucaccgaagcggcugagugcagccauaggaaaggcuugggaggagggcgucugcgguauccgcagcgccacgagacucgaaaauauuauguggaaacagaucuccaacgagcugaaucauauuuuacuggaaaacgacaugaaguuuacagugguugugggcgacgcaaaugggauccuuacccagggaaaaaagaugauaaggccucaacccauggagcacaaauacucuuggaagucguggggcaaagcuaagaucauuggggccgauacucagaacaccacauucaucauugacggaccagauacuccugaaugucccgacgaucagcgugcguggaauaucugggaggucgaggacuauggcuuugguguguucaccacaaacauaugguugaagcuccgggauagcuacacgcagaugugcgaccaccgacugauguccgccgcuauuaaagauucaaaggcaguucaugccgacaugggguauuggaucgaaagugagaaaaaugaaaccuggaagcuagcuagagccucuuuuauugaggugaaaacuuguaucuggccaaggagccacacacugugguccaacggaguacucgaaucagagaugauaauccccaagauuuacggcgguccuaucagccaacauaauuaucgcccaggcuacuucacccagacugcagggccguggcaccugggaaagcuugaguuggauuucaaccugugcgaaggcacaaccgucgugguggacgagcacugcgggaaucggggacccucuuuaagaacgacuaccgucacaggcaaaauuauccaugaaugguguugcagguccuguacccucccuccacugcgcuuucgaggugaggaugggugcugguacggaauggagauacggcccguuaaggaaaaagaggaaaaccuugugcguaguaugguaagcgcgggcucuggugagguggacuccuucucacugggcuugcucugugucaguauuaugaucgaagaggugaugagaagcagguggucgcgcaagaugcugaugacugggacacuagccaucuuuuuccugcucauuaugggacagcugaccuggaaugaccuuauccgguugugcauuaugguuggcgcuaacguguccgauagaauggggaugggaacaacuuaucuggccuuaauggcaaccuuuaaaaugaggccuauguucgcugucggccuccuguuucgacgccuuacgucucgggaggugcugcuacucacaauaggucugagcuugguugccucaguggaacugccaaacaguuuagaggaacucggggacggacuggcaaugggcaucaugaugcuuaagcuguugaccgauuuccaaucccaccagcucuggacuacccugcuaucucugacauuuauuaagacuacccuuagccucgacuacgccuggaaaacgauggcuaugguccuguccaucguaucauuguucccccuguguuuaagcacaaccagucagaagacuacauggcucccggugcugcuuggcucuuuugggugcaaaccucugaccauguucuugauuacugagaauaagaucuggggaagaaaauccuggccacucaacgaagguauaauggcgguuggcaucgugagcauucugcuaucgucacugcuuaagaaugaugucccccucgccgggccucugaucgcaggaggcauguugauugcuuguuaugugaucucugguaguuccgccgacuuaagccuggagagggccgcugagguaucuugggaagaggaagcagagcauagcggggccucccacaacauacucguggaaguccaggaugacggaacaaugaagauuaaagaugaggagcgugacgauacccugacgauccuucugaaggcgacuuugcuagcuguuucaggcguguaccccaugaguaucccagccacccuguuugugugguauuucuggcaaaaaaagaaacagcgcagcggcguccucugggacacaccuucucccccagaaguggagcgggcaguucuggaugacgggauuuacagaauacuucagaggggauuacugggucgaucccagguaggcgugggggucuuccaagacggaguguuucauaccauguggcacguuacacggggcgccgugcucauguaucaggguaagcgcuuggaaccgucaugggcuagugucaaaaaggaucugaucagcuacgggggaggcuggagauuccagggcuccuggaauacuggggaggaggugcagguaauugcagucgaaccuggaaagaaccccaaaaaugugcaaaccacgccagguacauuuaagacucccgagggcgaaguuggggccaucgcgcucgacuucaaaccuggaaccucuggcucgccaauugugaacagggaggguaagaucgucgggcuguacggaaauggcgugguuacaaccagcggcacuuaugugucagcuauagcccaggcaaaagccucccaggaagggccccuuccugagaucgaggaugaagucuuuaagaagcggaaccugaccauuauggacuugcacccgggaagugguaaaacacgaagauaccuaccagcuaucgugcgcgaggccauuaagaggaaacugcguacgcucaucuuagcacccacucggguaguggcuucugaaauggccgaggcgcugaagggcaugccuauaagauaucaaaccacagccguuaaaagcgaacauaccgggaaggagauugucgaucuuaugugccacgcaacuuucacaaugaggcugcucuccccagugcgcgugcccaauuacaacaugaucaucauggacgaggcucauuuuaccgauccugccucaauugcugcacgaggauauaucucuacgagagucggcaugggugaagccgccgcuauauucaugacugcgacaccgcccgggagcguagaggcauuuccacagaguaaugccgugauucaggacgaagagcgggauaucccugaaagguccuggaacagcggauacgacuggauuaccgauuuccccggcaagaccguuugguuugugccaucuaucaaaucaggcaaugacauagcuaacuguuugcgcaagaacgggaaacgugucauucagcuguccagaaagacuuucgacacagaguaucaaaaaaccaagaauaacgauugggacuacgugguuacaacugauaucagugagaugggagccaauuuccgggcagacagggugaucgauccucgccgaugccucaagcccgucauucugaaagacgguccagaaagagugauccuugccggcccgaugccuguaacggcugcgagcgccgcacagcggagggggcgcauuggaagaaaccagaauaaggagggcgaucaguacauauauaugggucaaccccuaaacaaugacgaagaucacgcucauuggaccgaggccaaaaugcuguuggacaacaucaauacaccagaggggauuauccccgcauuauuugaaccugagagggaaaagucggccgcuaucgauggcgaguaccggcugcguggagaagcccgcaaaacuuucguggagcucaugcgaagaggcgaccugccaguuuggcuuucuuauaaggucgcguccgagggguuucaguacagcgauaggcgguggugcuucgacggagaacgcaacaaucaggugcuggaggaaaacauggacguggagauuuggaccaaggaaggugagagaaaaaagcucaggccccggugguuggaugcacgaacauauucagacccucuggcccuaagagaguuuaaagaauucgcugccggccgcaggagugucucuggggaucugauacucgagaucggaaagcuuccgcagcaccugaccuuacgggcucaaaaugcauuggacaaccugguuaugcuccacaauuccgaacagggcgguaaagccuaccgucaugcuauggaggaacugccagauacuauugagacgcuuaugcugcucgccuugaucgcagugcugaccgggggcguaacauuauuuuuccuaagcggaaagggccuggggaaaacuucaauuggacuccuuugugugauggcgaguagcguccuguuguggauggccuccguggagccccacuggaucgcugccucuauaauccuggaauuuuuccucaugguucugcuuauuccugagcccgacagacagaggaccccacaggauaaccaacucgcauauguggucaucggucuguuguuuaugauucugacaguagcugccaacgaaaugggcuuacuagagaccacuaagaaggaccuggggaucggacaugugguugcagagaaucaccaccaugccacaaugcucgauauagaccuucacccugcuagcgcguggacgcuguacgccguggcaaccacuauuaucacacccaugaugcgccauaccauugaaaacaccacagcuaauaucuccuugacugccauagccaaccaggcagcuauccugaugggccucgauaaagguuggccaauuucaaagauggacaucggggucccucugcuugccuuaggcugcuacucucaggugaauccgcugacgcucaccgcggcugucuugaugcugguggcccacuaugcaauuaucggacccggccuacaagccaaagcuacacgggaggcacagaagcgaacugccgcggggauaaugaaaaacccaaccguugauggaauuguggcuaucgaccuggacccuguaguguacgaugccaaguucgaaaagcagcucggccagaucaugcuucugauuuuguguacaagucaaauccugcucaugagaaccacuugggcacugugcgagucgauaacguuagccacagguccccuuaccacucugugggaagggagcccaggaaaauuuuggaauaccacaauugcugucuccauggccaacaucuucaggggcucuuaucucgcaggugcuggccuagccuucucacugaugaagagcuuggggggaggccgccgggggacuggagcgcagggcgagacccugggugagaaauggaagagacagcucaaucagcuuuccaaaagugaauuuaacacauacaagcguucugggauuauggagguugacaggagcgaagccaaggagggacugaaacggggcgaaacgaccaagcaugcagugucacgcgguacugcuaaauugcgaugguucgucgagagaaaucuggugaagccugagggcaaaguaaucgaucucggguguggaaggggcgggugguccuauuacugcgccggauuaaagaaggugacagaaguuaaaggcuauaccaagggugggcccggacacgaggaaccgauaccaauggcaacuuacggcuggaacaucgugaaacugcacaguggccgggacgucuuuuucacaccucccgagaagugugauacccuucugugcgacauuggggaaagcucuccaaaucccacgaucgaggagggacgcacccuaagagugcucaaaauggucgaaccuuggcugagggguaaccaauuuuguauuaagaucuugaauccguacaugcccuccgugguugagacacuggaacagaugcagcgaaaacauggcgggaugcucguacggaacccacuuucacguaauagcacucacgagauguauugggugucgugcggaaccggcaacauugucucugcugugaacaugacaaguagaaugcuguuaaaucgcuucacuauggcccauaggaagccuaccuacgagcgggauguugaccugggugccgggacaagacacguggcggucgaacccgagaccgcuaacuuggauaucauaggacagcgcauugaaaauaucaagaacgagcacaaauccacuuggcauuaugacgaagauaauccuuacaagacgugggcauaucacggcagcuacgaggugaaaccaucaggcuccgccucuagcaugguaaacggggugguuaggcuccugacaaagcccugggacgucaucccuauggugacccaaauugcuaugacugacaccacaccauuuggacagcagcgaguguucaaagagaaggucgauacgcggacccccagaccgaagagggguacugcccaaauaauggaaguuacagcaaaauggcuauggggcuuucuuagucgcaauaagaaaccucguaucuguacccgggaggaauucacuagaaaggugagguccaacgccgcuauuggggcgguauuuguggacgagaaucaguggaacagcgccaaagaagcagucgaggaugagcgcuucugggaccuggugcaucgagaacgggagcuccacaagcagggaaagugcgcuacaugcguuuauaauaugaugggcaaaagagaaaagaaacugggugaguuugggaaggccaaaggaucuagggcaaucugguacaugugguugggcgcccgcuuccuggaauucgaggcucucggcuuuaugaacgaggaucauugguucucaagagaaaauagucuuuccgggguggagggagaaggucugcacaaguuaggcuacauucugcgggacaucagcaagauaccagggggaaacauguaugccgaugacaccgcgggcugggauacaaggaucacugaggacgauuugcagaaugaggcaaaaauuaccgacaucauggaacccgagcacgcccuccuggcuacgucuauuuuuaagcuaaccuaccaaaacaaagucgugcguguacagcgaccugccaagucggguacaguuauggaugugaucucacgcagagaccagcgggggagcggacaggucggcacuuauggccuuaacaccuucacaaauauggaagugcaacugauaaggcagauggaguccgaagggauuuuuaguccaucugagcucgagaacagcaaucuggcagaacgcguguuggacugguuagagaaacauggagucgaaagacugaagcggauggcuaucuccggugaugacuguguugugaaacccacugaugacagguucgccaccgcucucacggcccuuaacgauaugggcaagguacgaaaggacaucccgcagugggagccuucaaaaggguggaaugauuggcagcaagugcccuuuugcagucaccauuuccaccagcugauuaugaaggacggacgugaaauagucgugccauguagaaaccaggaugagcuaguuggccgcgcacgggugucucagggugcgggguggagccugagggagacagccugccucggaaaauccuacgcucaaauguggcaguugauguauuuucacagacgcgaccugcggcuugccgcaaaugcuaucuguucagccgucccugugaacuggguacccaccagcaggacuacauggucuauucaugcacaccaucaguggaugaccacugaagauaugcuguccguuuggaaucgaguguggaucgaggaaaacccauggauggaggacaagacccacgucaguagcugggaagacgugcccuaccucggcaaaagagaggaucaauggugcggcucguuaauugggcugacagcccgggcgacgugggcuaccaauauccagguugccauaaaccaggugaggcgcuugaucggaaaugagaacuaucuggacuacaugacuuccaugaagcguuucaagaaugaaucugauccugagggugcacucugguga

SEQ ID NO: 14195 - RNA, 9879 nt, Artificial Sequence
  derived and/or modified CDS sequence (opt3) from DENV-1__KM403604__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacagggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcacaagcaaugguuucuugaccugccguugcccuggacgucuggcgcauccaccucacaggagacuuggaaucggcaggaucuccugguaacauucaaaaccgcucaugccaagaagcaagaaguuguggucuuagguagccaggagggggcuaugcacacagcccugacuggcgcaaccgaaauccagacgaguggaaccacaacuauuuuugccggccaccuaaaaugccgucucaagauggacaaacugacccuuaagggggugucuuaugucauguguacaggauccuucaaauuggagaaggaaguggcugagacucagcaugguaccguucuggugcaaguaaaguacgagggcacggaugcgccuugcaaaauaccaaucagcacacaggacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaccagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaagcugacagcggaugcgugaucaacuggaaaggccgcgaauugaagugugguucugggaucuuugugacuaacgagguacauaccuggacggaacaguauaaguuccaggccgauucaccgaaaagacugagugcagccauuggaaaggcuugggaggagggcgucugcgguauaaggagcgccacacggcucgaaaauaucauguggaaacagauuuccaacgagcugaaucacaucuuacuggaaaacgacaugaaguuuaccgugguugugggcgacgcaaaugggauucuuacucaaggaaaaaagaugauccgcccucagcccauggagcauaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccaaaugugcgaccaccgucugauguccgccgcuauaaaagauucaaaggcaguucacgccgacaugggguauuggauugaaagugagaaaaaugaaacuuggaagcuagcucgggccucuuuuaucgaggugaagacauguauuuggccacgaagccauacccugugguccaacggaguacucgaaucagagaugaucauacccaaaaucuacggcgguccuauuagccagcacaauuauagaccaggcuacuucacucagacagcagggccguggcaucugggaaagcuugaguuggauuucaaccugugcgaaggcaccacggucgugguggacgagcacugcgggaauaggggacccucuuuacgcacuaccacagucaccggcaaaaucauucacgaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguuuuuuuccugcucaucaugggacaacugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccagucccaucagcucuggaccacacugcuaucucugacuuuuauaaagaccacgcuuagccucgacuacgccuggaaaacaauggcuaugguacuguccaucgugucauuguucccccuguguuuaagcaccacuagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcacagcggggccucccauaacauucucgucgaaguucaagaugacggaaccaugaagaucaaagaugaggagagagacgauacgcugacuauacuucugaaggcgaccuugcuagcugugucaggcguguaccccaugaguauuccagccacacuguuugucugguauuucuggcagaaaaagaaacagaggagcggcgugcucugggacaccccuucucccccagaaguugagcgugcaguacuggaugacgggaucuaccgcauccuucagcggggauuacuggguagaucccaagugggcgucgggguguuccaggacggaguuuuucacacaauguggcaugugacuaggggcgccguccucauguaucaggguaagcgauuggaaccgucaugggcuagugugaagaaagaucugauuagcuacgggggaggcuggcgguuccagggcuccuggaauaccggggaggagguacaagucauagcaguggaaccuggaaagaaccccaaaaauguucagacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaagaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucagacaaccgccgucaagagcgaacacacugggaaagagaucguggaucuuaugugccaugcaacauucaccaugcggcugcucuccccagugagaguccccaauuacaacaugauaauuauggacgaggcucacuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagagcgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccaacugucccgcaagacauucgacaccgaguaucagaagacaaaaaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaauacaucuauaugggucagccccuaaacaaugacgaagaucaugcucacuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagcuccgccccagaugguuggaugcaaggaccuauucagacccucuggcccuacgggaguuuaaagaauucgcugccggccgaagaaguguuucuggggaucugauccucgagauuggaaagcuuccgcaacaucugacuuuacgcgcucagaaugcauuggacaaccuggugaugcuccacaauuccgaacagggcgguaaagccuacaggcacgcuauggaggaacugccagauacgauagagacccuuaugcugcucgccuugaucgcaguacugacagggggcgugacuuuauuuuuccuaagcggaaagggccuggggaagaccucaauuggacuccuuugugucauggcgaguagcgugcuguuguggauggccuccguugagccccauuggaucgcugccucuauuauccuggaauuuuuccucauggugcugcuuauaccugagcccgaccggcagcguacaccacaagauaaccagcucgcauaugucguaaucggucuguuguuuaugauucugaccguggcugccaacgaaaugggcuuacuagagacuacaaaaaaggaccuggggaucggacacguuguggcagagaaucaucaccacgccacgaugcucgauauugaccuucauccugcuagcgcguggacccuguacgccgucgcaacuacaaucauaacccccaugaugagacacaccauugaaaacacaacugcuaauaucuccuugacggccauugccaaccaggcagcuauccugaugggccucgauaaagguuggccaauaucaaagauggacaucggggugccucugcuugccuuaggcugcuacucucaagucaauccgcugacccucacagcggcuguguugaugcugguugcccauuaugcaauuaucggacccggccuacaggccaaagcuacuagggaggcacagaagcgcaccgccgcggggauuaugaagaacccaacaguggauggaaucguagcuauagaccuggacccuguggucuacgaugccaaauucgaaaagcagcucggccaaauuaugcuucugaucuuguguaccagucagauccugcucaugcggacuacgugggcacugugcgagucgauuacauuagccaccgguccccuuacuacccugugggaagggagcccaggaaaauuuuggaauacaacuaucgcuguuuccauggccaacauauuccgaggcucuuaucucgcaggugcuggccuagccuucucacugaugaagagcuuggggggaggcagaagggggaccggagcgcagggcgagacacugggugagaaauggaagcgccagcucaaucaacuuuccaagagugaauuuaacacguacaaacggucugggauuauggagguggacagaagcgaagccaaggagggacugaaacguggcgaaaccacuaagcacgcagucucaagggguacagcuaaauugcggugguucguggagcgcaaucugguaaagccugagggcaaggugaucgaucucggguguggacgaggcgggugguccuauuacugcgccggauuaaaaaagguuaccgaagugaaaggcuauacuaagggugggcccggacaugaggaaccgauuccaauggcaacauacggcuggaacaucgucaaacugcacaguggcagagacguguuuuucaccccucccgagaagugugauacgcuucugugcgacauaggggaaagcucuccaaaucccaccaucgaggagggaaggacacuacggguccucaaaaugguggaaccuuggcugcgcgguaaccaguuuuguauuaagaucuugaauccguacaugcccuccguuguagagacucuggaacagaugcagagaaagcacggcgggaugcucgugaggaacccacuuucacgaaauagcacccaugagauguauugggucucgugcggaacaggcaacauugugucugcuguuaacaugacuagucggaugcuguuaaaucguuucaccauggcccacagaaaaccuacauacgagcgcgauguggaccugggugccgggaccaggcaugucgcgguggaacccgagaucgcuaacuuggauauuaucggacaacggauagaaaauauuaagaacgagcacaaauccacuuggcacuaugacgaagauaauccuuacaagacgugggcauaucauggcagcuacgagguaaaaccaucaggcuccgccucuagcauggugaacgggguugucagacuccugacaaagcccugggacgugaucccuauggugacccagaucgcuaugacugacaccacaccauuuggacagcaacgcgucuucaaggagaaaguugauacgaggaccccccgaccgaagcgggguacugcccagauuauggaagugacagcaaaauggcuauggggcuuucuuaguagaaauaagaaaccuaggauauguacccgcgaggaauucacucguaagguacgguccaacgccgcuaucggggcgguguuugucgacgagaaucaguggaacagcgccaaggaagcaguggaggaugagagauucugggaccugguucacagggaacgcgagcuccauaaacagggaaagugcgcuacaugcguguauaauaugaugggcaaacgagaaaagaaacugggugaguuugggaaggccaagggaucucgggcaauuugguacaugugguugggcgccagauuccuggaauucgaggcucucggcuuuaugaacgaggaucacugguucucaagggaaaauagucuuuccggggucgagggagaaggucugcauaaauuaggcuacauccugcgcgacauuagcaagaucccagggggaaacauguaugccgaugacaccgcgggcugggauacaagaauaacugaggacgauuugcaaaaugaggcaaaaaucaccgacauuauggaacccgagcacgcccuccuggcuacgucuaucuuuaagcuaaccuaccagaacaaagugguacggguucagaggccugccaagucggguacagugauggaugucauuucacgucgagaccagcgcgggagcggacaagugggcacuuauggccuuaacaccuucacaaauauggaagugcagcugaucagacagauggaguccgaagggauauuuaguccaucugagcucgagaacagcaaucuggcagaacgggucuuggacugguuagagaaacacggaguugaaaggcugaagcgcauggcuauuuccggugaugacugugugguaaagcccacugaugacagauucgccaccgcucucaucgcccuuaacgauaugggcaaagugcggaaggacaucccgcagugggagccuucaaaaggguggaaugauuggcaacagguccccuuuugcagucaucacuuccaucagcugauuaugaaggacggaagggaaauagugguuccaugucgaaaccaggaugagcuagugggccgugcaagagucucucaaggugcgggguggagccugcgcgagacggccugccucggaaaauccuacgcucagauguggcaguugauguauuuucaccggagggaccugagacuugccgcaaaugcuaucuguucagccgugccuguaaacuggguucccacaagccgcaccacuuggucuauucacgcacaucaccaauggaugacaaccgaagauaugcuguccguguggaaucgggucuggaucgaggaaaacccauggauggaggacaagacucaugugaguagcugggaagacguucccuaccucggcaagagggaggaucaguggugcggcucguuaauugggcugaccgcccgagcgacaugggcuacgaauauccagguggccauaaaccaggucagacgguugaucggaaaugagaacuaucuggacuacaugaccuccaugaaaagguucaagaaugaaucugauccugagggugcacucugguga

SEQ ID NO: 14196 - RNA, 9879 nt, Artificial Sequence
  derived and/or modified CDS sequence (opt3) from DENV-1__KM403588__SS-prME
agcgugaccaugcugcucaugcuucugcccacugccuuggcuuuccacuuaacuacgagaggaggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggggaaacugacccuuaagggagugucuuaugucauguguacagguuccuucaaauuggagaaggaaguggcugagacucagcacggcaccguucuggugcagguaaaguacgaggggacggacgcgccuugcaaaauaccaaucagcacacaagaugaaaagggagucacccagaacggccgccucauuacugcaaaucccaucgugacagacaaagagaagccuguuaacauagaaaccgagccacccuucggugagucguauauugugaucggggccggcgaaaaagcucugaaacuuucuugguuuaagaaaggauccucaaucggcaagauguucgaggccacugcaagaggggccaggcggauggcuauucugggagauaucgccugggacuuugguaguauuggcggggucuucaccagcgugggaaaauugguacaucagguguuuggcacagcauacgguguucucuucuccggggucucuuggacgaugaagauaggcaucggcauucuguuaaccuggcugggccuaaauagccgaucaacaagucucuccaugacauguaucgcgguggggauggugacccuguaccuuggagucaugguucaggcugauagcggcugcgugaucaacuggaaaggucgcgaauugaagugugggucuggaauuuuugugacaaacgagguacacacuuggaccgaacaauauaaguuccaggccgacucaccgaaaagacugagugcagccauaggcaaggcuugggaggagggugucugcggcaucaggagcgccacgcggcucgaaaauauuauguggaaacagaucuccaacgagcugaaucauauuuuacuggaaaacgauaugaaguuuacagugguugugggggacgcaaauggaauccuuacccagggcaaaaagaugauacgcccucaacccauggagcacaaauacucuuggaagucgugggggaaggcuaaaaucauuggagccgacacucagaacaccacauucaucauugauggcccagacacuccugaaugucccgaugaccagagagcguggaauaucugggaggucgaggauuaugguuuugggguguucaccacaaacauaugguugaagcucagggacagcuacacgcagaugugcgaucaccgucugauguccgccgcuauucgggacucaaaagcaguucaugccgauaugggauauuggaucgaaagugagaagaaugaaaccuggaaacuagcucgagccucuuuuauugaggugaagacuuguaucuggccaagaagccacacacugugguccaacggcguacucgaaucagagaugauaauccccaagauuuacgguggcccuaucagccaacauaauuauaggccaggguacuucacccagacugcaggaccguggcaccugggcaaacuugaguuggacuucaaccugugcgaagggacaaccgucgugguggaugagcacugcggaaaucgcggccccucuuuacggacgacuaccgucacagguaagauuauccaugaaugguguugcagauccuguacccucccuccacugagguuucgcggggaggacggaugcugguacggcauggagauacgacccguuaaagaaaaggaggaaaaccuugugcggaguaugguaagcgcggguucuggcgagguggauuccuucucacugggguugcucugugucaguauuaugaucgaagaggugaugcguagcagauggucgaggaaaaugcugaugacuggaacacuagccguauuuuuccugcucaucaugggccagcugaccuggaaugaccuuauucgcuugugcaucauggugggggcuaacgucuccgaccggaugggaaugggcacaacuuaucuggccuuaauggcaaccuuuaagaugagaccuauguucgcugugggucuccuguuuaggcgacuuacgucucgcgagguucugcuacucacaauugggcugagcuugguggccucagucgaacugccaaacaguuuagaggaacucggagauggccuggcaaugggcauaaugaugcuuaagcuguugaccgacuuccaaucccaccagcucuggacuacccugcuaucucugacauuuaucaaaacuacccuuagccucgauuacgccuggaagacgauggcuaugguacuguccauugugucauuguucccccuguguuuaagcacaaccagucagaaaacuacauggcucccgguucugcuugggucuuuuggaugcaagccucugaccauguucuugaucacugagaauaaaauuuggggucggaaguccuggccacucaacgaaggcaucauggcgguggggauagucagcauccugcuaucgucacugcuuaagaaugacgugccccucgccggaccucugauugcaggcgguauguugaucgcuuguuauguaauuucugggaguuccgccgauuuaagccuggagagagccgcugaggugucuugggaagaggaagcagagcauagcggagccucccacaacauccucgucgaaguucaggacgauggcacaaugaaaauaaaggacgaggagagggaugacacccugacgauucuucugaaagcgacuuugcuagcugugucaggcguguaccccaugaguaucccagccacccuguuugucugguauuucuggcaaaagaaaaagcagcguagcggggugcucugggauacaccuucucccccagaaguugagcgcgcaguacuggacgauggaaucuaccggauucuucagagagguuuacugggcaggucccaggugggggucggaguguuccaagacggcguuuuucauaccauguggcacgugacacgaggugccguccucauguaucaggggaaacgguuggaaccgucaugggcuagugugaagaaggaccugauaagcuacggaggcggcuggcgcuuccagggguccuggaauacuggagaggagguacaggucaucgcaguggaaccugguaaaaaccccaagaauguucaaaccacgccaggcacauuuaaaacucccgagggggaagugggagccauugcgcucgauuucaagccuggcaccucugguucgccaaucgucaacagagaggggaaaauugugggacuguacggcaauggcguugugacaaccagcgggacuuaugucucagcuaucgcccaggcaaaggccucccaggaaggaccccuuccugagauagaggacgaaguguuuaagaaaaggaaccugaccaucauggauuugcacccggguaguggcaagacacggcgauaccuaccagcuauuguaagagaggccaucaaacgcaagcugaggacgcucauuuuagcacccacucgugugguugcuucugaaauggccgaggcgcugaaagggaugccuauccgguaucaaaccacagccgucaagagcgaacauaccggaaaggagauaguggaccuuaugugccacgcaacuuucacaaugagacugcucuccccagugaggguccccaauuacaacaugauuaucauggaugaggcucauuuuaccgacccugccucaaucgcugcacgcggcuauauuucuacgcgaguagguaugggggaagccgccgcuaucuucaugacugcgacaccgcccggaagcguggaggcauuuccacagaguaaugccguuauacaggaugaagagagagacauuccugaacgguccuggaacagcggcuacgauuggaucaccgacuuccccggcaaaaccgugugguuugucccaucuauuaagucagggaaugauaucgcuaacuguuugaggaaaaacggaaagcgcgugauacagcugucccguaaaacuuucgacacagaguaucaaaagaccaagaauaacgacugggauuacguugugacaacugacauuagugagaugggugccaauuucagagcagaucgggucaucgacccuaggcgcugccucaaacccgugauccugaaggauggcccagaacgaguaauucuugccgggccgaugccuguggcugcggccagcgcagcucagagacggggaaggaucggccgcaaccagaauaaagagggugaccaguacauuuauauggggcaaccccuaaacaaugaugaagaccacgcccauuggacggaggcaaagaugcuguuggauaacauaaauaccccagagggcaucauucccgccuuauuugaaccugagagagaaaaaucggcugccaucgacggagaguacaggcugcggggcgaagcgcguaagacauucguugagcucaugcgccgaggggaucugccagucuggcuuucuuauaagguggcauccgagggauuucaguacagcgacagaagguggugcuucgauggugaacggaacaaucaggugcuggaggaaaacauggacgucgagaucuggacuaaagaaggcgagcgcaagaaacucagacccaggugguuggacgcccggaccuauucagauccucuggcucuacgagaguuuaaggaguucgccgcugggagacgcaguguuucuggagaccugauucucgagauaggcaaacuuccgcagcaccugacauuaagggcacaaaaugccuuggauaaccuggugaugcuccacaauuccgaacagggugggaaggcuuaccggcaugccauggaggaacugccagacaccaucgagacucuuaugcugcucgcauugauugcgguacugacgggcggagugaccuuauuuuuccuaagcggcaaagggcugggaaagacaucaaucggucuccuuugugucauggccaguagcgugcuguuguggauggcuuccguugagccccacuggauugccgcaucuaucauacuggaauuuuuccucauggugcugcuuaucccugagcccgaucgucagagaacuccacaggacaaccaacucgcuuaugucguaauuggccuguuguuuaugauccugaccguggccgcaaacgaaaugggguuacuagagacaaccaagaaagaucugggaauuggccauguuguggccgagaaucaccaccaugcuacuaugcucgacaucgaucuucacccugcgagcgccuggacacuguacgcagucgcuacgaccauaauuacucccaugaugaggcauacaaucgaaaacaccaccgccaauauuuccuugacagccaucgcaaaccaggcugccauacugaugggucucgacaagggguggccaaucucaaaaauggauauuggcgugccucugcuugcguuaggaugcuacucucaggucaauccgcugacucucacggcugccguguugaugcugguugcacacuaugccaucauuggccccgggcuacaagcuaaggcaacccgcgaggcccagaaacggacagcggcuggaaucaugaagaacccaacuguggacggcauaguagccauugaucuggacccuguggucuacgacgcaaaguucgaaaaacagcucggucagaucaugcuucugaucuuguguaccagucaaauucugcucaugcgaacaaccugggcccugugcgagucgaucacuuuagcuacggggccccuuacaacccugugggaaggaagcccaggcaaguuuuggaauacuaccauagccguuuccauggcaaacauuuucagagguucuuaucucgcuggcgccgggcuagcguucucacugaugaaguccuugggaggcgggaggcgcggaacaggcgcccagggugagacucugggggagaaguggaaacggcagcucaaucagcuuagcaagagugaauuuaacaccuacaagagaucuggaaucauggagguggaucguagcgaagcaaaagagggccugaagaggggugaaacaacgaaacaugcugucucacggggcaccgccaaguugcgcugguucguggagcgaaaucugguaaaaccugaggggaaggugauugaccucggauguggcagagggggaugguccuauuacugcgcaggcuuaaagaaaguuacugaagugaaggguuauacaaaagggggacccggccacgaggaaccgaucccaauggcuaccuacggcuggaacauagucaagcugcacagugggagggauguguuuuucacuccucccgagaaaugugacacacuucugugcgauaucggagaaagcucuccaaaucccaccauugaggagggucggacgcuacgcguccucaagaugguggaaccuuggcugagaggcaaccaauuuuguaucaaaauuuugaauccguacaugcccuccguuguagagacccuggaacagaugcagaggaagcaugggggaaugcucgugcgaaacccacuuucacggaauagcacacacgagauguauugggucucgugcggcacugguaacaucgugucugccguuaacaugaccagucguaugcuguuaaauagauucacaauggcccaucgcaagccuacuuacgagagggacguggaucugggggcgggaacccggcacgucgcuguggaacccgagauugcaaacuuggacaucauaggccagagaauugaaaauaucaaaaacgagcacaaguccacauggcauuaugaugaagacaauccuuacaaaaccugggccuaucacggcagcuacgagguaaagccaucaggguccgcuucuagcauggugaacggaguuguccgccuccugacuaaacccugggaugugaucccuauggugacgcaaauugccaugacagacaccacuccauuuggucagcagagggucuucaaggagaagguugacacccgaacaccccggccgaaaagaggcacggcacaaauaauggaagugaccgccaaguggcuauggggguuucuuaguaggaauaaaaagccucgcaucuguacucgugaggaguucacacggaaaguaagauccaacgcugcgauuggagccguguuugucgaugagaaucaguggaacagcgcaaaggaagcuguggaggacgagagguucugggaucugguucaucgcgaacgagagcuccacaagcagggcaaaugcgcaaccugcguguauaauaugauggguaagcgggagaaaaagcugggggaguuuggaaaagcaaagggcucuagagccaucugguacaugugguugggcgcuagguuccuggaguucgaggcccucggguuuaugaacgaggaccauugguucucacgcgaaaauagucuuuccggagucgagggugaaggccugcacaaguuaggguacauucugagagauaucagcaaaauaccaggaggcaacauguaugcggacgauacugcagguugggacacacggaucaccgaggaugacuugcagaaugaggccaagauuacagauaucauggaacccgagcacgcucuccuggccacuucuauuuuuaaacuaaccuaccaaaacaaggugguaaggguucagcguccugcaaaaucggggacggugauggacgucaucucacgacgcgaucagagaggaagcggccaggugggcaccuaugggcuuaacacauucacuaauauggaagugcaacugauacggcagauggaguccgaaggaauuuuuaguccaucugagcucgagaacagcaaucuggcugaaagggucuuggacugguuagagaagcaugguguugaacgccugaaaagaauggccaucuccggcgacgauugugugguaaagcccaccgacgaucgguucgcuacagcccucacugcacuuaacgacauggggaaggugaggaaagauaucccgcagugggagccuucaaagggauggaaugacuggcagcaaguccccuuuugcagucaccauuuccaccagcugauuaugaaagauggccgagaaauagugguuccaugucguaaccaggacgagcuaguggguagagcgcgcgucucucagggggccggauggagccugcgggagaccgcuugccucggcaaguccuacgcccaaauguggcaguugauguauuuucacaggagagaucugcgccuugcagcuaaugccaucuguucagcagugccuguaaacuggguucccacgagccggacaaccuggucuauucaugcccaccaucaguggaugacuacagaagacaugcuguccguguggaauagggucuggaucgaggaaaacccauggauggaggauaaaacccacgugaguagcugggaagacguucccuaccucggcaagcgagaggaccaauggugcgggucguuaauuggacugacugcgagagcuaccugggccacaaauauccagguggcaauaaaccagguccggagguugaucgguaaugagaacuaucuggauuacaugacguccaugaagcgcuucaaaaaugaaucugacccugagggcgcccucugguga

SEQ ID NO: 14197 - RNA, 9879 nt, Artificial Sequence
  derived and/or modified CDS sequence (opt3) from DENV-1__KM403605__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcauucaagacgaaaagggggucacacagaacggacgccucaucaccgcaaaucccauagugacugauaaagagaagccuguuaacauugaaacagagccacccuucggcgagucguauaucgugaucggugccggggaaaaagcucugaagcuuucuugguuuaagaaaggcuccucaauuggaaagauguucgaggccaccgcaagaggcgccaggcggauggcuauccugggggacacugccugggauuuuggaaguauugguggcgucuucaccagcguggggaaauugguacaucagguguuuggaacagcauacggcguucucuucuccggugucucuuggacgaugaagauagggaucggcauucuguuaaccuggcugggacuaaauagccgaucaacuagucucuccaugacauguaucgcggugggcauggugacccuguaccuuggggucaugguucaggcugacagcggaugcgugaucaacuggaaaggccgcgaauugaagugugguucugggauuuuugugacaaacgagguacacacuuggaccgaacaauauaaguuccaggccgauucaccgaaaagacugagugcagccauaggaaaggcuugggaggagggcgucugcgguaucaggagcgccacgcggcucgaaaauauuauguggaaacagaucuccaacgagcugaaucauauuuuacuggaaaacgacaugaaguuuacagugguugugggcgacgcaaaugggauccuuacccagggaaaaaagaugauacgcccucaacccauggagcacaaauacucuuggaagucguggggcaaggcuaaaaucauuggggccgauacucagaacaccacauucaucauugacggaccagauacuccugaaugucccgacgaucagagagcguggaauaucugggaggucgaggacuauggcuuugguguguucaccacaaacauaugguugaagcucagggauagcuacacgcagaugugcgaccaccgucugauguccgccgcuauuaaagauucaaaggcaguucaugccgacaugggguauuggaucgaaagugagaaaaaugaaaccuggaagcuagcucgggccucuuuuauugaggugaagacuuguaucuggccacgaagccacacacugugguccaacggaguacucgaaucagagaugauaauccccaaaauuuacggcgguccuaucagccaacauaauuauagaccaggcuacuucacccagacugcagggccguggcaccugggaaagcuugaguuggauuucaaccugugcgaaggcacaaccgucgugguggacgagcacugcgggaauaggggacccucuuuacgcacgacuaccgucacaggcaaaauuauccaugaaugguguugccgguccuguacccucccuccacugagauuuaggggugaggaugggugcugguacggaauggagauacgccccguuaaggaaaaagaggaaaaccuugugcgaaguaugguaagcgcgggcucuggugagguggacuccuucucacugggcuugcucugugucaguauuaugaucgaagaggugaugcggagccguuggucgagaaagaugcugaugacugggacacuagccguuuuuuuccugcucaucaugggacagcugaccuggaaugaccuuauuagguugugcaucauggugggcgcuaacgucuccgaucgcauggggaugggaacaacuuaucuggccuuaauggcaaccuuuaagaugcggccuauguucgcugugggccuccuguuuagaaggcuuacgucucgagagguucugcuacucacaauuggucugagcuugguggccucagucgaacugccaaacaguuuagaggaacucggggacggacuggcaaugggcauaaugaugcuuaaacuguugaccgauuuccaaucccaccagcucuggacuacccugcuaucucugacauuuaucaagacuacccuuagccucgacuacgccuggaaaacgauggcuaugguacuguccauugugucauuguucccccuguguuuaagcacaaccagucagaagacuacauggcucccgguucugcuuggcucuuuugggugcaaaccucugaccauguucuugaucacugagaauaagauuuggggacgcaaguccuggccacucaacgaagguaucauggcggugggcauagucagcauccugcuaucgucacugcuuaaaaaugaugugccccucgccgggccucugauugcaggaggcauguugaucgcuuguuauguaauuucugguaguuccgccgacuuaagccuggagcgggccgcugaggugucuugggaagaggaagcagagcauagcggggccucccacaacauccucgucgaaguucaggaugacggaacaaugaagauaaaagaugaggagagagacgauacccugacgauucuucugaaggcgacuuugcuagcugugucaggcguguaccccaugaguaucccagccacccuguuugucugguauuucuggcaaaaaaagaaacagaggagcggcgugcucugggacacaccuucucccccagaaguugagcgugcaguacuggaugacgggaucuaccgcauucuucagcggggauuacuggguagaucccaggugggcgucgggguguuccaagacggaguuuuucauaccauguggcacgugacaaggggcgccguccucauguaucaggguaagcgauuggaaccgucaugggcuagugugaagaaagaucugauaagcuacgggggaggcuggcgguuccagggcuccuggaauacuggggaggagguacaggucaucgcaguggaaccuggaaagaaccccaaaaauguucaaaccacgccagguacauuuaagacucccgagggcgaagugggggccauugcgcucgacuucaaaccuggaaccucuggcucgccaaucgucaaccgcgaggguaagauuguggggcuguacggaaauggcguugugacaaccagcggcacuuaugucucagcuaucgcccaggcaaaggccucccaggaagggccccuuccugagauagaggaugaaguguuuaaaaagagaaaccugaccaucauggacuugcacccgggaagugguaaaacaaggcgguaccuaccagcuauuguacgagaggccaucaagagaaaacugcgcacgcucauuuuagcacccacuagggugguugcuucugaaauggccgaggcgcugaagggcaugccuauccguuaucaaaccacagccgucaagagcgaacauaccgggaaagagauaguggaucuuaugugccacgcaacuuucacaaugcggcugcucuccccagugagaguccccaauuacaacaugauuaucauggacgaggcucauuuuaccgauccugccucaaucgcugcaaggggauauauuucuacgcgcguaggcaugggugaagccgccgcuaucuucaugacugcgacaccgcccgggagcguggaggcauuuccacagaguaaugccguuauacaggacgaagagcgagauauuccugaaagauccuggaacagcggauacgacuggaucaccgauuuccccggcaagaccgugugguuugucccaucuauuaaaucaggcaaugacaucgcuaacuguuugcggaagaacgggaaaagggugauacagcugucccgcaagacuuucgacacagaguaucaaaagaccaaaaauaacgauugggacuacguugugacaacugauauuagugagaugggagccaauuuccgugcagacagagucaucgauccucggaggugccucaagcccgugauccugaaagacgguccagaacgcguaauucuugccggcccgaugccugugacggcugcgagcgccgcacagcgaagagggcggaucggaaggaaccagaauaaggagggcgaucaguacauuuauaugggucaaccccuaaacaaugacgaagaucacgcucauuggaccgaggccaaaaugcuguuggacaacauaaauacaccagaggggaucauucccgcauuauuugaaccugagcgcgaaaagucggccgcuaucgauggcgaguacagacugaggggagaagcccggaagacuuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugcaaggacauauucagacccucuggcccuacgggaguuuaaagaauucgcugccggccgaagaaguguuucuggggaucugauucucgagauaggaaagcuuccgcagcaccugaccuuacgcgcucaaaaugcauuggacaaccuggugaugcuccacaauuccgaacagggcgguaaagccuacaggcaugcuauggaggaacugccagauacuaucgagacgcuuaugcugcucgccuugauugcaguacugaccgggggcgugacauuauuuuuccuaagcggaaagggccuggggaagacuucaaucggacuccuuugugucauggcgaguagcgugcuguuguggauggccuccguugagccccacuggauugcugccucuaucauacuggaauuuuuccucauggugcugcuuaucccugagcccgaccggcagcguaccccacaggauaaccaacucgcauaugucguaauuggucuguuguuuaugauccugacaguggcugccaacgaaaugggcuuacuagagaccacuaaaaaggaccuggggauuggacauguuguggcagagaaucaccaccaugccacaaugcucgauaucgaccuucacccugcuagcgcguggacgcuguacgccgucgcaaccacuauaauuacacccaugaugagacauaccaucgaaaacaccacagcuaauauuuccuugacugccaucgccaaccaggcagcuauacugaugggccucgauaaagguuggccaaucucaaagauggacauuggggugccucugcuugccuuaggcugcuacucucaggucaauccgcugacgcucaccgcggcuguguugaugcugguugcccacuaugcaaucauuggacccggccuacaagccaaagcuacaagggaggcacagaagcgcacugccgcggggaucaugaagaacccaaccguggauggaauaguagcuauugaccuggacccuguggucuacgaugccaaauucgaaaagcagcucggccagaucaugcuucugaucuuguguacaagucaaauucugcucaugcggaccacuugggcacugugcgagucgaucacguuagccacagguccccuuaccacucugugggaagggagcccaggaaaauuuuggaauaccacaauagcuguuuccauggccaacauuuuccgaggcucuuaucucgcaggugcuggccuagccuucucacugaugaagacuuuggggggaggcagaagggggaccggagcgcagggcgagacacugggugagaaauggaagcgccagcucaaucagcuuagcaaguccgaauuuaacacguacaaacggagugggaucauggagguggacagaucugaagccaaggagggacugaaacguggcgaaaccacuaagcaugcagucagcagggguacagcuaaauugcggugguucguggagcgcaaucugguaaagccugagggcaaggugauugaucucggguguggacgaggcggguggucauauuacugcgccggauuaaaaaagguuaccgaagugaaaggcuauacuaagggugggcccggacacgaggaaccgaucccaauggcaacauacggcuggaacauagucaaacugcacuccggcagagacguguuuuucaccccucccgagaagugugauacgcuucugugcgacaucggggaaaguagcccaaaucccaccauugaggagggaaggacacuacggguccucaaaaugguggaaccuuggcugcgcgguaaccaauuuuguaucaagauuuugaauccguacaugcccucuguuguagagacucuggaacagaugcagagaaagcauggcgggaugcucgugaggaacccacuuucccgaaauucaacccacgagauguauugggucagcugcggaacaggcaacaucgugucggcuguuaacaugacuucucggaugcuguuaaaucguuucaccauggcccauagaaaaccuacauacgagcgcgauguggaccugggugccgggaccaggcacgucgcgguggaacccgagauugcuaacuuggauaucauaggacagcggauugaaaauaucaagaacgagcacaaaaguacuuggcauuaugacgaagauaauccuuacaagacgugggcauaucacggcuccuacgagguaaaaccaagcggcucagccuccucuauggugaacgggguugucagacuccugacaaagcccugggacgugaucccuauggugacccaaauugcuaugacugacaccacaccauuuggacagcagcgcgucuucaaggagaaaguugauacgaggaccccccgaccgaagcgggguacugcccaaauaauggaagugacagcaaaauggcuauggggcuuucuuagcagaaauaagaaaccuaggaucuguacccgcgaggaauucacucguaagguacggaguaacgccgcuauuggggcgguguuugucgacgagaaucaguggaacuccgccaaggaagcaguggaggaugagagauucugggaccugguucauagggaacgcgagcuccacaaacagggaaagugcgcuacaugcguguauaauaugaugggcaaacgagaaaagaaacugggugaguuugggaaggccaagggaagccgggcaaucugguacaugugguugggcgccagauuccuggaauucgaggcucucggcuuuaugaacgaggaucauugguucucuagggaaaauucacuuaguggggucgagggagaaggucugcacaaauuaggcuacauucugcgcgacaucuccaagauaccagggggaaacauguaugccgaugacaccgcgggcugggauacaagaaucacugaggacgauuugcagaaugaggcaaaaauuaccgacaucauggaacccgagcacgcccuccuggcuacgagcauuuuuaagcuaaccuaccaaaacaaagugguacggguucagaggccugccaagucugguacagugauggaugucaucucgcgucgagaccagcgcgggucaggacaggugggcacuuauggccuuaacaccuucacaaauauggaagugcaacugauaagacagauggagagcgaagggauuuuuuccccaagugagcucgagaacucuaaucuggcagaacgggucuuggacugguuagagaaacauggaguugaaaggcugaagcgcauggcuaucagcggugaugacugugaggugaagcccacugaugacagauucgccaccgcucucacggcccuuaacgauaugggcaaaguacggaaggacaucccgcagugggaaccuuccaaaggguggaaugauuggcagcaagugcccuuuugcucacaccauuuccaccagcugauuaugaaggacggaagggagauagucgugccaugucgaaaccaggaugagcuaguuggccgugcaagagugagucagggugcgggguggucucugcgcgaaacagccugccucggaaaaagcuacgcucaaauguggcaguugauguauuuucaccggagggaccugagacuugccgcaaaugcuaucuguuccgccgucccugugaacuggguacccaccucacgcacuacauggagcauucaugcacaccaucaguggaugaccacugaggauaugcugucuguuuggaaucggguguggaucgaagagaacccauggauggaagacaagacccacgucuccaguugggaggacgugcccuaccucggcaagagggaggaucaauggugcggcagcuuaauugggcugacagcccgagcgacgugggcuaccaauauccagguugccauaaaccaggugagacgguugaucggaaaugaaaacuaucuggacuacaugacuucgaugaaaagguucaagaaugaguccgauccugaaggugcacucugguga

SEQ ID NO: 14198 - RNA, 9879 nt, Artificial Sequence
  derived and/or modified CDS sequence (opt3) from DENV-1__KM403606__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuacccuugagauccagcugacagacuacggggccuugacccuagacuguucaccaaggacuggacuggauuucaacgaaaugguccuccugacaaugaaggagaaaaguuggcuugugcauaagcagugguuucuggacuugccgcuccccuggacgagcggcgcaucuaccucccaagagacuuggaaucggcaggaucuguuaguaacauucaaaaccgcucacgccaagaagcaggaaguugugguccuggguucacaagagggggcuaugcacacagcccuaacuggcgcaaccgaaauccagacgagcggaaccacaacuauuuuugccggccaucucaaaugccgucugaagauggacaaacuuaccuugaagggggugaguuaugucauguguacaggaucuuucaaacuggagaaggaaguggcugagacucagcacgguaccguucucgugcagguaaaguacgagggcacggaugcgccuugcaaaauaccaaucuccacacaagacgaaaagggggucacccagaacggacgccugauuacugcaaaucccaucgugacagauaaagagaagccuguuaacauagaaaccgagccacccuucggcgagagcuauauugugaucggugccggggaaaaagcucuuaagcugucgugguuuaagaaaggcucuuccaucggaaagauguucgaggccacugcaagaggcgccaggcggauggcuauuuugggggacaccgccugggauuuuggaucaaucgguggcgucuucacaaguguggggaaacucguacaucagguguuuggaacggcauacggcguucuguucagcggugucuccuggaccaugaagauugggauaggcaucuuacugacuuggcuaggacucaauucucgaagcacaucacugaguaugaccuguauugcggugggcauggugacacuuuacuugggggucaugguucaggcugacuccggaugcgugaucaacuggaaaggccgcgaacugaagugugguagcgggaucuuugugacuaacgagguacacaccuggacggaacaauauaaguuccaggccgauucuccgaaaagacucucagcagccauuggaaaggcuugggaggagggcgucugcgguauaaggagugccacacggcuggaaaauaucauguggaaacagauuagcaacgaguuaaaucauauccugcuugaaaacgacaugaaguuuaccgugguugugggcgacgcaaaugggauuuugacucagggaaaaaagaugauccgcccucaacccauggagcacaaauacuccuggaagucuuggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucuggcucaagcugagggauucguacacccagaugugcgaccaccgucuaaugagcgccgcuauaaaagauuccaaggcaguucaugccgacaugggguauuggauugaaucagagaaaaaugaaacuuggaagcuggcucgggccaguuuuaucgaggugaagacauguauuuggccacgaucucacacccucuggagcaacggaguacuggaauccgagaugaucauacccaaaaucuacggcgguccuauuucacaacauaauuauagaccaggcuacuucacucagacagcagggccguggcaccuuggaaaguuggagcuggauuucaacuuaugcgaaggcaccacggucgugguggacgagcacugcgggaauaggggacccagccuccgcacuaccacagucaccggcaaaaucauucaugaaugguguugccggucuuguacucugccuccacuuagauuuaggggugaggaugggugcugguacggaauggagauccgccccguuaaggaaaaagaggaaaaccuggugcgauccaugguaagugcgggcagcggugagguggacucuuucuccuugggccuccugugugucucaauaaugauugaagaggugaugcggagucguuggagcagaaagaugcuaaugacagggacccuggccguuuuuuuccuccugaucaugggacagcuuacauggaaugacuugaucaggcugugcauuauggugggcgcuaacgucucggaucgcauggggaugggaacuaccuauuuagcccucauggcaacguuuaagaugcggccuauguucgcugugggccugcuuuuuagaaggcugacaucccgagagguucuacuccugaccaucgguuugucucugguggccagcgucgaauuaccaaacucacucgaggaacugggggacggacuugcaaugggcauuaugaugcugaaauugcucacugauuuccaaagucaccagcuguggaccacacuacugucccuuacuuuuauaaagaccacgcucucucuggacuacgccuggaaaacaauggcuaugguauugagcaucgugucccuguuccccuuaugucucucaaccacuagccagaagacaaccuggcugccgguucuucugggcaguuuugggugcaaaccuuugacuauguuccucauuacagagaauaagaucuggggacgcaagucuuggccacugaacgaagguauuauggcggugggcaucgucuccauacuacugagcucgcuucucaaaaaugaugugccccuggccgggccuuugaucgcaggaggcauguuaauugcuuguuauguaaucucagguucuagugccgaccugucccucgagcgggccgcugaggugagcugggaagaggaagcagagcauucuggggccagccacaacauucuggucgaaguucaggaugacggaaccaugaagaucaaagaugaggagagagacgauacgcuuacuauacuguugaaggcgacccuacuggcuguguccggcguguaccccaugucaauuccagccacacucuuugucugguauuucuggcaaaaaaagaaacagaggaguggcgugcugugggacaccccuagccccccagaaguugagcgugcaguacuugaugacgggaucuaccgcaucuuacagcggggacugcucgguagaucucaggugggcgucgggguguuccaagacggaguuuuucauacaauguggcacgugacuaggggcgccgucuugauguaucaggguaagcgacuggaaccguccugggcuucagugaagaaagaucucauuaguuacgggggaggcuggcgguuccagggcagcuggaauaccggggaggagguacaggucauagcaguggaaccuggaaagaaccccaaaaauguucaaacgacaccagguacuuuuaagacccccgagggcgaagugggggccaucgcgcuggacuucaaaccuggaacauccggcucuccaauugucaaccgcgaggguaagaucguggggcuuuacggaaauggcguugugaccacuucgggcaccuaugucagcgcuauugcccaggcaaaggccucacaggaagggccccugccugagaucgaggaugaaguguuuaaaaagagaaacuugacaauaauggaccuacacccgggauccgguaaaacgaggcgguaccugccagcuaucguacgagaggccauuaagagaaaacuccgcacuuuaauccuggcacccaccagggugguugcuagugaaauggccgaggcgcuuaagggcaugccuauucguuaucaaacaaccgccgucaagucugaacauacugggaaagagaucguggaucugaugugccacgcaacauucaccaugcggcucuugagcccagugagaguccccaauuacaacaugauaauuauggacgaggcucauuuuacggauccugccuccaucgcugcaaggggauauaucucaacucgcguaggcaugggugaagccgccgcuauuuucaugacagcgaccccgcccgggucuguggaggcauuuccacagagcaaugccguuauccaggacgaagagcgagauauaccugaaagaaguuggaacuccggauacgacuggauuaccgauuuccccggcaagacugugugguuugucccaagcaucaaaucuggcaaugacauugcuaacugucugcggaagaacgggaaaagggugauccagcucucacgcaagacauucgacaccgaguaucaaaagacaaaaaauaacgauugggacuacguugugacuacggauauauccgagaugggagccaauuuccgugcagacagagucauugauccucggaggugccugaagcccgugauccuuaaagacgguccagaacgcguaauccuagccggcccgaugccugugaccgcugcgagugccgcacagcgaagagggcggauuggaaggaaccagaauaaggagggcgaucaguacaucuauaugggucaaccccugaacaaugacgaagaucacgcucauuggacagaggccaaaauguuguuagacaacauuaauacuccagaggggauaauccccgcacuguuugaaccugagcgcgaaaagagcgccgcuauugauggcgaguacagacucaggggagaagcccggaagaccuucguugagcugaugcgucgcggcgaccuuccagucuggcugucguauaaaguggcgucugagggguuucaguacuccgaucgaagauggugcuucgacggagaaaggaacaaucaggugcucgaggaaaacauggacgucgagaucuggacaaaggaaggugagcggaaaaaguugcgccccagauggcuggaugcaaggaccuauagcgacccucuagcccugcgggaguuuaaagaauucgcugccggccgaagaucaguuaguggggaucucauccuugagauuggaaagcugccgcagcacuuaacuuugcgcgcucaaaaugcacuggacaaccucgugaugcugcacaauucugaacagggcgguaaagccuacaggcaugcuauggaggaacuuccagauacgauagagacccugaugcucuuggcccugaucgcaguauuaacagggggcgugacucuauuuuuccuguccggaaagggccucgggaagaccagcauuggacuucugugugucauggcgucaaguguguugcuguggauggccagcguugagccccacuggaucgcugccuccauuauccucgaauuuuuccugauggugcuucucauaccugagcccgaccggcagcguacaccacaggauaaccaacuggcauaugucguaaucgguuugcuguuuaugauuuuaaccguggcugccaacgaaaugggccuacuggagacuacaaaaaaggaccucgggaucggacauguuguggcagagaaucaccaccaugccacgaugcuugauauugaccugcacccugcuucugcguggaccuuguacgccgucgcaacuacaaucauaacccccaugaugagacauaccauugaaaacacaacugcuaauaucagccugacggccauugccaaccaggcagcuauccucaugggccuggauaaagguuggccaauauccaagauggacaucggggugccucuuuuagcccugggcugcuacucacaggucaauccgcucaccuugacagcggcugugcugaugcuaguugcccacuaugcaauuaucggacccggccugcaagccaaagcuacuagggaggcacagaagcgcaccgccgcggggauuaugaagaacccaacaguggauggaaucguagcuauagaccucgacccuguggucuacgaugccaaauucgaaaagcagcuuggccagauuaugcuguugauccuguguaccucucaaauccuccugaugcggacuacgugggcauuaugcgagaguauuacacuugccaccgguccccugacuacccucugggaagggucgccaggaaaauuuuggaauacaacuaucgcuguuagcauggccaacauauuccgaggcuccuaucuagcaggugcuggccuggccuucucuuugaugaagacccuggggggaggcagaagggggacaggagcgcagggcgagacgcucggugagaaauggaagcgccagcuuaaucagcugucaaagagcgaauuuaacaccuacaaacgguccgggauuauggagguggacagaagugaagccaaggagggauugaaacguggcgaaacuacaaagcaugcagucucuagggguaccgcuaaacugcggugguucguggagcgcaaucucguaaagccugagggcaaggugaucgauuuaggguguggacgaggcggguggagcuauuacugcgccggacugaaaaagguuacugaagugaaaggcuauacaaagggugggcccggacacgaggaaccgauuccaauggcaaccuacggcuggaacaucgucaaacuucacucaggcagagacguguuuuucacgccucccgagaagugugauacccugcuaugcgacauaggggaauccaguccaaaucccacaaucgaggagggaaggacucuccggguccugaaaaugguggaaccuugguugcgcgguaaccaauuuuguauuaagauccugaauccguacaugcccagcguuguagagacccucgaacagaugcagagaaagcauggcgggaugcuugugaggaacccacugucucgaaauuccacacacgagauguauugggucucaugcggaacuggcaacauugugagcgcuguuaacaugaccucgcggauguuacugaaucguuucacaauggcccauagaaaaccuaccuacgagcgcgauguggacuugggugccgggacuaggcacgucgcgguggaacccgagaucgcuaaccucgauauuaucggacagcggauagaaaauauuaagaacgagcacaaaucuacguggcauuaugacgaagauaauccuuacaagacaugggcauaucacggcaguuacgagguaaaaccauccggcagcgccucauccauggugaacgggguugucagacugcuaaccaagcccugggacgugaucccuauggugacucaaaucgcuaugaccgacacaacgccauuuggacagcagcgcgucuucaaggagaaaguugauaccaggacuccccgaccgaagcgggguacagcccaaauuauggaagugaccgcaaaauggcuuuggggcuuucugucuagaaauaagaaaccuaggauauguacucgcgaggaauucacacguaagguacggagcaacgccgcuaucggggcgguguuugucgacgagaaucaguggaacagugccaaggaagcaguggaggaugagagauucugggaccucguucauagggaacgcgagcugcacaaacagggaaagugcgcuaccugcguguauaauaugaugggcaaacgagaaaagaaauugggugaguuugggaaggccaagggaucccgggcaauuugguacauguggcugggcgccagauuccucgaauucgaggcucuuggcuuuaugaacgaggaucauugguucagcagggaaaauucucugucaggggucgagggagaagguuuacacaaacugggcuacaucuugcgcgacauuaguaagaucccagggggaaacauguaugccgaugacacagcgggcugggauacuagaauaaccgaggacgaucuccagaaugaggcaaaaaucacggacauuauggaacccgagcacgcccugcuagcuaccuccaucuuuaagcuuacauaccaaaacaaagugguacggguucagaggccugccaagagcgguacugugauggaugucauuucucgucgagaccagcgcgggucgggacaggugggcaccuauggccugaacacauucacuaauauggaagugcaacucaucagacagauggagucagaagggauauuuagcccauccgagcuggagaacaguaauuuggcagaacgggucuuagacuggcuggagaaacauggaguugaaaggcucaagcgcauggcuauuucuggugaugacugugugguaaagcccaccgaugacagauucgccacggcucuuacagcccugaacgauaugggcaaagugcggaaggacaucccgcagugggagccuagcaaaggguggaaugauuggcagcaaguccccuuuugcucccaccauuuccaccagcuaaucaugaaggacggaagggaaauugugguuccaugucgaaaccaggaugagcuggugggccgugcaagagucucacagggugcgggguggagucuccgcgagaccgccugcuugggaaaaucuuacgcucaaauguggcagcugauguauuuucaccggagggaccuuagacuggccgcaaaugcuauauguagcgccgugccuguaaacuggguucccacuucccgcacaaccuggucaauccaugcacaccaucaguggaugacuaccgaagauaugcucagcguguggaaucgggucuggauugaggaaaacccauggauggaggacaagacacacgugucuuccugggaagacguucccuacuuaggcaagagggaggaucaauggugcggcagucugaucggguugacggcccgagcgaccugggcuacuaauauucagguggccaucaaccaggucagacggcugauaggaaaugagaacuaucucgacuacaugacaagcaugaaaagguucaagaaugaaucggauccugagggugcacuuugguga

SEQ ID NO: 14199 - RNA, 9879 nt, Artificial Sequence
  derived and/or modified CDS sequence (opt3) from DENV-1__KM403591__SS-prME
agcgugaccaugcugcucaugcuucugcccacugcauuggcuuuccacuuaacuacgagaggaggggaaccucauaugaucgucuccaagcaagaaaggggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggggaaacugacccuuaagggagugucuuaugucauguguacagguuccuucaaauuggagaaggaaguggcugagacucagcacggcaccguucuggugcagguaaaguacgaggggacggacgcgccuugcaaaauaccaaucagcacacaagaugaaaagggagucacccagaacggccgccucauuacugcaaaucccaucgugacagacaaagagaagccuguuaacauagaaaccgagccacccuucggugagucguauauugugaucggggccggcgaaaaagcucugaaacuuucuugguuuaagaaaggauccucaaucggcaagauguucgaggccacugcaagaggggccaggcggauggcuauucugggagauaccgccugggacuuugguaguaucggcggggucuucacaagcgugggaaaauugguacaucagguguuuggcacggcauacgguguucucuucuccggggucucuuggaccaugaagauuggcauaggaauccuguuaacuuggcugggccuaaauagccgaucaacaagucucuccaugaccuguauugcgguggggauggugacacuguaccuuggagucaugguucaggcugauagcggcugcgugaucaacuggaaaggucgcgaauugaagugugggucuggaaucuuugugacuaacgagguacacaccuggacggaacaauauaaguuccaggccgacucaccgaaaagacugagugcagccauuggcaaggcuugggaggagggugucugcggcauaaggagcgccacacggcucgaaaauaucauguggaaacagauuuccaacgagcugaaucauaucuuacuggaaaacgauaugaaguuuaccgugguugugggggacgcaaauggcauucuuacucagggcaaaaagaugauccgcccucaacccauggagcacaaauacucuuggaagucgugggggaaggcuaaaauaaucggagccgacacccagaacacaacuuucauuaucgauggcccagacaccccugaaugucccgaugaccagagagcguggaauauuugggaggucgaggauuaugguuuugggguguucacaacgaacaucugguugaagcucagggacagcuacacccagaugugcgaucaccgucugauguccgccgcuauaaaagacucaaaggcaguucaugccgauaugggauauuggauugaaagugagaaaaaugaaacuuggaagcuagcucgggccucuuuuaucgaggugaagacauguauuuggccacgaagccacacccugugguccaacggcguacucgaaucagagaugaucauacccaaaaucuacgguggcccuauuagccaacauaauuauagaccaggguacuucacucagacagcaggaccguggcaccugggcaaacuugaguuggacuucaaccugugcgaagggaccacggucgugguggaugagcacugcggaaauaggggccccucuuuacgcacuaccacagucaccgguaaaaucauucaugaaugguguugccgguccuguacucucccuccacugagauuuagaggggaagacggaugcugguacggcauggagauccgccccguuaaggaaaaagaggaaaaccuugugcgaaguaugguaagcgcggguucuggcgagguggauuccuucucacugggguugcucugugucaguauaaugauugaagaggugaugcggagccguuggucgagaaagaugcugaugacaggaacccuagccguauuuuuccugcucaucaugggccagcugacauggaaugaccuuaucagguugugcauuauggugggggcuaacgucuccgaccgcaugggaaugggcacuaccuaucuggccuuaauggcaacguuuaagaugcggccuauguucgcugugggucuccuguuuagaaggcuuacaucucgagagguucugcuacucaccaucgggcugagcuugguggccucagucgaacugccaaacaguuuagaggaacucggagauggccuggcaaugggcauuaugaugcuuaaacuguugacugacuuccaaucccaccagcucuggaccacacugcuaucucugacuuuuauaaagaccacgcuuagccucgauuacgccuggaaaacaauggcuaugguacuguccaucgugucauuguucccccuguguuuaagcaccacaagucagaagacaaccuggcucccgguucugcuugggucuuuuggaugcaaaccucugacuauguucuugauuacagagaauaagaucuggggucgcaaguccuggccacucaacgaaggcauuauggcgguggggaucgucagcauacugcuaucgucacugcuuaaaaaugacgugccccucgccggaccucugaucgcaggcgguauguugauugcuuguuauguaaucucugggaguuccgccgauuuaagccuggagcgggccgcugaggugucuugggaagaggaagcagagcauagcggagccucccacaacauucucgucgaaguucaggacgauggcaccaugaagaucaaagacgaggagagagaugacacgcugacuauacuucugaaggcgaccuugcuagcugugucaggcguguaccccaugaguauuccagccacacuguuugucugguauuucuggcagaagaagaaacagaggagcggggugcucugggauaccccuucucccccagaaguugagcgugcaguacuggacgauggaaucuaccgcauccuucagcgggguuuacugggcagaucccaggugggggucggaguguuccaagacggcguuuuucauacaauguggcacgugacuaggggugccguccucauguaucaggggaaacgauuggaaccgucaugggcuagugugaagaaagaccugauuagcuacggaggcggcuggcgguuccagggguccuggaauaccggagaggagguacaggucauagcaguggaaccugguaagaaccccaaaaauguucaaacgacaccaggcacuuuuaagacccccgagggggaagugggagccaucgcgcucgauuucaaaccuggcacaucugguucgccaauugucaaccgcgaggggaagaucgugggacuguacggcaauggcguugugaccacuagcgggaccuaugucucagcuauugcccaggcaaaggccucccaggaaggaccccuuccugagaucgaggacgaaguguuuaaaaagagaaaccugacaauaauggauuugcacccggguaguggcaaaacgaagagguaccuaccagcuaucguacgggaggccauuaaacgaaagcugagaacucucaucuuagcacccacccgcgugguugcuucugaaauggccgaggcgcugaaggggaugccuauuagguaucaaacaaccgccgucaaaagcgaacauacuggaaaggagaucguggaccuuaugugccacgcaacauucaccaugcgucugcucuccccagugcggguccccaauuacaacaugauaauuauggaugaggcucauuuuacggacccugccucaaucgcugcaagaggcuauaucucuacuaggguagguaugggggaagccgccgcuauuuucaugacagcgaccccgcccggaagcguggaggcauuuccacagaguaaugccguuauccaggaugaagaacgcgacauaccugaacgauccuggaacagcggcuacgauuggauuaccgacuuccccggcaaaacugugugguuugucccaucuaucaagucagggaaugauauugcuaacuguuugaggaagaacggaaagcgggugauccagcuguccaggaagacauucgacaccgaguaucagaaaacuaagaauaacgacugggauuacguugugacuacggacauaagugagaugggugccaauuuccgcgcagaucgugucauugacccuagacggugccucaaacccgugauccugaaggauggcccagaaaggguaauccuugccgggccgaugccugugaccgcugcgagcgccgcacaacgccgaggaagaauuggccggaaccagaauaaagagggugaccaguacaucuauauggggcaaccccuaaacaaugaugaagaccacgcucauuggacagaggccaagaugcuguuggauaacauuaauacuccagagggcauaauccccgcauuauuugaaccugagagggaaaagucggccgcuauugacggagaguaccgccugagaggcgaagccaggaaaaccuucguugagcucaugcggcguggggaucugccagucuggcuuucuuauaagguggcguccgagggauuucaguacagcgaccgccgauggugcuucgauggugaaagaaacaaucaggugcuggaggaaaacauggacgucgagaucuggacaaaagaaggcgagaggaagaaacuccggccccgcugguuggacgcaagaaccuauucagauccucuggcccuaagggaguuuaaggaguucgcugccgggcggcgaaguguuucuggagaccugauccucgagauuggcaaacuuccgcagcaccugacuuuaagagcucaaaaugcauuggauaaccuggugaugcuccacaauuccgaacagggugggaaggccuaccgccaugcuauggaggaacugccagacacgauagagacccuuaugcugcucgccuugaucgcaguacugacaggcggagugacuuuauuuuuccuaagcggcaaggggcugggaaaaaccucaauuggucuccuuugugucauggcgaguagcgugcuguuguggauggccuccguugagccccacuggaucgcugccucuauuauccuggaauuuuuccucauggugcugcuuauaccugagcccgauaggcagcggacaccacaggacaaccaacucgcauaugucguaaucggccuguuguuuaugauucugaccguggcugccaacgaaaugggguuacuagagacuacaaagaaagaucugggaaucggccauguuguggcagagaaucaccaccaugccacgaugcucgacauugaucuucacccugcuagcgcguggacccuguacgccgucgcaacuacaaucauaacccccaugaugcgucauaccauugaaaacacaacugcuaauaucuccuugacggccauugccaaccaggcagcuauccugaugggucucgacaagggguggccaauaucaaaaauggauaucggcgugccucugcuugccuuaggaugcuacucucaggucaauccgcugacccucacagcggcuguguugaugcugguugcccacuaugcaauuaucggccccgggcuacaagccaaggcuacuagagaggcacagaagaggaccgccgcgggaauuaugaaaaacccaacaguggacggcaucguagcuauagaucuggacccuguggucuacgacgccaaguucgaaaaacagcucggucagauuaugcuucugaucuuguguaccagucaaauccugcucaugcgcacuacgugggcacugugcgagucgauuacauuagccaccgggccccuuacuacccugugggaaggaagcccaggcaaguuuuggaauacaacuaucgcuguuuccauggccaacauauuccgggguucuuaucucgcaggcgcugggcuagccuucucacugaugaaguccuugggaggcgggcgaagaggaaccggcgcgcagggugagacacugggggagaaguggaagaggcagcucaaucagcuuagcaaaagugaauuuaacacguacaagcgcucuggaauuauggagguggaucggagcgaagccaaagagggccugaagagaggugaaaccacuaaacaugcagucucacguggcacagcuaaguugaggugguucguggagcggaaucugguaaagccugaggggaaagugaucgaccucggauguggccgcgggggaugguccuauuacugcgccggcuuaaagaaaguuaccgaagugaaggguuauacuaaagggggacccggccacgaggaaccgauuccaauggcaacauacggcuggaacaucgucaagcugcacagugggcgagauguguuuuucaccccucccgagaaaugugacacgcuucugugcgauauaggagaaagcucuccaaaucccaccaucgaggaggguagaacacuaaggguccucaagaugguggaaccuuggcugcggggcaaccaauuuuguauuaagaucuugaauccguacaugcccuccguuguagagacucuggaacagaugcagcgcaaacaugggggaaugcucgugagaaacccacuuucaaggaauagcacccacgagauguauugggucucgugcggcacagguaacauugugucugcuguuaacaugacaagucgaaugcuguuaaaucgguucaccauggcccaucguaagccuacauacgagagagacguggaucugggggccggaacccgccacgucgcgguggaacccgagaucgcuaacuuggacauuaucggccagaggauagaaaauauuaaaaacgagcacaaguccacuuggcauuaugaugaagacaauccuuacaaaacgugggcauaucacggcagcuacgagguaaagccaucaggguccgccucuagcauggugaacggaguuguccggcuccugacaaagcccugggaugugaucccuauggugacccaaaucgcuaugacugacaccacaccauuuggucagcagagagucuucaaagagaagguugacacgcgcacccccaggccgaaacgaggcacugcccaaauuauggaagugacagcaaaguggcuauggggguuucuuagucggaauaaaaagccuagaauauguaccagggaggaguucacucgcaagguacguuccaacgccgcuaucggagcgguguuugucgaugagaaucaguggaacagcgccaaagaagcaguggaggacgagcgguucugggaucugguucauagagaaagggagcuccacaagcagggcaaaugcgcuacaugcguguauaauaugauggguaagcgcgagaaaaagcugggggaguuuggaaaggccaaaggcucucgagcaauuugguacaugugguugggcgcccgguuccuggaguucgaggcucucggguuuaugaacgaggaccauugguucucaagagaaaauagucuuuccggagucgagggugaaggccugcacaaguuaggguacauccugagggauauuagcaaaaucccaggaggcaacauguaugccgacgauaccgcggguugggacacacgcauaacugaggaugacuugcagaaugaggcaaagaucaccgauauuauggaacccgagcacgcccuccuggcuacgucuaucuuuaaacuaaccuaccaaaacaaggugguaagaguucagcggccugccaaaucggggacagugauggacgucauuucaaggcgugaucagcgaggaagcggccaggugggcacuuaugggcuuaacaccuucacaaauauggaagugcaacugauccgccagauggaguccgaaggaauauuuaguccaucugagcucgagaacagcaaucuggcagaaagagucuuggacugguuagagaagcaugguguugaacggcugaagaggauggcuauuuccggcgacgauugugugguaaaacccacugacgaucgcuucgccaccgcucucacggcccuuaacgacauggggaaggugagaaaagauaucccgcagugggagccuucaaagggauggaaugacuggcagcaaguccccuuuugcagucaccauuuccaccagcugaucaugaaagauggccgggaaauugugguuccauguaggaaccaggacgagcuagugggucgagcacgugucucucagggggcgggauggagccugagagagacagccugccucggcaaguccuacgcucaaauguggcaguugauguauuuucaccgccgggaucugaggcuugccgcaaaugcuauauguucagccgugccuguaaacuggguucccaccagcagaacuacauggucuauccaugcacaccaucaguggaugaccacugaagacaugcuguccguguggaaucgcgucuggauugaggaaaacccauggauggaggauaagacccacgugaguagcugggaagacguucccuaccucggcaaacgggaggaccaauggugcgggucguuaaucggacugacagccagggcgacgugggcuaccaauauucagguggccaucaaccagguccgaagauugauagguaaugagaacuaucuggauuacaugacuuccaugaagcgguucaaaaaugaaucugacccugagggcgcacucugguga

SEQ ID NO: 14200 - RNA, 9879 nt, Artificial Sequence
  derived and/or modified CDS sequence (opt3) from DENV-1__KM403607__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcauucaagacgaaaagggggucacacagaacggacgccucaucaccgcaaaucccauagugacugauaaagagaagccuguuaacauugaaacagagccacccuucggcgagucguauaucgugaucggugccggggaaaaagcucugaagcuuucuugguuuaagaaaggcuccucaauuggaaagauguucgaggccaccgcaagaggcgccaggcggauggcuauccugggggacacugccugggauuuuggaaguauugguggcgucuucaccagcguggggaaauugguacaucagguguuuggaacagcauacggcguucucuucuccggugucucuuggacgaugaagauagggaucggcauucuguuaaccuggcugggacuaaauagccgaucaacuagucucuccaugacauguaucgcggugggcauggugacccuguaccuuggggucaugguucaggcugacagcggaugcgugaucaacuggaaaggccgcgaauugaagugugguucugggauuuuugugacaaacgagguacacacuuggaccgaacaauauaaguuccaggccgauucaccgaaaagacugagugcagccauaggaaaggcuugggaggagggcgucugcgguaucaggagcgccacgcggcucgaaaauauuauguggaaacagaucuccaacgagcugaaucauauuuuacuggaaaacgacaugaaguuuacagugguugugggcgacgcaaaugggauccuuacccagggaaaaaagaugauacgcccucaacccauggagcacaaauacucuuggaagucguggggcaaggcuaaaaucauuggggccgauacucagaacaccacauucaucauugacggaccagauacuccugaaugucccgacgaucagagagcguggaauaucugggaggucgaggacuauggcuuugguguguucaccacaaacauaugguugaagcucagggauagcuacacgcagaugugcgaccaccgucugauguccgccgcuauuaaagauucaaaggcaguucaugccgacaugggguauuggaucgaaagugagaaaaaugaaaccuggaagcuagcucgggccucuuuuauugaggugaagacuuguaucuggccacgaagccacacacugugguccaacggaguacucgaaucagagaugauaauccccaaaauuuacggcgguccuaucagccaacauaauuauagaccaggcuacuucacccagacugcagggccguggcaccugggaaagcuugaguuggauuucaaccugugcgaaggcacaaccgucgugguggacgagcacugcgggaauaggggacccucuuuacgcacgacuaccgucacaggcaaaauuauccaugaaugguguugccgguccuguacccucccuccacugagauuuaggggugaggaugggugcugguacggaauggagauacgccccguuaaggaaaaagaggaaaaccuugugcgaaguaugguaagcgcgggcucuggugagguggacuccuucucacugggcuugcucugugucaguauuaugaucgaagaggugaugcggagccguuggucgagaaagaugcugaugacugggacacuagccguuuuuuuccugcucaucaugggacagcugaccuggaaugaccuuauuagguugugcaucauggugggcgcuaacgucuccgaucgcauggggaugggaacaacuuaucuggccuuaauggcaaccuuuaagaugcggccuauguucgcugugggccuccuguuuagaaggcuuacgucucgagagguucugcuacucacaauuggucugagcuugguggccucagucgaacugccaaacaguuuagaggaacucggggacggacuggcaaugggcauaaugaugcuuaaacuguugaccgauuuccaaucccaccagcucuggacuacccugcuaucucugacauuuaucaagacuacccuuagccucgacuacgccuggaaaacgauggcuaugguacuguccauugugucauuguucccccuguguuuaagcacaaccagucagaagacuacauggcucccgguucugcuuggcucuuuugggugcaaaccucugaccauguucuugaucacugagaauaagauuuggggacgcaaguccuggccacucaacgaagguaucauggcggugggcauagucagcauccugcuaucgucacugcuuaaaaaugaugugccccucgccgggccucugauugcaggaggcauguugaucgcuuguuauguaauuucugguaguuccgccgacuuaagccuggagcgggccgcugaggugucuugggaagaggaagcagagcauagcggggccucccacaacauccucgucgaaguucaggaugacggaacaaugaagauaaaagaugaggagagagacgauacccugacgauucuucugaaggcgacuuugcuagcugugucaggcguguaccccaugaguaucccagccacccuguuugucugguauuucuggcaaaaaaagaaacagaggagcggcgugcucugggacacaccuucucccccagaaguugagcgugcaguacuggaugacgggaucuaccgcauucuucagcggggauuacuggguagaucccaggugggcgucgggguguuccaagacggaguuuuucauaccauguggcacgugacaaggggcgccguccucauguaucaggguaagcgauuggaaccgucaugggcuagugugaagaaagaucugauaagcuacgggggaggcuggcgguuccagggcuccuggaauacuggggaggagguacaggucaucgcaguggaaccuggaaagaaccccaaaaauguucaaaccacgccagguacauuuaagacucccgagggcgaagugggggccauugcgcucgacuucaaaccuggaaccucuggcucgccaaucgucaaccgcgaggguaagauuguggggcuguacggaaauggcguugugacaaccagcggcacuuaugucucagcuaucgcccaggcaaaggccucccaggaagggccccuuccugagauagaggaugaaguguuuaaaaagagaaaccugaccaucauggacuugcacccgggaagugguaaaacaaggcgguaccuaccagcuauuguacgagaggccaucaagagaaaacugcgcacgcucauuuuagcacccacuagggugguugcuucugaaauggccgaggcgcugaagggcaugccuauccguuaucaaaccacagccgucaagagcgaacauaccgggaaagagauaguggaucuuaugugccacgcaacuuucacaaugcggcugcucuccccagugagaguccccaauuacaacaugauuaucauggacgaggcucauuuuaccgauccugccucaaucgcugcaaggggauauauuucuacgcgcguaggcaugggugaagccgccgcuaucuucaugacugcgacaccgcccgggagcguggaggcauuuccacagaguaaugccguuauacaggacgaagagcgagauauuccugaaagauccuggaacagcggauacgacuggaucaccgauuuccccggcaagaccgugugguuugucccaucuauuaaaucaggcaaugacaucgcuaacuguuugcggaagaacgggaaaagggugauacagcugucccgcaagacuuucgacacagaguaucaaaagaccaaaaauaacgauugggacuacguugugacaacugauauuagugagaugggagccaauuuccgugcagacagagucaucgauccucggaggugccucaagcccgugauccugaaagacgguccagaacgcguaauucuugccggcccgaugccugugacggcugcgagcgccgcacagcgaagagggcggaucggaaggaaccagaauaaggagggcgaucaguacauuuauaugggucaaccccuaaacaaugacgaagaucacgcucauuggaccgaggccaaaaugcuguuggacaacauaaauacaccagaggggaucauucccgcauuauuugaaccugagcgcgaaaagucggccgcuaucgauggcgaguacagacugaggggagaagcccggaagacuuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugcaaggacauauucagacccucuggcccuacgggaguuuaaagaauucgcugccggccgaagaaguguuucuggggaucugauucucgagauaggaaagcuuccgcagcaccugaccuuacgcgcucaaaaugcauuggacaaccuggugaugcuccacaauuccgaacagggcgguaaagccuacaggcaugcuauggaggaacugccagauacuaucgagacgcuuaugcugcucgccuugauugcaguacugaccgggggcgugacauuauuuuuccuaagcggaaagggccuggggaagacuucaaucggacuccuuugugucauggcgaguagcgugcuguuguggauggccuccguugagccccacuggauugcugccucuaucauacuggaauuuuuccucauggugcugcuuaucccugagcccgaccggcagcguaccccacaggauaaccaacucgcauaugucguaauuggucuguuguuuaugauccugacaguggcugccaacgaaaugggcuuacuagagaccacuaaaaaggaccuggggauuggacauguuguggcagagaaucaccaccaugccacaaugcucgauaucgaccuucacccugcuagcgcguggacgcuguacgccgucgcaaccacuauaauuacacccaugaugagacauaccaucgaaaacaccacagcuaauauuuccuugacugccaucgccaaccaggcagcuauacugaugggccucgauaaagguuggccaaucucaaagauggacauuggggugccucugcuugccuuaggcugcuacucucaggucaauccgcugacgcucaccgcggcuguguugaugcugguugcccacuaugcaaucauuggacccggccuacaagccaaagcuacaagggaggcacagaagcgcacugccgcggggaucaugaagaacccaaccguggauggaauaguagcuauugaccuggacccuguggucuacgaugccaaauucgaaaagcagcucggccagaucaugcuucugaucuuguguacaagucaaauucugcucaugcggaccacuugggcacugugcgagucgaucacguuagccacagguccccuuaccacucugugggaagggagcccaggaaaauuuuggaauaccacaauagcuguuuccauggccaacauuuuccgaggcucuuaucucgcaggugcuggccuagccuucucacugaugaagacuuuggggggaggcagaagggggaccggagcgcagggcgagacacugggugagaaauggaagcgccagcucaaucagcuuagcaaguccgaauuuaacacguacaaacggagugggaucauggagguggacagaucugaagccaaggagggacugaaacguggcgaaaccacuaagcaugcagucagcagggguacagcuaaauugcggugguucguggagcgcaaucugguaaagccugagggcaaggugauugaucucggguguggacgaggcggguggucauauuacugcgccggauuaaaaaagguuaccgaagugaaaggcuauacuaagggugggcccggacacgaggaaccgaucccaauggcaacauacggcuggaacauagucaaacugcacuccggcagagacguguuuuucaccccucccgagaagugugauacgcuucugugcgacaucggggaaaguagcccaaaucccaccauugaggagggaaggacacuacggguccucaaaaugguggaaccuuggcugcgcgguaaccaauuuuguaucaagauuuugaauccguacaugcccucuguuguagagacucuggaacagaugcagagaaagcauggcgggaugcucgugaggaacccacuuucccgaaauucaacccacgagauguauugggucagcugcggaacaggcaacaucgugucggcuguuaacaugacuucucggaugcuguuaaaucguuucaccauggcccauagaaaaccuacauacgagcgcgauguggaccugggugccgggaccaggcacgucgcgguggaacccgagauugcuaacuuggauaucauaggacagcggauugaaaauaucaagaacgagcacaaaaguacuuggcauuaugacgaagauaauccuuacaagacgugggcauaucacggcuccuacgagguaaaaccaagcggcucagccuccucuauggugaacgggguugucagacuccugacaaagcccugggacgugaucccuauggugacccaaauugcuaugacugacaccacaccauuuggacagcagcgcgucuucaaggagaaaguugauacgaggaccccccgaccgaagcgggguacugcccaaauaauggaagugacagcaaaauggcuauggggcuuucuuagcagaaauaagaaaccuaggaucuguacccgcgaggaauucacucguaagguacggaguaacgccgcuauuggggcgguguuugucgacgagaaucaguggaacuccgccaaggaagcaguggaggaugagagauucugggaccugguucauagggaacgcgagcuccacaaacagggaaagugcgcuacaugcguguauaauaugaugggcaaacgagaaaagaaacugggugaguuugggaaggccaagggaagccgggcaaucugguacaugugguugggcgccagauuccuggaauucgaggcucucggcuuuaugaacgaggaucauugguucucuagggaaaauucacuuaguggggucgagggagaaggucugcacaaauuaggcuacauucugcgcgacaucuccaagauaccagggggaaacauguaugccgaugacaccgcgggcugggauacaagaaucacugaggacgauuugcagaaugaggcaaaaauuaccgacaucauggaacccgagcacgcccuccuggcuacgagcauuuuuaagcuaaccuaccaaaacaaagugguacggguucagaggccugccaagucugguacagugauggaugucaucucgcgucgagaccagcgcgggucaggacaggugggcacuuauggccuuaacaccuucacaaauauggaagugcaacugauaagacagauggagagcgaagggauuuuuuccccaagugagcucgagaacucuaaucuggcagaacgggucuuggacugguuagagaaacauggaguugaaaggcugaagcgcauggcuaucagcggugaugacugugugguaaagcccacugaugacagauucgccaccgcucucacggcccuuaacgauaugggcaaagugcggaaggacaucccgcagugggagccuuccaaaggguggaaugauuggcagcaaguccccuuuugcucacaccauuuccaccagcugauuaugaaggacggaagggaaauagugguuccaugucgaaaccaggaugagcuagugggccgugcaagagucagucagggugcgggguggucucugcgcgagacagccugccucggaaaaagcuacgcucaaauguggcaguugauguauuuucaccggagggaccugagacuugccgcaaaugcuaucuguuccgccgugccuguaaacuggguucccaccucacgcacuacauggagcauucaugcacaccaucaguggaugaccacugaagauaugcugucuguguggaaucgggucuggaucgaggaaaacccauggauggaggacaagacccacguguccaguugggaagacguucccuaccucggcaagagggaggaucaauggugcggcagcuuaauugggcugacagcccgagcgacgugggcuaccaauauccagguggccauaaaccaggucagacgguugaucggaaaugagaacuaucuggacuacaugacuucgaugaaaagguucaagaaugaauccgauccugagggugcacucugguga

SEQ ID NO: 14201 - RNA, 9879 nt, Artificial Sequence
  derived and/or modified CDS sequence (opt3) from DENV-1__KM403581__SS-prME
agcgugaccaugcugcucaugcuucugcccacugcauuggcuuuccacuuaacuacgagaggaggggaaccucauaugaucgucuccaagcaagaaaggggaaaaucucugcuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagaccguagaagcguggcacuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauauucaucuuacugaugcuugugacgccaucaauggccaugaggugcgucgggauuggaaaccgggauuuuguggaggguuugagcggcgcgacuuggguagacguugugcuggagcacgggaguugugucacaaccauggccaagaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagaacaggaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacguacuggacuagauuucaacgaaaugguccugcucacaaugaaggagaaaagcuggcuggugcauaagcagugguuucuugaccugccguugcccuggacgucuggcgcauccaccucacaagagacuuggaaucgccaggaucuccugguaacauucaaaaccgcucacgccaagaaacaggaaguuguggucuuagguagccaagagggggcuaugcacacagcccugacuggcgcaaccgaaauccagacgaguggaaccacaacuauuuuugccggccaucuaaagugcagacucaagauggacaaacugacccuuaagggggugucuuaugucauguguacaggauccuucaaauuggagaaggaaguggcugagacucagcacgguaccguucuggugcagguaaaauacgagggcacggaugcgccuugcaagauaccaaucagcacacaagacgaaaagggggucacccagaacggaaggcucauuacugcaaaucccaucgugacagauaaagagaagccuguuaacauagaaaccgagccacccuucggcgagucguauauugugaucggugccggggaaaaagcucugaaacuuucuugguuuaaaaagggcuccucaaucggaaagauguucgaggccacugcacggggcgcccgacgcauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagcagaucaacaagucucuccaugaccuguauugcggugggcauggugacacuguaccuuggggucaugguucaggcugacagcggaugcgugaucaacuggaaaggcagggaauugaagugugguucugggaucuuugugacuaacgagguacacaccuggacggaacaauauaaauuccaggccgauucaccgaagcggcugagugcagccauuggaaaggcuugggaggagggcgucugcgguauacgcagcgccacaagacucgaaaauaucauguggaaacagauuuccaacgagcugaaucauaucuuacuggaaaacgacaugaaguuuaccgugguugugggcgacgcaaaugggauucuuacucagggcaagaagaugaucaggccucaacccauggagcacaaauacucuuggaagucguggggcaaagcuaagauaaucggggccgauacccagaacacaacuuucauuaucgacggaccagauaccccugaaugucccgacgaucagcgugcguggaauauuugggaggucgaggacuauggcuuugguguguucacaacgaacaucugguugaagcuccgggauagcuacacccagcugugcgaccaccgacuaauguccgccgcuauaaaagauucaaaggcaguucaugccgacaugggguauuggauugaaagugagaaaaaugaaacuuggaagcuggcuagagccucuuuuaucgaggugaaaacauguauuuggccaaggagccacacccucugguccaacggaguacuggaaucagagaugaucauacccaagaucuacggcgguccuauuagccaacauaauuaucgcccaggcuacuucacucagacagcagggccguggcaccuuggaaaguuggagcuggauuucaacuuaugcgaaggcaccacggucgugguggacgagcacugcgggaaucggggacccucucucagaacuaccacagucaccggcaaaaucauucaugaaugguguugcagguccuguacucugccuccacuucgcuuucgaggugaggaugggugcugguacggaauggagauccggcccguuaaggaaaaagaggaaaaccuggugcguaguaugguaagcgcgggcucuggugagguggacuccuucucauugggccuccugugugucaguauaaugauugaagaggugaugagaagcagauggucgcgcaagaugcuaaugacagggacccuggccaucuuuuuccuccugaucaugggacagcuuacauggaaugacuugauucggcugugcaucaugguuggcgcuaacguguccgauagaauggggaugggaacuaccuauuuagcccucauggcaacguuuaaaaugaggccuauguucgcugucggccugcuuuuucgacgccugacaucucgggaggugcuacuccugaccauugguuugagccugguugccucaguggaauuaccaaacagucucgaggaacugggggacggacuugcaaugggcauaaugaugcugaaguugcucacugauuuccaaucccaccagcuguggaccacacuacugucucuuacuuuuaucaagaccacgcucagccuggacuacgccuggaaaacaauggcuauggucuuguccauuguaucacuguuccccuuaugucucagcaccacaagucagaagacaaccuggcugccggugcuucugggcucuuuugggugcaaaccuuugacuauguuccucaucacagagaauaagauuuggggaagaaaauccuggccacugaacgaagguaucauggcgguuggcauagugagcauccuacugucgucacuucucaagaaugaugucccccuggccgggccuuugauugcaggaggcauguuaaucgcuuguuaugugauuucugguaguuccgccgaccugagccucgagagggccgcugagguaucuugggaagaggaagcagagcauagcggggccucccacaacauccugguggaaguccaggaugacggaaccaugaagauaaaagaugaggagcgugacgauacgcuuacuauucuguugaaggcgacccuacuggcuguuucaggcguguaccccaugaguaucccagccacacucuuugugugguauuucuggcagaagaagaaacagcgcagcggcguccugugggacaccccuucucccccagaaguggagcgggcaguucuugaugacgggaucuacagaauuuuacagaggggacugcucggucgaucccagguaggcgugggggucuuccaagacggaguguuucauacaauguggcacguuacucggggcgccguguugauguaucaggguaagcgccuggaaccgucaugggcuagugucaaaaaggaucucauaagcuacgggggaggcuggagauuccagggcuccuggaauaccggggaggaggugcagguaaucgcagucgaaccuggaaagaaccccaaaaaugugcaaacgacaccagguacuuuuaagacccccgagggcgaaguuggggccauugcgcuggacuucaaaccuggaacaucuggcucgccaaucgugaacagggaggguaagauugucgggcuuuacggaaauggcgugguuaccacuagcggcaccuaugugucagcuaucgcccaggcaaaagccucccaggaagggccccugccugagauagaggaugaagucuuuaagaagcggaacuugacaaucauggaccuacacccgggaagugguaaaacgcgaagauaccugccagcuauugugcgcgaggccaucaagaggaaacuccguacuuuaauucuggcacccacccggguaguggcuucugaaauggccgaggcgcuuaagggcaugccuaucagauaucaaacaaccgccguuaaaagcgaacauacugggaaggagauagucgaucugaugugccacgcaacauucaccaugaggcucuuguccccagugcgcgugcccaauuacaacaugauuaucauggacgaggcucauuuuacggauccugccucaaucgcugcacgaggauauauuucuacuagagucggcaugggugaagccgccgcuaucuucaugacagcgaccccgcccgggagcguagaggcauuuccacagaguaaugccgugauacaggacgaagaacgggauauuccugaaagguccuggaacagcggauacgacuggaucaccgauuuccccggcaagacuguuugguuugugccaucuauuaaaucaggcaaugacaucgcuaacugucugcgcaagaacgggaaacgugucauacagcucuccagaaagacauucgacaccgaguaucagaaaacuaagaauaacgauugggacuacgugguuacuacggauauuagugagaugggagccaauuuccgggcagacagggugaucgauccucgccgaugccugaagcccgucauccuuaaagacgguccagaaagagugauucuagccggcccgaugccuguaaccgcugcgagcgccgcacaacggagggggcgcaucggaagaaaccagaauaaggagggcgaucaguacauuuauaugggucaaccccugaacaaugacgaagaucacgcucauuggacagaggccaaaauguuguuagacaacauaaauacuccagaggggaucauucccgcacuguuugaaccugagagggaaaagucggccgcuaucgauggcgaguaccggcuccguggagaagcccgcaaaaccuucguggagcugaugcgaagaggcgaccuuccaguuuggcugucuuauaaggucgcguccgagggguuucaguacagcgauaggcgguggugcuucgacggagaacgcaacaaucaggugcucgaggaaaacauggacguggagaucuggacaaaggaaggugagaggaaaaaguugaggccccgguggcuggaugcacgaaccuauucagacccucuagcccugagagaguuuaaagaguucgcugccggccgcaggagugucucuggggaucucauucuugagauaggaaagcugccgcagcacuuaacuuugcgggcucaaaaugcacuggacaaccucguuaugcugcacaauuccgaacagggcgguaaagccuaccgucaugcuauggaggaacuuccagauacgaucgagacccugaugcucuuggcccugauugcaguguuaacagggggcguaacucuauuuuuccugagcggaaagggccucgggaaaaccucaaucggacuucugugugugauggcgaguagcgucuugcuguggauggccuccguggagccccacuggauugcugccucuaucauacucgaauuuuuccugaugguucuucucaucccugagcccgacagacagaggacaccacaggauaaccaacuggcauauguggucauugguuugcuguuuaugaucuuaaccguagcugccaacgaaaugggccuacuggagacuacaaagaaggaccucgggauuggacaugugguugcagagaaucaccaccaugccacgaugcuugauaucgaccugcacccugcuagcgcguggaccuuguacgccguggcaacuacaauaauuacccccaugaugcgccauaccaucgaaaacacaacugcuaauauuucccugacggccaucgccaaccaggcagcuauacucaugggccuggauaaagguuggccaaucucaaagauggacauuggggucccucuuuuagcccugggcugcuacucucaggugaauccgcucaccuugacagcggcuguccugaugcuaguggcccacuaugcaaucauuggacccggccugcaagccaaagcuacucgggaggcacagaagcgaaccgccgcggggaucaugaaaaacccaacaguugauggaauaguggcuauugaccucgacccuguaguguacgaugccaaguucgaaaagcagcuuggccagaucaugcuguugauccuguguaccagucaaauucuccugaugagaacuacgugggcauuaugcgagucgaucacacuugccaccgguccccugacuacccucugggaagggagcccaggaaaauuuuggaauacaacuauagcugucuccauggccaacauuuucaggggcucuuaucuagccggugcuggccuggccuucucauugaugaaaagccuagggggaggccgccgggggaccggagcgcagggcgagacacucggugagaaauggaagagacagcuuaaucagcuguccaaaagugaauuuaacacguacaagcguucugggaucauggagguugacaggagcgaagccaaggagggauugaaacggggcgaaaccacuaagcaugcagugucacgcgguacagcuaaacugcgaugguucgucgagagaaaucucgugaagccugagggcaaaguaauugauuuaggguguggaaggggcgggugguccuauuacugcgccggacugaagaaggugaccgaaguuaaaggcuauacuaagggugggcccggacacgaggaaccgaucccaauggcaacauacggcuggaacauagugaaacuucacaguggccgggacgucuuuuucaccccucccgagaagugugauacgcugcuaugcgacaucggggaaagcucuccaaaucccaccauugaggagggacgcacacucagagugcugaaaauggucgaaccuugguugagggguaaccaauuuuguaucaagauucugaauccguacaugcccuccgugguugagacucucgaacagaugcagcgaaaacauggcgggaugcuuguacggaacccacugucacguaauagcacccacgagauguauugggugucgugcggaacaggcaacaucgucucugcugugaacaugacaaguagaauguuacugaaucgcuucaccauggcccauaggaagccuacauacgagcgggauguugacuugggugccgggaccagacacguggcggucgaacccgagauugcuaaccucgauaucauaggacagcgcauugaaaauaucaagaacgagcacaaauccacuuggcauuaugacgaagauaauccuuacaagacgugggcauaucacggcagcuacgaggugaaaccaucaggcuccgccucuagcaugguaaacggggugguuaggcugcuaacaaagcccugggacgucaucccuauggugacccaaauugcuaugacugacaccacaccauuuggacagcagcgaguguucaaagagaaggucgauacgcggacccccagaccgaagagggguacugcccaaauaauggaaguuacagcaaaauggcuuuggggcuuucugagucgcaauaagaaaccucguaucuguacccgggaggaguucacuagaaaggugagguccaacgccgcuauuggggcgguauuuguggacgagaaucaguggaacagcgccaaagaagcagucgaggaugagcgcuucugggaccucgugcaucgagaacgggagcugcacaagcagggaaagugcgcuacaugcguuuauaauaugaugggcaaaagagaaaagaaauugggugaguuugggaaggccaaaggaucuagggcaaucugguacauguggcugggcgcccgcuuccucgaguucgaggcucuuggcuuuaugaacgaggaucauugguucucaagagaaaauagucuguccgggguggagggagaagguuuacacaagcugggcuacauuuugcgggacaucagcaagauaccagggggaaacauguaugccgaugacaccgcgggcugggauacaaggaucacugaggacgaucuccagaaugaggcaaaaauuaccgacaucauggaacccgagcacgcccugcuagcuacgucuauuuuuaaacuuaccuaccaaaacaaagucgugcguguacagcgaccugccaagucggguacaguuauggaugugaucucacgcagagaccagcgggggagcggacaggucggcacuuauggccugaacaccuucacaaauauggaagugcaacucauaaggcagauggaguccgaagggauuuuuaguccaucugagcuggagaacagcaauuuggcagaacgcguguuagacuggcuggagaaacauggagucgaaagacucaagcggauggcuaucuccggugaugacuguguugugaaacccacugaugacagguucgccaccgcucuuacggcccugaacgauaugggcaagguacgaaaggacaucccgcagugggagccuucaaaaggguggaaugauuggcagcaagugcccuuuugcagucaccauuuccaccagcuaauuaugaaggacggacgugaaauagucgugccauguagaaaccaggaugagcugguuggccgcgcacgggugucucagggugcgggguggagccucagggagacagccugcuugggaaaauccuacgcucaaauguggcagcugauguauuuucacagacgcgaccuucggcuggccgcaaaugcuaucuguucagccgucccugugaacuggguacccaccagcaggacuacauggucuauucaugcacaccaucaguggaugaccacugaagauaugcucuccguuuggaaucgaguguggaucgaggaaaacccauggauggaggacaagacccacgucaguagcugggaagacgugcccuacuuaggcaaaagagaggaucaauggugcggcucgcugauuggguugacagcccgggcgacgugggcuaccaauauccagguugccauaaaccaggugaggcgccugaucggaaaugagaacuaucucgacuacaugacuuccaugaagcguuucaagaaugaaucugauccugagggugcacuuugguga

SEQ ID NO: 14202 - RNA, 9879 nt, Artificial Sequence
  derived and/or modified CDS sequence (opt3) from DENV-1__KM403597__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagaccguagaagcguggcccuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauauucaucuuacugaugcuugugacgccaucaauggccaugaggugcgucgggauuggaaaccgggauuuuguggaggguuugagcggcgcgacuuggguagacguugugcuggagcacgggaguugugucacaaccauggcaaaaaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagagcaggaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacguacuggacuagauuucaacgaaaugguccugcucacaaugaaggagaaaagcuggcuggugcauaagcagugguuucuugaccugccguugcccuggacgucuggcgcauccaccucacaagagacuuggaaucgccaggaucuccugguaacauucaaaaccgcucacgccaagaaacaggaaguuguggucuuagguagccaagagggggcuaugcacacagcccugacuggcgcaaccgaaauccagacgaguggaaccacaacuauuuuugccggccaucuaaagugcagacucaagauggacaaacugacccuuaagggggugucuuaugucauguguacaggauccuucaaauuggagaaggaaguggcugagacucagcacgguaccguucuggugcagguaaaauacgagggcacggaugcgccuugcaagauaccaaucagcacacaagacgaaaagggggucacccagaacggaaggcucauuacugcaaaucccaucgugacagauaaagagaagccuguuaacauagaaaccgagccacccuucggcgagucguauauugugaucggugccggggaaaaagcucugaagcuuucuugguuuaaaaagggcuccucaaucggaaagauguucgaggccacugcacggggcgcccgacgcauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagcagaucaacaagucucuccaugaccuguauugcggugggcauggugacacuguaccuuggggucaugguucaggcugacagcggaugcgugaucaacuggaaaggcagggaauugaagugugguucugggaucuuugugacuaacgagguacacaccuggacggaacaauauaaauuccaggccgauucaccgaagcggcugagugcagccauuggaaaggcuugggaggagggcgucugcgguauacgcagcgccacaagacucgaaaauaucauguggaaacagauuuccaacgagcugaaucauaucuuacuggaaaacgacaugaaguuuaccgugguugugggcgacgcaaaugggauucuuacucagggaaaaaagaugaucaggccucaacccauggagcacaaauacucuuggaagucguggggcaaagcuaagauaaucggggccgauacccagaacacaacuuucauuaucgacggaccagauaccccugaaugucccgacgaucagcgugcguggaauauuugggaggucgaggacuauggcuuugguguguucacaacgaacaucugguugaagcuccgggauagcuacacccagaugugcgaccaccgacugauguccgccgcuauaaaagauucaaaggcaguucaugccgacaugggguauuggauugaaagugagaaaaaugaaacuuggaagcuagcuagagccucuuuuaucgaggugaaaacauguauuuggccaaggagccacacccugugguccaacggaguacucgaaucagagaugaucauacccaagaucuacggcgguccuauuagccaacauaauuaucgcccaggcuacuucacucagacagcagggccguggcaccugggaaagcuugaguuggauuucaaccugugcgaaggcaccacggucgugguggacgagcacugcgggaaucggggacccucuuuaagaacuaccacagucaccggcaaaaucauucaugaaugguguugcagguccuguacucucccuccacugcgcuuucgaggugaggaugggugcugguacggaauggagauccggcccguuaaggaaaaagaggaaaaccuugugcguaguaugguaagcgcgggcucuggugagguggacuccuucucacugggcuugcucugugucaguauaaugauugaagaggugaugagaagcagguggucgcgcaagaugcugaugacagggacccuagccaucuuuuuccugcucaucaugggacagcugacauggaaugaccuuauucgguugugcaucaugguuggcgcuaacguguccgauagaauggggaugggaacuaccuaucuggccuuaauggcaacguuuaaaaugaggccuauguucgcugucggccuccuguuucgacgccuuacaucucgggaggugcugcuacucaccauuggucugagcuugguugccucaguggaacugccaaacaguuuagaggaacucggggacggacuggcaaugggcauaaugaugcuuaagcuguugacugauuuccaaucccaccagcucuggaccacacugcuaucucugacuuuuaucaagaccacgcuuagccucgacuacgccuggaaaacaauggcuaugguccuguccauuguaucauuguucccccuguguuuaagcaccacuagucagaagacaaccuggcucccggugcugcuuggcucuuuugggugcaaaccucugacuauguucuugaucacagagaauaagauuuggggaagaaaauccuggccacucaacgaagguaucauggcgguuggcauagugagcauccugcuaucgucacugcuuaagaaugaugucccccucgccgggccucugauugcaggaggcauguugaucgcuuguuaugugauuucugguaguuccgccgacuuaagccuggagagggccgcugagguaucuugggaagaggaagcagagcauagcggggccucccacaacauccucguggaaguccaggaugacggaaccaugaagauaaaagaugaggagcgugacgauacgcugacuauucuucugaaggcgaccuugcuagcuguuucaggcguguaccccaugaguaucccagccacacuguuugugugguauuucuggcaaaaaaagaaacagcgcagcggcguccucugggacaccccuucucccccagaaguggagcgggcaguucuggaugacgggaucuacagaauucuucagaggggauuacugggucgaucccagguaggcgugggggucuuccaagacggaguguuucauacaauguggcacguuacucggggcgccgugcucauguaucaggguaagcgcuuggaaccgucaugggcuagugucaaaaaggaucugauaagcuacgggggaggcuggagauuccagggcuccuggaauaccggggaggaggugcagguaaucgcagucgaaccuggaaagaaccccaaaaaugugcaaacgacaccagguacuuuuaagacccccgagggcgaaguuggggccauugcgcucgacuucaaaccuggaacaucuggcucgccaaucgugaacagggaggguaagauugucgggcuguacggaaauggcgugguuaccacuagcggcaccuaugugucagcuaucgcccaggcaaaagccucccaggaagggccccuuccugagauagaggaugaagucuuuaagaagcggaaccugacaaucauggacuugcacccgggaagugguaaaacgcgaagauaccuaccagcuauugugcgcgaggccaucaagaggaaacugcguacucucauuuuagcacccacccggguaguggcuucugaaauggccgaggcgcugaagggcaugccuaucagauaucaaacaaccgccguuaaaagcgaacauacugggaaggagauagucgaucuuauuugccacgcaacauucaccaugaggcugcucuccccagugcgcgugcccaauuacaacaugaucaucauggacgaggcucauuuuacggauccugccucaauugcugcacgaggauauaucucuacuagagucggcaugggugaagccgccgcuauauucaugacagcgaccccgcccgggagcguagaggcauuuccacagaguaaugccgugauucaggacgaagagcgggauaucccugaaagguccuggaacagcggauacgacuggauuaccgauuuccccggcaagacuguuugguuugugccaucuaucaaaucaggcaaugacauagcuaacuguuugcgcaagaacgggaaacgugucauucagcuguccagaaagacauucgacaccgaguaucaaaaaacaaagaauaacgauugggacuacgugguuacuacggauaucagugagaugggagccaauuuccgggcagacagggugaucgauccucgccgaugccucaagcccgucauucugaaagacgguccagaaagagugauccuugccggcccgaugccuguaaccgcugcgagcgccgcacagcggagggggcgcauuggaagaaaccagaauaaggagggcgaucaguacauauauaugggucaaccccuaaacaaugacgaagaucacgcucauuggacagaggccaaaaugcuguuggacaacaucaauacuccagaggggauuauccccgcauuauuugaaccugagagggaaaagucggccgcuaucgauggcgaguaccggcugcguggagaagcccgcaaaaccuucguggagcucaugcgaagaggcgaccugccaguuuggcuuucuuauaaggucgcguccgagggguuucaguacagcgauaggcgguggugcuucgacggagaacgcaacaaucaggugcuggaggaaaacauggacguggagauuuggacaaaggaaggugagagaaaaaagcucaggccccggugguuggaugcacgaaccuauucagacccucuggcccuaagagaguuuaaagaauucgcugccggccgcaggagugucucuggggaucugauacucgagaucggaaagcuuccgcagcaccugacuuuacgggcucaaaaugcauuggacaaccugguuaugcuccacaauuccgaacagggcgguaaagccuaccgucaugcuauggaggaacugccagauacgauugagacccuuaugcugcucgccuugaucgcagugcugacagggggcguaacuuuauuuuuccuaagcggaaagggccuggggaaaaccucaauuggacuccuuugugugauggcgaguagcguccuguuguggauggccuccguggagccccacuggaucgcugccucuauaauccuggaauuuuuccucaugguucugcuuauuccugagcccgacagacagaggacaccacaggauaaccaacucgcauauguggucaucggucuguuguuuaugauucugaccguagcugccaacgaaaugggcuuacuagagacuacaaagaaggaccuggggaucggacaugugguugcagagaaucaccaccaugccacgaugcucgauauagaccuucacccugcuagcgcguggacccuguacgccguggcaacuacaauuaucacccccaugaugcgccauaccauugaaaacacaacugcuaauaucuccuugacggccauagccaaccaggcagcuauccugaugggccucgauaaagguuggccaauuucaaagauggacaucggggucccucugcuugccuuaggcugcuacucucaggugaauccgcugacccucacagcggcugucuugaugcugguggcccacuaugcaauuaucggacccggccuacaagccaaagcuacucgggaggcacagaagcgaaccgccgcggggauaaugaaaaacccaacaguugauggaauuguggcuaucgaccuggacccuguaguguacgaugccaaguucgaaaagcagcucggccagaucaugcuucugauuuuguguaccagucaaauccugcucaugagaacuacgugggcacugugcgagucgauaacauuagccaccgguccccuuacuacccugugggaagggagcccaggaaaauuuuggaauacaacuauugcugucuccauggccaacaucuucaggggcucuuaucucgcaggugcuggccuagccuucucacugaugaagagcuuggggggaggccgccgggggaccggagcgcagggcgagacacugggugagaaauggaagagacagcucaaucagcuuuccaaaagugaauuuaacacguacaagcguucugggauuauggagguugacaggagcgaagccaaggagggacugaaacggggcgaaaccacuaagcaugcagugucacgcgguacagcuaaauugcgaugguucgucgagagaaaucuggugaagccugagggcaaaguaaucgaucucggguguggaaggggcgggugguccuauuacugcgccggauuaaagaaggugaccgaaguuaaaggcuauacuaagggugggcccggacacgaggaaccgauaccaauggcaacauacggcuggaacaucgugaaacugcacaguggccgggacgucuuuuucaccccucccgagaagugugauacgcuucugugcgacauuggggaaagcucuccaaaucccaccaucgaggagggacgcacacuaagagugcucaaaauggucgaaccuuggcugagggguaaccaauuuuguauuaagaucuugaauccguacaugcccuccgugguugagacucuggaacagaugcagcgaaaacauggcgggaugcucguacggaacccacuuucacguaauagcacccacgagauguauugggugucgugcggaacaggcaacauugucucugcugugaacaugacuaguagaaugcuguuaaaucgcuucaccauggcccauaggaagccuacauacgagcgggauguugaccugggugccgggaccagacacguggcggucgaacccgagaucgcuaacuuggauauaauuggacagcgcaucgaaaauaucaagaacgagcacaaauccacuuggcauuaugacgaagauaauccuuacaagacgugggcauaucacggcagcuacgaggugaaaccaucaggcuccgccucuagcaugguaaacggggugguuaggcuccugacaaagcccugggacgucauuccuauggugacccaaauagcuaugacugacaccacaccauuuggacagcagcgaguguucaaagagaaggucgauacgcggacccccagaccgaagagggguacugcccaaaucauggaaguuacagcaaaauggcuauggggcuuucuuagucgcaauaagaaaccucguauuuguacccgggaggaauucacuagaaaggugagguccaacgccgcuaucggggcgguauuuguggacgagaaucaguggaacagcgccaaagaagcagucgaggaugagcgcuucugggaccuggugcaucgagaacgggagcuccacaagcagggaaagugcgcuacaugcguuuauaauaugaugggcaaaagagaaaagaaacugggugaguuugggaaggccaaaggaucuagggcaauuugguacaugugguugggcgcccgcuuccuggaauucgaggcucucggcuuuaugaacgaggaucauugguucucaagagaaaauagucuuuccgggguggagggagaaggucugcacaaguuaggcuacauccugcgggacauaagcaagaucccagggggaaacauguaugccgaugacaccgcgggcugggauacaaggauuacugaggacgauuugcagaaugaggcaaaaaucaccgacauuauggaacccgagcacgcccuccuggcuacgucuaucuuuaagcuaaccuaccaaaacaaagucgugcguguacagcgaccugccaagucggguacaguuauggaugugauaucacgcagagaccagcgggggagcggacaggucggcacuuauggccuuaacaccuucacaaauauggaagugcaacugauuaggcagauggaguccgaagggaucuuuaguccaucugagcucgagaacagcaaucuggcagaacgcguguuggacugguuagagaaacauggagucgaaagacugaagcggauggcuaucuccggugaugacuguguugugaaacccacugaugacagguucgccaccgcucucacggcccuuaacgauaugggcaagguacgaaaggacauuccgcagugggagccuucaaaaggguggaaugauuggcagcaagugcccuuuugcagucaccauuuccaccagcugauaaugaaggacggacgugaaaucgucgugccauguagaaaccaggaugagcuaguuggccgcgcacgggugucucagggugcgggguggagccugagggagacagccugccucggaaaauccuacgcucaaauguggcaguugauguauuuucacagacgcgaccugcggcuugccgcaaaugcuauuuguucagccgucccugugaacuggguacccaccagcaggacuacauggucuauccaugcacaccaucaguggaugaccacugaagauaugcuguccguuuggaaucgaguguggauugaggaaaacccauggauggaggacaagacccacgucaguagcugggaagacgugcccuaccucggcaaaagagaggaucaauggugcggcucguuaaucgggcugacagcccgggcgacgugggcuaccaauauacagguugccaucaaccaggugaggcgcuugauuggaaaugagaacuaucuggacuacaugacuuccaugaagcguuucaagaaugaaucugauccugagggugcacucugguga

SEQ ID NO: 14203 - RNA, 9879 nt, Artificial Sequence
  derived and/or modified CDS sequence (opt3) from DENV-1__KM403610__SS-prME
uccgugaccaugcugcucaugcuucugcccacagcauuggcuuuccacuuaacuacgagaggaggggaaccucauaugaucgucuccaagcaggaaagaggaaaaucucuguuguuuaagaccucagccgguguuaauaugugcacacucauugccauggaccugggagaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaagaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaauccacaccggagaucagcaucaaguugguaaugagacuacggaacacggcacaauugccaccaucacuccccaggcgccuaccucagagauccagcuuacagacuacggggcccugaccuuggacuguaguccaaggacuggacuagauuucaacgaaauggugcugcucacaaugaaggagaaaagcuggcugguccauaagcagugguuucuugaccugccguugcccuggacgucuggcgcauccaccucacaagagacuuggaaucggcaggaucuccuggugacauucaaaaccgcucacgccaagaagcaggaaguaguuguguuagguagccaagagggggcuaugcacacagcccugacuggcgcaaccgaaauucagacgaguggaaccacaacuauauuugccggccaucuaaaaugccgucucaagauggacaaacugacccuuaagggggucucuuaugugauguguacaggauccuucaaauuggagaaggaagucgcugagacucagcacgguaccgugcugguucaggugaaguacgagggcacggaugcgccuugcaaaaucccaauuagcacacaagacgaaaaggggguaacccagaacggacgccucaucacugcaaaucccauagucacagauaaagagaagccugugaacauugaaaccgagccacccuucggcgagucguauaucguuaucggugccggggaaaaagcucugaaacuuucuugguuuaagaaaggcuccucaauuggaaagauguucgaggccacugcaagaggcgccaggcggauggcuauccugggggacaccgccugggauuuuggaaguauugguggcguguucacaagcgucgggaaauuggugcaucagguauuuggaacggcauacggcguacucuucuccgguguuucuuggaccaugaagauagggaucggcauucuguuaacuuggcugggacuaaauagccgaucaacaagucucuccaugaccuguaucgcggucggcauggugacacuguaccuuggggugaugguccaggcugacagcggaugcguuaucaacuggaaaggccgcgaauugaagugugguucugggauuuuugugacuaacgaggugcacaccuggacggaacaauauaaguuccaggccgauucaccgaaaagacugagugcagccauaggaaaggcuugggaggagggcguaugcgguaucaggagcgccacacggcucgaaaauauuauguggaaacagaucuccucugagcugaaccauauuuuacuggaaaaugacaugaaguuuaccgucgugguuggcgacgcaaacgggauccuuacucagggcaagaagaugauacgcccucaacccauggagcacaaauacucguggaaaagcuggggcaaggcuaagaucauuggggccgauacccagaauacaacuuucaucauugacggaccagauaccccugaaugucccgacgaucagagagcguggaacaucugggagguggaggacuauggcuuuggugucuucacaacgaauauaugguugaagcucagggauuccuacacccagaugugcgaccaccgucugaugucagccgcuauuaaagauaguaaggcagugcaugccgacaugggguauuggaucgaaucugagaaaaacgaaacuuggaagcuagcucgggccagcuuuauugagguuaagacauguaucuggccacgaucccacacccuguggucaaauggagugcucgaaagcgagaugauaauccccaaaauuuacggcgguccuaucucucaacauaacuauagaccaggcuacuucacucagacagcagggccguggcaccugggaaaacuugaguuggauuucaaucugugcgaaggcaccacgguagucguggacgagcacugcgggaacaggggacccuccuuacgcacuaccacagugaccggcaaaauuauccaugaaugguguugccggaguuguacucucccuccacugagauuuaggggugaggaugggugcugguacggaauggagauacgccccgucaaggaaaaagaggaaaaucuuguucgaagcauggugucugcgggcuccggugagguagacucauucagucugggcuugcucugugugagcauuaugaucgaagaggucaugcggucgcguugguccaagaagaugcugaugacagggacccuagccguguuuuuccugcucaucaugggacagcugacauggaacgaccuuauuagauugugcaucaugguuggcgcuaaugugucugauaggauggggaugggaacuaccuaucuggccuuaauggcaacguuuaaaaugcgcccuauguucgcugucggccuccuguuucggagacuuacaagcagggaggugcugcuacucaccauuggucugucauugguugccaguguggaacugccaaacuccuuagaggaacucggggacggacuggcaaugggcauaaugaugcuuaagcuguugacugauuuccaaucucaccagcucuggaccacacugcuaagccugacuuuuaucaaaaccacgcuuucccucgacuacgccuggaagacaauggcuaugguccugucaauugugagcuuguucccccuguguuuaaguaccacuucucagaaaacaaccuggcucccggugcugcuuggcuccuuugggugcaagccucugacuauguucuugaucacagagaacaagauuuggggacgaaaaagcuggccacucaaugaagguaucauggcgguuggcauagugucgauccugcuaucaucucugcuuaagaacgaugucccccucgccgggccucugauugcaggaggcauguugaucgcuuguuaugugauuagugguuccagcgccgacuuaucucuggagcgcgccgcugagguaagcugggaagaggaagcagagcauuccggggccucacacaauauccucguggaaguccaggaugacggaaccaugaaaauaaaggaugaggagcgggacgauacgcugacuauucuucugaaagcgaccuugcuagcuguuaguggcguguaccccaugagcaucccagccacacuguuugugugguauuucuggcaaaagaaaaagcagagaucuggcguccucugggacaccccuucacccccagaaguggagagggcaguucuggaugacgggaucuaccguauucuucagcgcggauuacugggucggagccagguaggcgugggggucuuccaagacggaguguuucauacaauguggcacguuacuagaggcgccgugcucauguaucaggguaagagguuggaaccgaguugggcuagcgucaaaaaggaucugauauccuacgggggaggcuggcgauuccagggcucuuggaacaccggggaggaggugcagguaaucgcagucgaaccuggcaagaaucccaagaacgugcaaacgacaccagguacuuuuaaaacccccgagggcgaaguuggggccauugcgcucgacuucaagccuggaacaucgggcagcccaaucgugaaucgggaggguaagauugucgggcuguacggaaacggcgugguuaccacuucaggcaccuauguguccgcuaucgcccaggcaaaagccagucaggaagggccccuuccugagauagaggaugaagucuuuaagaaacgcaaucugacaaucauggacuugcacccgggaucugguaagacgagaagguaccuaccagcuauugugcgggaggccaucaaacgaaagcugagaacucucauuuuagcacccacccgcguaguggcuagcgaaauggccgaggcgcugaagggcaugccuaucagguaucaaacaaccgccguuaaauccgaacauacugggaaggagauagucgaucuuaugugccacgcaacauucaccaugcgucugcucucaccagugcgggugcccaacuacaauaugauuaucauggacgaggcucauuuuacggauccugccucuaucgcugcaagaggauauauuagcacuagggucggcaugggugaagccgccgcuaucuucaugacagcgaccccgcccgggaguguagaggcauuuccacaguccaacgccgugauacaggacgaagaacgcgauauuccugaacgaagcuggaacucuggauacgacuggaucaccgauuuccccggcaaaacuguuugguuugugccaucaauuaaguccggcaacgacaucgcuaauuguuugaggaaaaaugggaagcgggucauacagcugaguaggaagacauucgacaccgaguaucagaaaacaaagaacaaugauugggacuacgugguuacuacggauauuagcgagaugggagccaacuuccgcgcagaccgugugaucgauccuagacggugccucaaacccgucauccugaaggacgguccagaaagggugauucuugccggcccgaugccuguaaccgcugcgucggccgcacagcgccgagggagaaucggacggaaucagaacaaagagggcgaucaguacauuuauaugggucaaccccuaaauaacgacgaagaucacgcucauuggacagaggccaagaugcuguuggacaauauaaacacuccagaggggaucauucccgcauuauuugaaccugagagggaaaagucugccgcuaucgauggcgaguaccgccugagaggagaagccaggaaaaccuucguggagcucaugcggcguggcgaccugccaguuuggcuuuccuauaaggucgcgagcgagggguuucaguacucagaucgccgauggugcuucgacggagaaagaaauaaccaggugcuggaggaaaauauggacguggagaucuggacaaaagaaggugagaggaagaaacuccggccccgcugguuggaugcaagaaccuauagugacccucuggcccuaagggaguuuaaggaguucgcugccggccggcgaucugucuccggggaucugauucucgagauaggaaaacuuccgcagcaccugacuuuaagagcucaaaacgcauuggacaaucugguuaugcuccacaacagcgaacagggcgguaaggccuaccgccaugcuauggaggaacugccagauacgaucgagacccuuaugcugcucgccuugauugcagugcugacagggggcguaacuuuauuuuuccuaucaggaaagggccuggggaaaaccaguaucggacuccuuugugugauggcgagcuccguccuguuguggauggccucuguggagccccacuggauugcugccagcaucauacuggaauuuuuccucaugguucugcuuaucccugagcccgacaggcagcggacaccacaggauaaucaacucgcauauguggucauuggucuguuguuuaugauccugaccguagcugccaacgaaaugggcuuacuagagacuacaaagaaagaccuggggauuggacaugugguugcagagaaccaccaccaugccacgaugcucgauaucgaccuucacccugcuuccgcguggacccuguacgccguggcaacuacaauaauuacccccaugaugcgucauaccaucgaaaauacaacugcuaacauuucauugacggccaucgccaaucaggcagcuauacugaugggccucgauaaggguuggccaaucucuaaaauggacauuggggucccucugcuugccuuaggcugcuacagucaggugaacccgcugacccucacagcggcugucuugaugcugguggcccacuaugcaaucauuggacccggccuacaagccaaggcuacuagagaggcacagaagaggaccgccgcggggaucaugaaaaauccaacaguugauggaauaguggcuauugaccuggacccuguaguguacgaugccaaguucgaaaaacagcucggccagaucaugcuucugaucuuguguaccucgcaaauucugcucaugcgcacuacgugggcacugugcgagagcaucacauuagccaccgguccccuuacuacccugugggaaggguccccaggaaaguuuuggaacacaacuauagcugucucuauggccaauauuuuccggggcucauaucucgcaggagcuggccuagccuucagccugaugaaaucccuaggggguggccgaagagggaccggagcgcagggcgagacacugggugagaaguggaagaggcagcucaaccagcuuaguaaaucugaauuuaauacguacaagcgcagcgggaucauggagguugaccggucagaagccaaagagggacugaagagaggcgaaaccacuaaacaugcagugucccgugguacagcuaaguugaggugguucgucgagcggaaccuggugaagccugagggcaaaguaauugaucucggguguggacgcggcggguggaguuauuacugcgccggauuaaagaaagugaccgaaguuaagggcuauacuaaaggugggcccggacacgaggaaccgaucccaauggcaacauacggcuggaauauagugaagcugcacagcggccgagacgucuuuuucaccccucccgagaaaugugauacgcuucugugcgacaucggggaaucuuccccaaaccccaccauugaggagggaagaacacuaagggugcucaagauggucgaaccuuggcugcgggguaaucaauuuuguaucaagauuuugaacccguacaugcccucagugguugagacucuggaacagaugcagcgcaaacauggcgggaugcucguaagaaauccacuuagcaggaacucgacccacgagauguauugggugucuugcggaacaggcaauaucgucagugcugugaacaugacuucccgaaugcuguuaaaccgguucaccauggcccaucguaagccuacauacgagagagauguugaccugggugccgggacccgccacguggcggucgaacccgagauugcuaauuuggauaucauaggacagaggauugaaaacaucaaaaaugagcacaagagcacuuggcauuaugacgaagauaacccuuacaaaacgugggcauaucacggcucauacgaggugaagccauccggcucugccagcaguaugguaaauggggugguucggcuccugacaaagcccugggacgucaucccuauggugacccaaauugcuaugacugacaccacaccauuuggacagcagagaguguucaaagagaaggucgauacgcgcacccccaggccgaaacgagguacugcccaaauaauggaaguuacagcaaaguggcuauggggcuuucuuucccggaacaaaaagccuagaaucuguaccagggaggaguucacucgcaaggugcguagcaaugccgcuauuggggcgguauuuguggacgagaaccaguggaacucugccaaagaagcagucgaggaugagcgguucugggaccuggugcauagagaaagggagcuccacaagcagggaaaaugcgcuacaugcguuuauaacaugaugggcaagcgcgagaaaaagcugggugaguuugggaaggccaaaggaucacgagcaaucugguacaugugguugggcgcccgguuccuggaguucgaggcucucggcuuuaugaaugaggaucauugguucaguagagaaaacucccuuagcgggguggagggagaaggucugcacaaguuaggcuacauucugagggacaucucuaaaauaccagggggaaauauguaugccgaugacaccgcgggcugggauacacgcaucacugaggacgauuugcagaacgaggcaaagauuaccgacaucauggaacccgagcacgcccuccuggcuacgucgauuuuuaaacuaaccuaccaaaauaaggucgugagaguacagcggccugccaaaucagguacaguuauggaugugaucagcaggcgugaccagcgaggguccggacaggucggcacuuauggccuuaacaccuucacaaacauggaagugcaacugauacgccagauggagagugaagggauuuuucucccaucugagcuggagaauagcaacuuggcagaaagaguguuagacuggcuggagaagcauggagucgaacggcucaagaggauggcuaucuccggugaugacuguguugugaaacccacugaugaccgcuucgccaccgcucuuacggcccugaaugauaugggcaagguaagaaaagacaucccgcagugggagccuucaaagggguggaacgauuggcagcaagugcccuuuugcagucaccauuuccaccagcuaauuaugaaagacggacgggaaauagucgugccauguaggaaucaggaugagcugguuggccgagcacgugugucucagggugcgggguggagccucagagagacagccugcuugggaaaguccuacgcucaaauguggcagcugauguauuuucaccgccgggaccuuaggcuggccgcaaacgcuaucuguucagccgucccugugaauuggguacccaccagcagaacuacauggucuauucaugcacaccaucaguggaugaccacugaagauaugcucuccguuuggaaccgcguguggaucgaggaaaauccauggauggaggacaagacccacgucaguagcugggaagacgugcccuacuuaggcaaacgggaggaucaauggugcggcucgcugauuggguugacagccagggcgacgugggcuaccaacauccagguugccauaaaucaggugcgaagacugaucggaaacgagaauuaucucgacuacaugacuuccaugaagcgguucaaaaacgaaucugauccugagggugcacuuugguga

SEQ ID NO: 14204 - RNA, 9879 nt, Artificial Sequence
  derived and/or modified CDS sequence (opt3) from DENV-1__KM403596__SS-prME
agcgugaccaugcugcucaugcuucugcccacagcauuggcuuuccacuuaacuacgagaggcggggaaccucauaugaucgucuccaagcaagaaagaggaaaaucucuguuguuuaagaccucagccgguguuaacaugugcacacucauugcaauggaccugggcgagcuuugugaagauacuaugaccuacaaaugcccacggauuacagaggcggaaccggacgauguggacuguuggugcaaugcuaccgauacuuggguaacauaugggaccuguagucaaacgggagagcaccgccgagaccguagaagcguggcccuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauauucaucuuacugaugcuugugacgccaucaauggccaugaggugcgucgggauuggaaaccgggauuuuguggaggguuugagcggcgcgacuuggguagacguugugcuggagcacgggaguugugucacaaccauggccaagaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagaacaagaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaguuuggacuguagcccacguaccggacuagauuucaacgaaaugguccugcucacuaugaaggagaaaucuuggcuggugcauaagcagugguuucuugaccugccguugcccuggacauccggcgcaucaacgagccaagagaccuggaaucgccaggaucuccugguaacuuucaaaacagcucacgccaagaaacaggaaguuguggucuuagguagucaagagggggcuaugcacaccgcccugacaggcgcaacugaaauccagaccucuggaacgaccacaauuuuugccggccaucuaaagugcagacucaagauggacaaacugacucuuaaggggguguccuaugucauguguaccgguagcuucaaauuggagaaggaaguggcugagacacagcacgguacuguucuggugcagguaaaauacgagggcaccgaugcgccuugcaagauaccaaucucgacgcaagacgaaaagggggucacacagaacggaaggcucauuaccgcaaaucccaucgugacugauaaagagaagccuguuaacauagaaauugagccacccuucggcgagucuuauaucgugaucggugccggggaaaaagcucugaaacuuuccugguuuaaaaagggcucaaguauuggaaagauguucgaggccacagcacggggcgcccgacgcauggcuauccugggggacaccgccugggauuuuggaagcauugguggcgucuucacuuccguggggaaauugguacaucagguguuuggaaccgcauacggcguucucuucucuggugucagcuggacaaugaagauagggaucggcauucuguuaacguggcugggacuaaauucaagaaguaccucccucagcaugacuuguaucgcggugggcauggugacacuguaccuuggggucaugguucaggcugacucuggaugcgugaucaacuggaaaggcagggaauugaagugugguucagggauuuuugugaccaacgagguacacacauggacugaacaauauaaauuccaggccgauaguccgaagcggcugagcgcagccauaggaaaggcuugggaggagggcgucugcgguauccgcuccgccaccagacucgaaaauauuauguggaaacagaucucuaacgagcugaaucauauuuuacuggaaaacgacaugaaguuuacggugguugugggcgacgcaaaugggauccuuacacagggcaagaagaugauaaggccucaacccauggagcacaaauacucguggaaaagcuggggcaaggcuaagaucauuggggccgauacccagaacacuaccuucaucauugacggaccagauacaccugaaugucccgacgaucagcgugcguggaauaucugggaggucgaggacuauggcuuugguguguucacuaccaacauaugguugaagcuccgggauuccuacacacagaugugcgaccaccgacugaugucagccgcuauuaaagauaguaaggcaguucaugccgacaugggguauuggaucgaaucugagaaaaaugaaacguggaagcuagcuagagccagcuuuauugaggugaaaaccuguaucuggccaaggucccacacucuguggucaaacggaguacucgaaagcgagaugauaauccccaagauuuacggcgguccuaucucucaacauaauuaucgcccaggcuacuucacacagaccgcagggccguggcaccugggaaaacuugaguuggauuucaaccugugcgaaggcacuacagucgugguggacgagcacugcgggaaucggggacccuccuuaagaaccacgacugucaccggcaaaauuauccaugaaugguguugcaggaguuguacacucccuccacugcgcuuucgaggugaggaugggugcugguacggaauggagauacggcccguuaaggaaaaagaggaaaaccuugugcguagcaugguaucugcgggcuccggugagguggacucauucagucugggcuugcucugugucagcauuaugaucgaagaggugaugagaucgagguggucccgcaagaugcugaugaccgggacucuagccaucuuuuuccugcucauuaugggacagcugacauggaaugaccuuauccgguugugcauuaugguuggcgcuaacgugucugauagaauggggaugggaaccacauaucuggccuuaauggcaacuuuuaaaaugaggccuauguucgcugucggccuccuguuucgacgccuuaccagccgggaggugcugcuacucacgauaggucugucauugguugccaguguggaacugccaaacuccuuagaggaacucggggacggacuggcaaugggcaucaugaugcuuaagcuguugacagauuuccaaucucaccagcucuggaccacucugcuaagccugaccuuuauuaagacaacucuuucccucgacuacgccuggaaaaccauggcuaugguccugucaaucguauccuuguucccccuguguuuaaguacgacaucucagaagaccacuuggcucccggugcugcuuggcuccuuugggugcaaaccucugacaauguucuugauuaccgagaauaagaucuggggaagaaaaagcuggccacucaacgaagguauaauggcgguuggcaucgugucgauucugcuaucaucucugcuuaagaaugaugucccccucgccgggccucugaucgcaggaggcauguugauugcuuguuaugugaucagugguuccagcgccgacuuaucucuggagagggccgcugagguaagcugggaagaggaagcagagcauuccggggccucacacaacauacucguggaaguccaggaugacggaacuaugaagauuaaagaugaggagcgugacgauacacugaccauccuucugaaggcgacguugcuagcuguuaguggcguguaccccaugagcaucccagccacucuguuugugugguauuucuggcagaagaagaaacagcgcucuggcguccucugggacaccccuucacccccagaaguggagcgggcaguucuggaugacgggauuuacagaauacuucagaggggauuacugggucgaagccagguaggcgugggggucuuccaagacggaguguuucauacaauguggcacguuacccggggcgccgugcucauguaucaggguaagcgcuuggaaccgaguugggcuagcgucaaaaaggaucugaucuccuacgggggaggcuggagauuccagggcucuuggaauacaggggaggaggugcagguaauugcagucgaaccuggaaagaaccccaaaaaugugcaaacuaccccagguacguuuaagacacccgagggcgaaguuggggccaucgcgcucgacuucaaaccuggaacuucgggcagcccaauugugaacagggaggguaagaucgucgggcuguacggaaauggcgugguuaccacaucaggcaccuauguguccgcuauagcccaggcaaaagccagucaggaagggccccuuccugagaucgaggaugaagucuuuaagaagcggaaccugacuauuauggacuugcacccgggaucugguaaaacccgaagauaccuaccagcuaucgugcgcgaggccauuaagaggaaacugcguacacucaucuuagcacccacgcggguaguggcuagcgaaauggccgaggcgcugaagggcaugccuauaagauaucaaacuaccgccguuaaauccgaacauacagggaaggagauugucgaucuuaugugccacgcaaccuucacuaugaggcugcucucaccagugcgcgugcccaauuacaacaugaucaucauggacgaggcucauuuuacagauccugccucuauugcugcacgaggauauaucagcaccagagucggcaugggugaagccgccgcuauauucaugacggcgacuccgcccgggaguguagaggcauuuccacaguccaaugccgugauucaggacgaagaacgggauaucccugaaaggagcuggaacucuggauacgacuggauuacagauuuccccggcaagaccguuugguuugugccaucaaucaaauccggcaaugacauagcuaacuguuugcgcaagaacgggaaacgugucauucagcugaguagaaagaccuucgacacugaguaucagaaaacaaagaauaacgauugggacuacgugguuaccacagauaucagcgagaugggagccaauuuccgggcagacagggugaucgauccucgccgaugccucaagcccgucauucugaaagacgguccagaaagagugauccuugccggcccgaugccuguaacugcugcgucggccgcacagcggagggggcgcauuggaagaaaccagaauaaggagggcgaucaguacauauauaugggucaaccccuaaacaaugacgaagaucacgcucauuggacggaggccaaaaugcuguuggacaacaucaauaccccagaggggauuauccccgcauuauuugaaccugagagggaaaagucugccgcuaucgauggcgaguaccggcugcguggagaagcccgcaaaacauucguggagcucaugcgaagaggcgaccugccaguuuggcuuuccuauaaggucgcgagcgagggguuucaguacucagauaggcgguggugcuucgacggagaacgcaacaaucaggugcuggaggaaaacauggacguggagauuuggacuaaggaaggugagaggaaaaagcucaggccccggugguuggaugcacgaaccuauagugacccucuggcccuaagagaguuuaaagaguucgcugccggccgcaggucugucuccggggaucugauacucgagaucggaaaacuuccgcagcaccugacauuacgggcucaaaaugcauuggacaaccugguuaugcuccacaauagcgaacagggcgguaaagccuaccgucaugcuauggaggaacugccagauaccauugagacucuuaugcugcucgccuugaucgcagugcugaccgggggaguaacguuauuuuuccuaucaggaaagggccuggggaaaacaaguauuggacuccuuugugugauggcgagcuccguccuguuguggauggccucuguggagccccacuggaucgcugccagcauaauccuggaauuuuuccucaugguucugcuuauuccugagcccgacagacagaggacuccacaggauaaccaacucgcauauguggucaucggucuguuguuuaugauucugaccguagcugccaacgaaaugggcuuacuagagacaaccaagaaggaccuggggaucggacaugugguugcagagaaucaccaccaugccacuaugcucgauauagaccuucacccugcuuccgcguggacacuguacgccguggcaacgaccauuaucacucccaugaugcgccauacaauugaaaacaccaccgcuaauaucucauugacagccauagccaaccaggcagcuauccugaugggccucgauaaagguuggccaauuucuaagauggacaucggggucccucugcuugccuuaggcugcuacagucaggugaauccgcugacucucacggcggcugucuugaugcugguggcccacuaugcaauuaucggacccggccuacaagccaaagcuacccgggaggcacagaagcgaacagccgcggggauaaugaaaaacccaacuguugauggaauuguggcuaucgaccuggacccuguaguguacgaugccaaguucgaaaagcagcucggccagaucaugcuucugauuuuguguaccucgcaaauccugcucaugagaacaaccugggcacugugcgagagcauaacuuuagccacggguccccuuacaacccugugggaaggguccccaggaaaauuuuggaauacuaccauugcugucucuauggccaacaucuucaggggcucauaucucgcaggagcuggccuagccuucagccugaugaagucccuagggggaggccgccgggggacaggagcgcagggcgagacucugggugagaaauggaagagacagcucaaucagcuuaguaaaucugaauuuaacaccuacaagcguagcgggauuauggagguugacaggucagaagccaaggagggacugaaacggggcgaaacaacgaagcaugcagugucccgcgguaccgcuaaauugcgaugguucgucgagagaaaucuggugaagccugagggcaaaguaaucgaucucggguguggaaggggcggguggaguuauuacugcgccggauuaaagaaggugacugaaguuaaaggcuauacaaagggugggcccggacacgaggaaccgauaccaauggcaaccuacggcuggaacaucgugaaacugcacagcggccgggacgucuuuuucacuccucccgagaagugugauacacuucugugcgacauuggggaaucuuccccaaaucccaccaucgaggagggacgcacgcuaagagugcucaaaauggucgaaccuuggcugagggguaaccaauuuuguauuaagaucuugaauccguacaugcccucagugguugagacccuggaacagaugcagcgaaaacauggcgggaugcucguacggaacccacuuagccguaauucgacacacgagauguauugggugucuugcggaacuggcaacauugucagugcugugaacaugaccuccagaaugcuguuaaaucgcuucacaauggcccauaggaagccuacuuacgagcgggauguugaccugggugccgggaccagacacguggcggucgaacccgagacagcuaacuuggauaucauaggacagcgcauugaaaauaucaagaacgagcacaaaagcaccuggcauuaugacgaagauaauccuuacaagacuugggcauaucacggcucauacgaggugaaaccauccggcucugccagcaguaugguaaacggggugguuaggcuccugacgaagcccugggacgucaucccuauggugacacaaauugcuaugaccgacacuaccccauuuggacagcagcgaguguucaaagagaaggucgauacacggacgcccagaccgaagagggguaccgcccaaauaauggaaguuacugcaaaauggcuauggggcuuucuuucccgcaauaagaaaccucguaucuguacacgggaggaguucaccagaaaggugaggagcaacgccgcuauuggggcgguauuuguggacgagaaucaguggaacucugccaaagaagcagucgaggaugagcgcuucugggaccuggugcaucgagaacgggagcuccacaagcagggaaagugcgcuacuugcguuuauaauaugaugggcaaaagagaaaagaaacugggugaguuugggaaggccaaaggaucaagggcaaucugguacaugugguugggcgcccgcuuccuggaguucgaggcucucggcuuuaugaacgaggaucauugguucaguagagaaaauucccuuagcgggguggagggagaaggucugcacaaguuaggcuacauucugcgggacaucucuaagauaccagggggaaacauguaugccgaugacacagcgggcugggauaccaggaucacagaggacgauuugcagaaugaggcaaaaauuacugacaucauggaacccgagcacgcccuccuggcuaccucgauuuuuaagcuaacguaccaaaacaaagucgugcguguacagcgaccugccaagucagguaccguuauggaugugaucagccgcagagaccagcggggguccggacaggucggcacauauggccuuaacacuuucaccaauauggaagugcaacugauaaggcagauggagagugaagggauauuuucuccaagcgagcucgagaacuccaaucuggcagaacgcguguuggacugguuagagaaacauggagucgaaagacugaagcggauggcuaucucaggugaugacuguguugugaaacccacagaugacagguucgccacugcucucaccgcccuuaacgauaugggcaagguacgaaaggacaucccgcagugggagccuaguaaaggguggaaugauuggcagcaagugcccuuuugcucucaccauuuccaccagcugauuaugaaggacggacgugaaauagucgugccauguagaaaccaggaugagcuaguuggccgcgcacgggugagccagggugcgggguggucccugagggagacggccugccucggaaaaucauacgcucaaauguggcaguugauguauuuucacagacgcgaccugcggcuugccgcaaaugcuaucuguagcgccgucccugugaacuggguacccacaucuaggaccacuugguccauucaugcacaccaucaguggaugacaaccgaagauaugcugaguguuuggaaucgaguguggaucgaggaaaacccauggauggaggacaagacucacgucagcucgugggaagacgugcccuaccucggcaaaagagaggaucaauggugcggcuccuuaauugggcugaccgcccgggcgacaugggcuacgaauauccagguugccauaaaccaggugaggcgcuugaucggaaaugagaacuaucuggacuacaugaccucuaugaagcguuucaagaaugaaucagauccugagggugcacucugguga

SEQ ID NO: 14205 - RNA, 9879 nt, Artificial Sequence
  derived and/or modified CDS sequence (opt3) from DENV-1__KM403616__SS-prME
agcgugaccaugcugcucaugcuucugcccaccgccuuggcuuuccacuuaacuacgagaggaggggaaccucauaugaucgucuccaagcaagaaaggggaaaaucucuguuauuuaagaccucagcugguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucgugguuacagugcacaccggagaucagcaucaagucgguaaugagacuacggaacacggcacaauugccaccaucacuccccaggcgccuaccucagagauucagcuuacagacuacggggcccugaccuuggacuguaguccaaggacuggacuagauuucaacgaaauggugcugcucacaaugaaggagaaaagcuggcugguacauaagcagugguuucuugaccugccguugcccuggacgucuggcgcauccaccucacaagagacuuggaaucggcaggaucuccugguuacauucaaaaccgcucacgccaagaagcaggaaguggucguguuagguagccaagagggggcuaugcacacagcccugacuggcgcaaccgaaauccagacgaguggaaccacaacuaucuuugccggccaucuaaaaugccgucucaagauggacaaacugacccuuaagggggucucuuaugugauguguacaggauccuucaaauuggagaaggaaguugcugagacucagcacgguaccgugcugguacaggucaaguacgagggcacggaugcgccuugcaaaauuccaauaagcacacaagacgaaaagggggugacccagaacggacgccucaucacugcaaaucccauuguuacagauaaagagaagccugugaacaucgaaaccgagccacccuucggcgagucguauauagucauuggugccggggaaaaagcucugaaacuuucuugguuuaagaaaggcuccucaaucggaaagauguucgaggccacugcaagaggcgccaggcggauggcuauccugggggacaccgccugggauuuuggaaguauugguggcguguucacaagcguagggaaauuggugcaucagguuuuuggaacggcauacggcguccucuucuccggugugucuuggaccaugaagaucgggauuggcauacuguuaacuuggcugggacuaaauagccgaucaacaagucucuccaugaccuguaucgcggugggcauggucacacuguaccuugggguuauggugcaggcugacagcggaugcgugauuaacuggaaaggccgcgaauugaagugugguucugggaucuuuguaacuaacgagguccacaccuggacggaacaauauaaguuccaggccgauucaccgaaaagacugagugcagccaucggaaaggcuugggaggagggcgugugcgguauuaggagcgccacacggcucgaaaauauaauguggaaacagaucuccaacgagcugaaucauauuuuacuggaaaacgacaugaaguuuaccguuguggucggcgacgcaaaugggauccuuacucagggcaagaaaaugauucgcccucaacccauggagcacaaauacucuuggaagucguggggcaaggcuaaaaucauaggggccgauacccagaacacaacuuucaucauugacggaccagauaccccugaaugucccgacgaucagagagcguggaauaucugggagguggaggacuauggcuuugguguuuucacaacgaacauuugguugaagcucagggauagcuacacccagaugugcgaccaccgucugauguccgccgcuaucaaagauucaaaggcagugcaugccgacaugggguauuggauagaaagugagaaaaaugaaacuuggaagcuagcucgggccucuuuuauugagguaaagacauguaucuggccacgaagccacacccugugguccaacggaguccucgaaucagagaugauuauccccaaaauauacggcgguccuaucagccaacauaauuauagaccaggcuacuucacucagacagcagggccguggcaccugggaaaacuugaguuggauuucaaccugugcgaaggcaccacggugguggucgacgagcacugcgggaauaggggacccucuuuacgcacuaccacaguuaccggcaaaauuauccaugaaugguguugccgguccuguacucucccuccacugagauuuaggggugaggaugggugcugguacggaauggagauucgccccgugaaggaaaaagaggaaaaccuuguacgaaguauggugagcgcgggcucuggugaggucgacuccuucucacugggcuugcucugugugaguaucaugauagaagagguuaugcggagccguuggucgagaaagaugcugaugacagggacccuagccgcauuuuuccugcucauuaugggacagcugacauggaaugaccuuaucagguugugcaucauggugggcgccaacgucuccgaucgcauggggaugggaacuaccuaucuggcauuaauggcuacguuuaagaugcggccuauguucgccgugggccuccuguuuagaaggcuuacaucucgagagguucugcuacucaccauuggucugagcuugguggcaucagucgaacugccaaacaguuuagaggaacucggggacggacuggccaugggcaucaugaugcuuaaacuguugacugauuuccaaucccaccagcucuggaccacacugcuaucucugacuuuuauuaagaccacgcuuagccucgacuacgcuuggaaaacaauggcgaugguacuguccauagugucauuguucccccuguguuuaagcaccacaagucagaagacaaccuggcucccgguucugcuuggcucuuuugggugcaaaccucugacuauguucuugaucacagagaauaagauuuggggacgcaaguccuggccacucaacgaagguaucauggccgugggcauugucagcauccugcuaucgucacugcuuaaaaaugaugugccccucgcagggccucugauagcuggaggcauguugaucgccuguuauguaauuucugguaguuccgccgacuuaagccuggagcgggcugcagaggugucuugggaagaggaagccgagcauagcggggcgucccacaacauccucgucgaaguucaggaugacggaaccaugaagauuaaagaugaggagagagacgauacgcugacuauccuucugaaggcuaccuugcuagccgugucaggcguguaccccaugaguauaccagcaacacuguuugucugguauuucuggcagaagaagaaacagaggagcggcgugcucugggacaccccuucucccccagaaguugagcgugccguacuggaugacgggauuuaccgcauccuucagcggggauuacuggguagaucccaggugggcgucgggguguuccaagacggaguuuuucauacaauguggcacgugacuaggggcgcuguccucauguaucaggguaagcgauuggaaccgucaugggcaagugugaagaaagaucugaucagcuacgggggaggcuggcgguuccagggcuccuggaauaccggggaggagguacaggucauugccguggaaccuggaaagaaccccaaaaauguucaaacgacaccagguacuuuuaagacccccgagggcgaagugggggcgauagcucucgacuucaaaccuggaacaucuggcucgccaaucgucaaccgcgaggguaagauuguggggcuguacggaaauggcguugugaccacuagcggcaccuaugucucagccaucgcacaggccaaggcuucccaggaagggccccuuccugagauugaggaugaaguguuuaaaaagagaaaccugacaaucauggacuugcacccgggaagugguaaaacgaggcgguaccuaccagccauaguacgagaggcaaucaagagaaaacugcgcacucucauuuuagcucccaccagggugguugccucugaaauggcggaggcccugaagggcaugccuauccguuaucaaacaaccgcagucaagagcgaacauacugggaaagagauuguggaucuuaugugccacgcuacauucaccaugcggcugcucuccccagugagaguccccaauuacaacaugaucauaauggacgaggcccauuuuacggauccugcuucaauugcagccaggggauauaucucuacucgcguaggcaugggugaagccgcugcgaucuucaugacagcaaccccgcccgggagcguggaggccuuuccacagaguaaugcuguuauucaggacgaagaacgagauaucccugaaagauccuggaacagcggauacgacuggauaaccgauuuccccggcaagacugugugguuugucccaucuauuaaaucaggcaaugacaucgccaacuguuugcggaagaacgggaaaagggugauucagcugucccgcaagacauucgacaccgaguaucaaaagacuaagaauaacgauugggacuacguugugacuacggauaucagugagaugggagcaaauuuccgugccgacagagucauagauccucggaggugccucaagcccgugauucugaaagacgguccagaacgcguaauccuugcuggcccgaugccugugaccgcggccagcgcagcucagcgaagagggcggaucggaaggaaccagaauaaggagggcgaucaguacauuuauaugggucaaccccuaaacaaugacgaagaucacgcccauuggacagaggcaaaaaugcuguuggacaacaucaauacuccagaggggauuauacccgccuuauuugaaccugagcgcgaaaagucggcugccaucgauggcgaguacagacugaggggagaagcgcggaagaccuucguugagcucaugcgucgcggcgaccugccagucuggcuuucuuauaaaguggcauccgagggguuucaguacagcgaucgaagauggugcuucgacggagaaaggaacaaucaggugcuggaggaaaacauggacgucgagauuuggacaaaggaaggugagcggaaaaagcuccgccccagaugguuggaugccaggaccuauucagacccucuggcucuacgggaguuuaaagaguucgccgcuggccgaagaaguguuucuggggaucugauccucgagaucggaaaacuuccgcagcaccugacuuuacgcgcacaaaaugccuuggacaaccuggugaugcuccacaauuccgaacagggcgguaaggcuuacaggcaugccauggaggaacugccagauacgauugagacccuuaugcugcucgcauugauagcgguacugacagggggcgugacuuuauuuuuccuaagcggaaagggccuggggaagaccucaaucggacuccuuugugucauggccaguagcgugcuguuguggauggcuuccguugagccccacuggauugccgcaucuaucauucuggaauuuuuccucauggugcugcuuaucccugagcccgaccggcagcguacaccacaggauaaccaacucgcuuaugucguaauaggucuguuguuuaugauccugaccguggccgcaaacgaaaugggcuuacuagagacuacuaagaaggaccuggggauuggacauguuguggccgagaaucaccaccaugcuacgaugcucgauaucgaccuucacccugcgagcgccuggacccuguacgcagucgcuacuacaauuaucacccccaugaugagacauaccauagaaaacacaacugccaauauuuccuugacggccaucgcaaaccaggcugccauucugaugggccucgauaaagguuggccaaucucaaagauggacauaggggugccucugcuugcguuaggcugcuacucucaggucaauccgcugacccucacagcugccguguugaugcugguugcacacuaugccaucauuggacccggccuacaagcuaaagcaacuagggaggcccagaagcgcaccgcggcugggaucaugaagaacccaacaguggauggaauuguagccaucgaccuggacccuguggucuacgaugcaaaauucgaaaagcagcucggccagauaaugcuucugauuuuguguaccagucaaauccugcucaugcggacuacgugggcccugugcgagucgaucacauuagcuaccgguccccuuacuacccugugggaagggagcccaggaaaauuuuggaauacaacuauugccguuuccauggcaaacaucuuccgaggcucuuaucucgcuggugccggccuagcguucucacugaugaaaagccuagggggaggcagaagggggaccggagcccagggcgagacacugggugagaaauggaagcgccagcucaaucagcuuuccaagagugaauuuaacacguacaaacggucugggauaauggagguggacagaagcgaagcaaaggagggacugaaacguggcgaaaccacuaagcaugcugucucaagggguacagccaaauugcggugguucguggagcgcaaucugguaaagccugagggcaaggugauugaucucggguguggacgaggcgggugguccuauuacugcgcaggacugaaaaagguuaccgaagugaaaggcuauacuaagggugggcccggacacgaggaaccgaucccaauggcuacauacggcuggaacauugucaaacuacacaguggcagagacguguuuuucaccccucccgagaagugugauacgcuucugugcgacaucggggaaagcucuccaaaucccaccauagaggagggaaggacacuacggguccucaaaaugguggaaccuuggcugcgcgguaaccaauuuuguaucaagauuuugaauccguacaugcccuccguuguagagacucuggaacagaugcagagaaagcauggcgggaugcucgugaggaacccacuuucacgaaauagcacccacgagauguauugggucucgugcggaacaggcaacaucgugucugccguuaacaugacaagucggaugcuguuaaaucguuucaccauggcccauagaaaaccuacauacgagcgcgauguggaccugggugcggggaccaggcacgucgcuguggaacccgagauugcaaacuuggauaucauuggacagcggaucgaaaauauaaagaacgagcacaaauccacuuggcauuaugacgaagauaauccuuacaagacgugggccuaucacggcagcuacgagguaaaaccaucaggcuccgcuucuagcauggugaacgggguugucagacuccugacaaagcccugggacgugauuccuauggugacccaaaucgccaugacugacaccacaccauuuggacagcagcgcgucuucaaggagaaaguugauacgaggacaccccgaccgaagcgggguacugcacaaaucauggaagugacagccaaauggcuauggggcuuucuuaguagaaauaagaaaccuaggauuuguacccgcgaggaguucacucguaagguacgguccaacgcugcgauaggggccguguuugucgacgagaaucaguggaacagcgcaaaggaagcuguggaggaugagagauucugggaccugguucauagggaacgcgagcuccacaaacagggaaagugcgccacaugcguguauaauaugaugggcaaacgagaaaagaaacugggugaguuugggaaggcaaagggaucucgggccaucugguacaugugguugggcgcuagauuccuggaguucgaggcccucggcuuuaugaacgaggaucauugguucucaagggaaaauagucuuuccggggucgagggagaaggucugcacaaauuaggcuacauucugcgcgacaucagcaagauuccagggggaaacauguaugcggaugacaccgcaggcugggauacaagaaucacugaggacgauuugcagaaugaggccaaaauaaccgacaucauggaacccgagcacgcucuccuggccacgucuauuuuuaagcuaaccuaccaaaacaaagugguacggguucagaggccugcaaagucggguacagugauggaugucaucucacgucgagaccagcgcgggagcggacaggugggcacuuauggccuuaacaccuucacaaauauggaagugcaacugauuagacagauggaguccgaagggaucuuuaguccaucugagcucgagaacagcaaucuggcugaacgggucuuggacugguuagagaaacauggaguugaaaggcugaagcgcauggccauauccggugaugacugugugguaaagcccacugaugacagauucgcuaccgcccucacggcacuuaacgauaugggcaaagugcggaaggacauuccgcagugggagccuucaaaaggguggaaugauuggcagcaaguccccuuuugcagucaccauuuccaccagcugaucaugaaggacggaagggaaaucgugguuccaugucgaaaccaggaugagcuagugggccgugcgagagucucucagggugccggguggagccugcgcgagacagcuugccucggaaaauccuacgcccaaauguggcaguugauguauuuucaccggagggaccugagacuugcagcuaaugccauuuguucagcagugccuguaaacuggguucccaccagccgcacuacauggucuauacaugcccaccaucaguggaugaccacugaagauaugcuguccguguggaaucgggucuggaucgaggaaaacccauggauggaggacaagacccacgugaguagcugggaagacguucccuaccucggcaagagggaggaucaauggugcggcucguuaauugggcugacagcgcgagcuacgugggccaccaauauccagguggcaauuaaccaggucagacgguugaucggaaaugagaacuaucuggacuacaugacuuccaugaaaagguucaagaaugaaucugauccugagggugcccucugguga

SEQ ID NO: 14206 - RNA, 9879 nt, Artificial Sequence
  derived and/or modified CDS sequence (opt3) from DENV-1__KM403617__SS-prME
agcgugaccaugcugcucaugcuucugcccaccgcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucgugguuacagugcacaccggagaucagcaucaagucgguaaugagacuacggaacacggcacaauugccaccaucacuccccaggcgccuaccucagagauucagcuuacagacuacggggcccugaccuuggacuguaguccaaggacuggacuagauuucaacgaaauggugcugcucacaaugaaggagaaaagcuggcugguacauaagcagugguuucuugaccugccguugcccuggacgucuggcgcauccaccucacaagagacuuggaaucggcaggaucuccugguuacauucaaaaccgcucacgccaagaagcaggaaguggucguguuagguagccaagagggggcuaugcacacagcccugacuggcgcaaccgaaauccagacgaguggaaccacaacuaucuuugccggccaucuaaaaugccgucucaagauggacaaacugacccuuaagggggucucuuaugugauguguacaggauccuucaaauuggagaaggaaguugcugagacucagcacgguaccgugcugguacaggucaaguacgagggcacggaugcgccuugcaaaauuccaauaagcacacaagacgaaaagggggugacccagaacggacgccucaucacugcaaaucccauuguuacagauaaagagaagccugugaacaucgaaaccgagccacccuucggcgagucguauauagucauuggugccggggaaaaagcucugaaacuuucuugguuuaagaaaggcuccucaaucggaaagauguucgaggccacugcaagaggcgccaggcggauggcuauccugggggacaccgccugggauuuuggaaguauugguggcguguucacaagcguagggaaauuggugcaucagguuuuuggaacggcauacggcguccucuucuccggugugucuuggaccaugaagaucgggauuggcauacuguuaacuuggcugggacuaaauagccgaucaacaagucucuccaugaccuguaucgcggugggcauggucacacuguaccuugggguuauggugcaggcugacagcggaugcgugauuaacuggaaaggccgcgaauugaagugugguucugggaucuuuguaacuaacgagguccacaccuggacggaacaauauaaguuccaggccgauucaccgaaaagacugagugcagccaucggaaaggcuugggaggagggcgugugcgguauuaggagcgccacacggcucgaaaauauaauguggaaacagaucuccaacgagcugaaucauauuuuacuggaaaacgacaugaaguuuaccguuguggucggcgacgcaaaugggauccuuacucagggcaagaagaugauucgcccucaacccauggagcacaaauacucuuggaagucguggggcaaggcuaaaaucauaggggccgauacccagaacacaacuuucaucauugacggaccagauaccccugaaugucccgacgaucagagagcguggaauaucugggagguggaggacuauggcuuugguguuuucacaacgaacauuugguugaagcucagggauagcuacacccagaugugcgaccaccgucugauguccgccgcuaucaaagauucaaaggcagugcaugccgacaugggguauuggauagaaagugagaaaaaugaaacuuggaagcuagcucgggccucuuuuauugagguaaagacauguaucuggccacgaagccacacccugugguccaacggaguccucgaaucagagaugauuauccccaaaauauacggcgguccuaucagccaacauaauuauagaccaggcuacuucacucagacagcagggccguggcaccugggaaaacuugaguuggauuucaaccugugcgaaggcaccacggugguggucgacgagcacugcgggaauaggggacccucuuuacgcacuaccacaguuaccggcaaaauuauccaugaaugguguugccgguccuguacucucccuccacugagauuuaggggugaggaugggugcugguacggaauggagauucgccccgugaaggaaaaagaggaaaaccuuguacgaaguauggugagcgcgggcucuggugaggucgacuccuucucacugggcuugcucugugugaguaucaugauagaagagguuaugcggagccguuggucgagaaagaugcugaugacagggacccuagccguguuuuuccugcucauuaugggacagcugacauggaaugaccuuaucagguugugcaucauggucggcgcuaacguguccgaucgcauggggaugggaacuaccuaucuggccuuaauggcaacguuuaagaugcggccuauguucgcuguuggccuccuguuuagaaggcuuacaucucgagaggugcugcuacucaccauuggucugagcuuggucgccucaguagaacugccaaacaguuuagaggaacucggggacggacuggcaaugggcaucaugaugcuuaaacuguugacugauuuccaaucccaccagcucuggaccacacugcuaucucugacuuuuauuaagaccacgcuuagccucgacuacgccuggaaaacaauggcuauggugcuguccauaguuucauuguucccccuguguuuaagcaccacaagucagaagacaaccuggcucccggugcugcuuggcucuuuugggugcaaaccucugacuauguucuugaucacagagaauaagauuuggggacgcaaguccuggccacucaacgaagguaucauggcggucggcauugugagcauccugcuaucgucacugcuuaaaaaugauguaccccucgccgggccucugauagcaggaggcauguugaucgcuuguuaugugauuucugguaguuccgccgacuuaagccuggagcgggccgcugaggucucuugggaagaggaagcagagcauagcggggccucccacaacauccucguugaagugcaggaugacggaaccaugaagauuaaagaugaggagagagacgauacgcugacuauccuucugaaggcgaccuugcuagcugugucaggcgucuaccccaugaguauaccagccacacuguuugugugguauuucuggcagaagaagaaacagaggagcggcguucucugggacaccccuucucccccagaaguagagcgugcagugcuggaugacgggauuuaccgcauccuucagcggggauuacuggguagaucccaggucggcguggggguuuuccaagacggaguguuucauacaauguggcacgucacuaggggcgccgugcucauguaucaggguaagcgauuggaaccgucaugggcuaguguaaagaaagaucugaucagcuacgggggaggcuggcgguuccagggcuccuggaauaccggggaggagguccaggugauugcaguugaaccuggaaagaaccccaaaaaugugcaaacgacaccagguacuuuuaagacccccgagggcgaagucggggccauagcgcucgacuucaaaccuggaacaucuggcucgccaaucgugaaccgcgaggguaagauuguugggcuguacggaaauggcguggucaccacuagcggcaccuaugugucagcuaucgcccaggcaaaggccucccaggaagggccccuuccugagauugaggaugaaguauuuaaaaagagaaaccugacaaucauggacuugcacccgggaagugguaaaacgaggcgguaccuaccagcuauagugcgagaggccaucaagagaaaacugcgcacucucauuuuagcacccaccaggguugucgcuucugaaauggccgaggcgcugaagggcaugccuauccguuaucaaacaaccgccguaaagagcgaacauacugggaaagagauuguggaucuuaugugccacgcaacauucaccaugcggcugcucuccccagucagaguacccaauuacaacaugaucauaauggacgaggcucauuuuacggauccugccucaauugcugcaaggggauauaucucuacucgcgugggcaugggugaagccgccgcuaucuucaugacagcgaccccgcccgggagcguugaggcauuuccacagaguaaugccgugauucaggacgaagaacgagauaucccugaaagauccuggaacagcggauacgacuggauaaccgauuuccccggcaagacugucugguuugugccaucuauuaaaucaggcaaugacaucgcuaacuguuugcggaagaacgggaaaaggguuauucagcugucccgcaagacauucgacaccgaguaucaaaagacuaagaauaacgauugggacuacguggucacuacggauaucagugagaugggagccaauuuccgugcagacagagugauagauccucggaggugccucaagcccguaauucugaaagacgguccagaacgcgugauccuugccggcccgaugccuguuaccgcugcgagcgccgcacagcgaagagggcggaucggaaggaaccagaauaaggagggcgaucaguacauuuauaugggucaaccccuaaacaaugacgaagaucacgcucauuggacagaggccaaaaugcuguuggacaacaucaauacuccagaggggauuauacccgcauuauuugaaccugagcgcgaaaagucggccgcuaucgauggcgaguacagacugaggggagaagcccggaagaccuucgucgagcucaugcgucgcggcgaccugccaguguggcuuucuuauaaaguggcguccgagggguuucaguacagcgaucgaagauggugcuucgacggagaaaggaacaaucagguccuggaggaaaacauggacguugagauuuggacaaaggaaggugagcggaaaaagcuccgccccagaugguuggaugcaaggaccuauucagacccucuggcccuacgggaguuuaaagaguucgcugccggccgaagaagugugucuggggaucugauccucgagaucggaaaacuuccgcagcaccugacuuuacgcgcucaaaaugcauuggacaaccugguaaugcuccacaauuccgaacagggcgguaaagccuacaggcaugcuauggaggaacugccagauacgauugagacccuuaugcugcucgccuugauagcagugcugacagggggcgucacuuuauuuuuccuaagcggaaagggccuggggaagaccucaaucggacuccuuugugugauggcgaguagcguucuguuguggauggccuccguggagccccacuggauugcugccucuaucauucuggaauuuuuccucaugguccugcuuaucccugagcccgaccggcagcguacaccacaggauaaccaacucgcauauguagugauaggucuguuguuuaugauccugaccguugcugccaacgaaaugggcuuacuagagacuacuaagaaggaccuggggauuggacauguggucgcagagaaucaccaccaugccacgaugcucgauaucgaccuucacccugcuagcgcguggacccuguacgccguggcaacuacaauuaucacccccaugaugagacauaccauagaaaacacaacugcuaauauuuccuugacggccaucgccaaccaggcagcuauucugaugggccucgauaaagguuggccaaucucaaagauggacauaggggucccucugcuugccuuaggcugcuacucucaggugaauccgcugacccucacagcggcuguuuugaugcugguggcccacuaugcaaucauuggacccggccuacaagccaaagcuacuagggaggcacagaagcgcaccgccgcggggaucaugaagaacccaacaguagauggaauuguggcuaucgaccuggacccugucguuuacgaugccaaauucgaaaagcagcucggccagauaaugcuucugauuuuguguaccagucaaauccugcucaugcggacuacgugggcacugugcgagucgaucacauuagccaccgguccccuuacuacccugugggaagggagcccaggaaaauuuuggaauacaacuauugcuguguccauggccaacaucuuccgaggcucuuaucucgccggugcuggccuagccuucucacugaugaaaagccuagggggaggcagaagggggaccggagcgcagggcgagacacugggugagaaauggaagcgccagcucaaucagcuuuccaagagugaauuuaacacguacaaacggucugggauaauggaggucgacagaagcgaagccaaggagggacugaaacguggcgaaaccacuaagcaugcagugucaagggguacagcuaaauugcggugguucguagagcgcaaucuggugaagccugagggcaagguuauugaucucggguguggacgaggcgggugguccuauuacugcgccggacugaaaaaggugaccgaagucaaaggcuauacuaagggugggcccggacacgaggaaccgaucccaauggcaacauacggcuggaacauugugaaacuacacaguggcagagacgucuuuuucaccccucccgagaagugugauacgcuucugugcgacaucggggaaagcucuccaaaucccaccauagaggagggaaggacacuacgggugcucaaaaugguugaaccuuggcugcgcgguaaccaauuuuguaucaagauuuugaauccguacaugcccuccguaguggagacucuggaacagaugcagagaaagcauggcgggaugcucgucaggaacccacuuucacgaaauagcacccacgagauguauugggugucgugcggaacaggcaacaucguuucugcugugaacaugacaagucggaugcuguuaaaucguuucaccauggcccauagaaaaccuacauacgagcgcgaugucgaccugggugccgggaccaggcacguggcgguagaacccgagauugcuaacuuggauaucauuggacagcggaucgaaaauauaaagaacgagcacaaauccacuuggcauuaugacgaagauaauccuuacaagacgugggcauaucacggcagcuacgaggugaaaccaucaggcuccgccucuagcaugguuaacggggucgugagacuccugacaaagcccugggacgugauuccuauggucacccaaaucgcuaugacugacaccacaccauuuggacagcagcgcguuuucaaggagaaaguggauacgaggacaccccgaccgaagcgggguacugcccaaaucauggaaguaacagcaaaauggcuauggggcuuucuuaguagaaauaagaaaccuaggauuuguacccgcgaggaguucacucguaaggugcgguccaacgccgcuauaggggcggucuuuguggacgagaaucaguggaacagcgccaaggaagcaguugaggaugagagauucugggaccuggugcauagggaacgcgagcuccacaaacagggaaagugcgcuacaugcgucuauaauaugaugggcaaacgagaaaagaaacugggugaguuugggaaggccaagggaucucgggcaaucugguacaugugguugggcgccagauuccuggaguucgaggcucucggcuuuaugaacgaggaucauugguucucaagggaaaauagucuuuccgggguggagggagaaggucugcacaaauuaggcuacauucugcgcgacaucagcaagauuccagggggaaacauguaugccgaugacaccgcgggcugggauacaagaaucacugaggacgauuugcagaaugaggcaaaaauaaccgacaucauggaacccgagcacgcccuccuggcuacgucuauuuuuaagcuaaccuaccaaaacaaaguaguucgggugcagaggccugccaagucggguacagucauggaugugaucucacgucgagaccagcgcgggagcggacaggugggcacuuauggccuuaacaccuucacaaauauggaaguccaacugauuagacagauggaguccgaagggaucuuuaguccaucugagcucgagaacagcaaucuggcagaacggguuuuggacugguuagagaaacauggaguggaaaggcugaagcgcauggcuauauccggugaugacuguguagugaagcccacugaugacagauucgccaccgcucucacggcccuuaacgauaugggcaaaguccggaaggacauuccgcagugggagccuucaaaaggguggaaugauuggcagcaagugcccuuuugcagucaccauuuccaccagcugaucaugaaggacggaagggaaaucguugugccaugucgaaaccaggaugagcuagucggccgugcaagagugucucagggugcgggguggagccugcgcgagacagccugccucggaaaauccuacgcucaaauguggcaguugauguauuuucaccggagggaccugagacuugccgcaaaugcuauuuguucagccguaccuguuaacugggugcccaccagccgcacuacauggucuauacaugcacaccaucaguggaugaccacugaagauaugcuguccgucuggaaucggguguggaucgaggaaaacccauggauggaggacaagacccacguuaguagcugggaagacgugcccuaccucggcaagagggaggaucaauggugcggcucguuaauugggcugacagcccgagcgacgugggcuaccaauauccaggucgccauuaaccaggugagacgguugaucggaaaugagaacuaucuggacuacaugacuuccaugaaaagguucaagaaugaaucugauccugagggugcacucugguga

SEQ ID NO: 14207 - RNA, 9879 nt, Artificial Sequence
  derived and/or modified CDS sequence (opt3) from DENV-1__KM403635__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccgcuucacaagagaccuggaaucggcaggaucuccugguaacuuucaaaacagcccacgcuaagaagcaggaaguuguggucuuagguagccaagagggggccaugcacaccgcacugacaggcgccacugaaauccagaccaguggaacgaccacaauuuuugcuggccaucuaaaaugccgucucaagauggacaaacugacucuuaagggggugucuuaugucauguguaccggauccuucaaauuggagaaggaaguggcggagacacagcacgguacuguucuggugcagguaaaguacgagggcaccgaugcaccuugcaaaauaccaaucagcacgcaagacgaaaagggggucacacagaacggacgccucauuaccgccaaucccaucgugacugauaaagagaagccuguuaacauagaaacagagccacccuucggcgagucguauauugugaucggugcuggggaaaaagcccugaagcuuucuugguuuaagaaaggcuccucaaucggaaagauguucgaggcaaccgccagaggcgcuaggcggauggccauucugggggacacugcaugggauuuuggaaguaucgguggcgucuucaccagcguggggaaauugguacaucagguguuuggaacagcguacggcguucucuucuccggugucucuuggacgaugaagauugggauaggcauccuguuaaccuggcugggacuaaauagccgaucaacuagucucuccaugacauguauugcugugggcauggugacccuguaccuuggggucaugguucaggccgacagcggaugcgugaucaacuggaaaggccgcgaauugaagugugguucugggaucuuugugacaaacgagguacacacuuggaccgaacaauauaaguuccaggcagauucaccgaaaagacugagugccgcuauuggaaaggccugggaggagggcgucugcgguauaaggagcgcaacgcggcucgaaaauaucauguggaaacagauuuccaacgagcugaaucauaucuuacuggaaaacgacaugaaguuuacagugguugugggcgacgcuaaugggauucuuacccagggaaaaaagaugauccgcccucaacccauggagcacaaauacucuuggaagucguggggcaaggccaaaauaaucggggcggauacucagaacaccacauucauuaucgacggaccagauacuccugaaugucccgacgaucagagagccuggaauauuugggaggucgaggacuauggcuuugguguguucaccacaaacaucugguugaagcucagggauagcuacacgcagaugugcgaccaccgucugauguccgcugcaauaaaagauucaaaggccguucaugcugacaugggguauuggauugaaagugagaaaaaugaaaccuggaagcuagcccgggcaucuuuuaucgaggugaagacuuguauuuggccacgaagccacacacugugguccaacggaguacucgaaucagagaugaucauacccaaaaucuacggcgguccuauuagccaacauaauuauagaccaggcuacuucacccagacugcggggccguggcaccugggaaagcuugaguuggauuucaaccugugcgaaggcacaaccgucgugguggacgagcacugcgggaauaggggacccucuuuacgcacgacuaccgucacaggcaaaaucauucaugaaugguguugccgguccuguacccucccuccacugagauuuaggggugaggaugggugcugguacggaauggagauccgccccguuaaggaaaaagaggaaaaccuugugcgaaguaugguaagcgccggcucuggugagguggacuccuucucacugggcuugcucugugucaguauaaugauugaagaggugaugcggagccguuggucgagaaagaugcugaugacugggacacuagcuguuuuuuuccugcucaucaugggacagcugaccuggaaugaccuuaucagguugugcauuauggugggcgccaacgucuccgaucgcauggggaugggaacaacuuaucuggcauuaauggcuaccuuuaagaugcggccuauguucgccgugggccuccuguuuagaaggcuuacgucucgagagguucugcuacucacaaucggucugagcuugguggcaucagucgaacugccaaacaguuuagaggaacucggggacggacuggccaugggcauuaugaugcuuaaacuguugaccgauuuccaaucccaccagcucuggacuacccugcuaucucugacauuuauaaagacuacccuuagccucgacuacgcuuggaaaacgauggcgaugguacuguccaucgugucauuguucccccuguguuuaagcacaaccagucagaagacuacauggcucccgguucugcuuggcucuuuugggugcaaaccucugaccauguucuugauuacugagaauaagaucuggggacgcaaguccuggccacucaacgaagguauuauggccgugggcaucgucagcauacugcuaucgucacugcuuaaaaaugaugugccccucgcagggccucugaucgcuggaggcauguugauugccuguuauguaaucucugguaguuccgccgacuuaagccuggagcgggcugcagaggugucuugggaagaggaagccgagcauagcggggcgucccacaacauucucgucgaaguucaggaugacggaacaaugaagaucaaagaugaggagagagacgauacccugacgauacuucugaaggcuacuuugcuagccgugucaggcguguaccccaugaguauuccagcaacccuguuugucugguauuucuggcaaaaaaagaaacagaggagcggcgugcucugggacacaccuucucccccagaaguugagcgugccguacuggaugacgggaucuaccgcauccuucagcggggauuacuggguagaucccaggugggcgucgggguguuccaagacggaguuuuucauaccauguggcacgugacaaggggcgcuguccucauguaucaggguaagcgauuggaaccgucaugggcaagugugaagaaagaucugauuagcuacgggggaggcuggcgguuccagggcuccuggaauacuggggaggagguacaggucauagccguggaaccuggaaagaaccccaaaaauguucaaaccacgccagguacauuuaagacucccgagggcgaagugggggcgaucgcucucgacuucaaaccuggaaccucuggcucgccaauugucaaccgcgaggguaagaucguggggcuguacggaaauggcguugugacaaccagcggcacuuaugucucagccauugcacaggccaaggcuucccaggaagggccccuuccugagaucgaggaugaaguguuuaaaaagagaaaccugaccauaauggacuugcacccgggaagugguaaaacaaggcgguaccuaccagccaucguacgagaggcaauuaagagaaaacugcgcacgcucaucuuagcucccacuagggugguugccucugaaauggcggaggcccugaagggcaugccuauucguuaucaaaccacagcagucaagagcgaacauaccgggaaagagaucguggaucuuaugugccacgcuacuuucacaaugcggcugcucuccccagugagaguccccaauuacaacaugauaauuauggacgaggcccauuuuaccgauccugcuucaaucgcagccaggggauauaucucuacgcgcguaggcaugggugaagccgcugcgauuuucaugacugcaacaccgcccgggagcguggaggccuuuccacagaguaaugcuguuauccaggacgaagagcgagauauaccugaaagauccuggaacagcggauacgacuggauuaccgauuuccccggcaagaccgugugguuugucccaucuaucaaaucaggcaaugacauugccaacuguuugcggaagaacgggaaaagggugauccagcugucccgcaagacuuucgacacagaguaucaaaagaccaaaaauaacgauugggacuacguugugacaacugauauaagugagaugggagcaaauuuccgugccgacagagucauugauccucggaggugccucaagcccgugauccugaaagacgguccagaacgcguaauccuugcuggcccgaugccugugacggcggccagcgcagcucagcgaagagggcggauuggaaggaaccagaauaaggagggcgaucaguacaucuauaugggucaaccccuaaacaaugacgaagaucacgcccauuggaccgaggcaaaaaugcuguuggacaacauuaauacaccagaggggauaauccccgccuuauuugaaccugagcgcgaaaagucggcugccauugauggcgaguacagacugaggggagaagcgcggaagacuuucguugagcucaugcgucgcggcgaccugccagucuggcuuucuuauaaaguggcauccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugccaggacauauucagacccucuggcucuacgggaguuuaaagaauucgccgcuggccgaagaaguguuucuggggaucugauccucgagauuggaaagcuuccgcagcaccugaccuuacgcgcacaaaaugccuuggacaaccuggugaugcuccacaauuccgaacagggcgguaaagcuuacaggcaugccauggaggaacugccagauacuauagagacgcuuaugcugcucgcauugaucgcgguacugaccgggggcgugacauuauuuuuccuaagcggaaagggccuggggaagacuucaauuggacuccuuugugucauggccaguagcgugcuguuguggauggcuuccguugagccccacuggaucgccgcaucuauuauccuggaauuuuuccucauggugcugcuuauaccugagcccgaccggcagcguaccccacaggauaaccaacucgcuuaugucguaaucggucuguuguuuaugauucugacaguggccgcaaacgaaaugggcuuacuagagaccacuaaaaaggaccuggggaucggacauguuguggccgagaaucaccaccaugcuacaaugcucgauauugaccuucacccugcgagcgccuggacgcuguacgcagucgcuaccacuaucauaacacccaugaugagacauaccauugaaaacaccacagccaauaucuccuugacugccauugcaaaccaggcugccauccugaugggccucgauaaagguuggccaauaucaaagauggacaucggggugccucugcuugcguuaggcugcuacucucaggucaauccgcugacgcucaccgcugccguguugaugcugguugcacacuaugccauuaucggacccggccuacaagcuaaagcaacaagggaggcccagaagcgcacugcggcugggauuaugaagaacccaaccguggauggaaucguagccauagaccuggacccuguggucuacgaugcaaaauucgaaaagcagcucggccagauuaugcuucugaucuuguguacaagucaaauccugcucaugcggaccacuugggcccugugcgagucgauuacguuagcuacagguccccuuaccacucugugggaagggagcccaggaaaauuuuggaauaccacaaucgccguuuccauggcaaacauauuccgaggcucuuaucucgcuggugccggccuagcguucucacugaugaagagcuuggggggaggcagaagggggacuggagcccagggcgagacccugggugagaaauggaagcgccagcucaaucagcuuuccaagagugaauuuaacacauacaaacggucugggauuauggagguggacagaagcgaagcaaaggagggacugaaacguggcgaaacgaccaagcaugcugucucaagggguacugccaaauugcggugguucguggagcgcaaucugguaaagccugagggcaaggugaucgaucucggguguggacgaggcgggugguccuauuacugcgcaggauuaaaaaagguuacagaagugaaaggcuauaccaagggugggcccggacacgaggaaccgauuccaauggcuacuuacggcuggaacaucgucaaacugcacaguggcagagacguguuuuucacaccucccgagaagugugauacccuucugugcgacauaggggaaagcucuccaaaucccacgaucgaggagggaaggacccuacggguccucaaaaugguggaaccuuggcugcgcgguaaccaauuuuguauuaagaucuugaauccguacaugcccuccguuguagagacacuggaacagaugcagagaaagcauggcgggaugcucgugaggaacccacuuucacgaaauagcacucacgagauguauugggucucgugcggaaccggcaacauugugucugccguuaacaugacaagucggaugcuguuaaaucguuucacuauggcccauagaaaaccuaccuacgagcgcgauguggaccugggugcggggacaaggcacgucgcuguggaacccgagaucgcaaacuuggauauuaucggacagcggauagaaaauauuaagaacgagcacaaauccaccuggcauuaugacgaagauaauccuuacaagacuugggccuaucacggcagcuacgagguaaaaccaucaggcuccgcuucuagcauggugaacgggguugucagacuccugacgaagcccugggacgugaucccuauggugacacaaaucgccaugaccgacacuaccccauuuggacagcagcgcgucuucaaggagaaaguugauacaaggacgccccgaccgaagcgggguaccgcacaaauuauggaagugacugccaaauggcuauggggcuuucuuaguagaaauaagaaaccuaggauauguacacgcgaggaauucacccguaagguacgguccaacgcugcgaucggggccguguuugucgacgagaaucaguggaacagcgcaaaggaagcuguggaggaugagagauucugggaccugguucauagggaacgcgagcuccacaaacagggaaagugcgccacuugcguguauaauaugaugggcaaacgagaaaagaaacugggugaguuugggaaggcaaagggaucucgggccauuugguacaugugguugggcgcuagauuccuggaauucgaggcccucggcuuuaugaacgaggaucauugguucucaagggaaaauagucuuuccggggucgagggagaaggucugcacaaauuaggcuacauccugcgcgacauuagcaagaucccagggggaaacauguaugcggaugacacagcaggcugggauaccagaauaacagaggacgauuugcagaaugaggccaaaaucacugacauuauggaacccgagcacgcucuccuggccaccucuaucuuuaagcuaacguaccaaaacaaagugguacggguucagaggccugcaaagucggguaccgugauggaugucauuucacgucgagaccagcgcgggagcggacaggugggcacauauggccuuaacacuuucaccaauauggaagugcaacugaucagacagauggaguccgaagggauauuuaguccaucugagcucgagaacagcaaucuggcugaacgggucuuggacugguuagagaaacauggaguugaaaggcugaagcgcauggccauuuccggugaugacugugugguaaagcccacagaugacagauucgcuacugcccucaccgcacuuaacgauaugggcaaagugcggaaggacaucccgcagugggagccuucaaaaggguggaaugauuggcagcaaguccccuuuugcagucaccauuuccaccagcugaucaugaaggacggaagggaaauugugguuccaugucgaaaccaggaugagcuagugggccgugcgagagucucucagggugccggguggagccugcgcgagacggcuugccucggaaaauccuacgcccaaauguggcaguugauguauuuucaccggagggaccugagacuugcagcuaaugccauauguucagcagugccuguaaacuggguucccacaagccgcaccacuuggucuauccaugcccaccaucaguggaugacaaccgaagauaugcuguccguguggaaucgggucuggauugaggaaaacccauggauggaggacaagacucacgugaguagcugggaagacguucccuaccucggcaagagggaggaucaauggugcggcucguuaaucgggcugaccgcgcgagcuacaugggccacgaauauucagguggcaaucaaccaggucagacgguuggugggaaaugagaacuaucuggacuacaugaccuccaugaaaagguucaagaaugaaucugauccugagggugcccucugguga

SEQ ID NO: 14208 - RNA, 9879 nt, Artificial Sequence
  derived and/or modified CDS sequence (opt3) from DENV-1__KM403621__SS-prME
agcgugaccaugcugcucaugcuucugcccacagcauuggcuuuccacuuaacuacgagaggaggggaaccucauaugaucgucuccaagcaagaaaggggaaaaucucuguuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggagaguuuuccacaguccaaugcaguuauccaggacgaagaacgagauauaccugaaagaagcuggaacucuggauacgacuggauuaccgauuuccccggcaagacugugugguuugucccaucaaucaaauccggcaaugacauugccaacuguuugcggaagaacgggaaaagggugauccagcugagucgcaagacauucgacaccgaguaucaaaagacuaagaauaacgauugggacuacguugugacuacggauauaagcgagaugggagcuaauuuccgugccgacagagucauugauccucggaggugccucaagcccgugauccugaaagacgguccagaacgcguaauccuugcaggcccgaugccugugaccgccgcuucggcggcccagcgaagagggcggauuggaaggaaccagaauaaggagggcgaucaguacaucuauaugggucaaccccuaaacaaugacgaagaucacgcacauuggacagaggcuaaaaugcuguuggacaacauuaauacuccagaggggauaauccccgccuuauuugaaccugagcgcgaaaagucugcagccauugauggcgaguacagacugaggggagaagcucggaagaccuucguugagcucaugcgucgcggcgaccugccagucuggcuuuccuauaaaguggccagcgagggguuucaguacucagaucgaagauggugcuucgacggagaaaggaacaaucaggugcuggaggaaaacauggacgucgagaucuggacaaaggaaggugagcggaaaaagcuccgccccagaugguuggaugcgaggaccuauagugacccucuggcacuacgggaguuuaaagaguucgccgcuggccgaagaucuguuuccggggaucugauccucgagauuggaaaacuuccgcagcaccugacuuuacgcgcccaaaaugcuuuggacaaccuggugaugcuccacaauagcgaacagggcgguaaagcauacaggcaugccauggaggaacugccagauacgauagagacccuuaugcugcucgcuuugaucgccguacugacagggggcgugacuuuauuuuuccuaucaggaaagggccuggggaagaccaguauuggacuccuuugugucauggcaagcuccgugcuguuguggauggcgucuguugagccccacuggaucgccgcuagcauuauccuggaauuuuuccucauggugcugcuuauaccugagcccgaccggcagcguacaccacaggauaaccaacucgccuaugucguaaucggucuguuguuuaugauucugaccguggcagcuaacgaaaugggcuuacuagagacuaccaaaaaggaccuggggaucggacauguuguggccgagaaucaccaccaugcaacgaugcucgauauugaccuucacccugccuccgcuuggacccuguacgcggucgccacuacaaucauaacccccaugaugagacauaccauugaaaacacaacugcaaauaucucauugacggcuauugccaaccaggccgcaauccugaugggccucgauaaagguuggccaauaucuaagauggacaucggggugccucugcuugcuuuaggcugcuacagucaggucaauccgcugacccucacagccgcgguguugaugcugguugcucacuaugccauuaucggacccggccuacaagcaaaagccacuagggaggcucagaagcgcaccgcagccgggauuaugaagaacccaacaguggauggaaucguagcgauagaccuggacccuguggucuacgaugcuaaauucgaaaagcagcucggccagauuaugcuucugaucuuguguaccucgcaaauccugcucaugcggacuacgugggcccugugcgagagcauuacauuagcaaccgguccccuuacuacccugugggaaggguccccaggaaaauuuuggaauacaacuaucgccguuucuauggcuaacauauuccgaggcucauaucucgccggugcaggccuagcuuucagccugaugaagucccuagggggaggcagaagggggaccggagcccagggcgagacacugggugagaaauggaagcgccagcucaaucagcuuaguaagucugaauuuaacacguacaaacggagcgggauuauggagguggacagaucagaagcgaaggagggacugaaacguggcgaaaccacuaagcaugccgucuccagggguacagcaaaauugcggugguucguggagcgcaaucugguaaagccugagggcaaggugaucgaucucggguguggacgaggcggguggaguuauuacugcgcuggacugaaaaagguuaccgaagugaaaggcuauacuaagggugggcccggacacgaggaaccgauuccaauggccacauacggcuggaacaucgucaaacuacacagcggcagagacguguuuuucaccccucccgagaagugugauacgcuucugugcgacauaggggaaucuuccccaaaucccaccaucgaggagggaaggacacuacggguccucaaaaugguggaaccuuggcugcgcgguaaccaauuuuguauuaagaucuugaauccguacaugcccucaguuguagagacucuggaacagaugcagagaaagcauggcgggaugcucgugaggaacccacuuagccgaaauucgacccacgagauguauugggucucuugcggaacaggcaacauugugagugcaguuaacaugacuucccggaugcuguuaaaucguuucaccauggcucauagaaaaccuacauacgagcgcgauguggaccugggugccgggaccaggcacgucgccguggaacccgagaucgcgaacuuggauauuaucggacagcggauagaaaauauuaagaacgagcacaaaagcacuuggcauuaugacgaagauaauccuuacaagacgugggcuuaucacggcucauacgagguaaaaccauccggcucugcaagcaguauggugaacgggguugucagacuccugacaaagcccugggacgugaucccuauggugacccaaaucgccaugacugacaccacaccauuuggacagcagcgcgucuucaaggagaaaguugauacgaggacaccccgaccgaagcgggguacugcucaaauuauggaagugacagccaaauggcuauggggcuuucuuuccagaaauaagaaaccuaggauauguacccgcgaggaguucacucguaagguacggagcaacgcagccaucggggcuguguuugucgacgagaaucaguggaacucugcgaaggaagccguggaggaugagagauucugggaccugguucauagggaacgcgagcuccacaaacagggaaagugcgcaacaugcguguauaauaugaugggcaaacgagaaaagaaacugggugaguuugggaaggcuaagggaucacgggccauuugguacaugugguugggcgcaagauuccuggaguucgaggcccucggcuuuaugaacgaggaucauugguucaguagggaaaauucccuuagcggggucgagggagaaggucugcacaaauuaggcuacauccugcgcgacauuucuaagaucccagggggaaacauguaugcugaugacaccgccggcugggauacaagaauaacugaggacgauuugcagaaugaggcgaaaaucaccgacauuauggaacccgagcacgcacuccuggccacgucgaucuuuaagcuaaccuaccaaaacaaagugguacggguucagaggccugcuaagucagguacagugauggaugucauuagccgucgagaccagcgcggguccggacaggugggcacuuauggccuuaacaccuucacaaauauggaagugcaacugaucagacagauggagagugaagggauauuuucuccaagcgagcucgagaacuccaaucuggccgaacgggucuuggacugguuagagaaacauggaguugaaaggcugaagcgcauggcaauuucaggugaugacugugugguaaagcccacugaugacagauucgcuaccgcccucacggcucuuaacgauaugggcaaagugcggaaggacaucccgcagugggagccuaguaaaggguggaaugauuggcagcaaguccccuuuugcucucaccauuuccaccagcugaucaugaaggacggaagggaaauugugguuccaugucgaaaccaggaugagcuagugggccgugccagagucagccagggugcaggguggucccugcgcgagacagcgugccucggaaaaucauacgcccaaauguggcaguugauguauuuucaccggagggaccugagacuugcugccaaugcaauauguagcgcugugccuguaaacuggguucccaccucucgcacuacaugguccauccaugcccaccaucaguggaugaccacugaagauaugcugaguguguggaaucgggucuggauugaggaaaacccauggauggaggacaagacccacgugagcucgugggaagacguucccuaccucggcaagagggaggaucaauggugcggcuccuuaaucgggcugacagcacgagccacgugggcgaccaauauucagguggcuaucaaccaggucagacgguugauaggaaaugagaacuaucuggacuacaugacuucuaugaaaagguucaagaaugaaucagauccugagggugcccucugguga

SEQ ID NO: 14209 - RNA, 9879 nt, Artificial Sequence
  derived and/or modified CDS sequence (opt3) from DENV-1__KM403623__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagagcaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaagggggugucuuaugucauguguacaggauccuucaaacuugagaaggaaguggcugagacucagcacgguaccguuuuggugcagguaaaguacgagggcacggaugcgccuugcaaaauaccaaucagcacacaagacgaaaagggggucacccagaacggacgccugauuacugcaaaucccaucgugacagauaaagagaagccuguuaacauagaaaccgagccacccuuuggcgagucguauauugugaucggugccggggaaaaagcucucaagcugucuugguucaagaaaggcuccucaaucggaaagauguuugaggccacugcaagaggcgccaggcggauggcuauucuuggggacaccgccugggauuucggaaguaucgguggcgucuuuacaagcguggggaaacugguacaucagguguucggaacggcauacggcguuuuguuuuccggugucucuuggaccaugaagauugggauaggcauccuccugacuugguuaggacugaauagccgaucaacaagucuauccaugaccuguauugcggugggcauggugacacucuaccugggggucaugguucaggcugacagcggaugcgugaucaacuggaaaggccgcgaacuuaagugugguucugggaucuucgugacuaacgagguacacaccuggacggaacaauauaaguuucaggccgauucaccgaaaagauugagugcagccauuggaaaggcuugggaggagggcgucugcgguauaaggagcgccacacggcuggaaaauaucauguggaaacagauuuccaacgagcucaaucauauccuguuagaaaacgacaugaaguucaccgugguugugggcgacgcaaaugggauucugacucagggaaaaaagaugauccgcccucaacccauggagcacaaauacucuuggaagucguggggcaaggcuaaaauaaucggggccgauacccagaacacaacuuuuauuaucgacggaccagauaccccugaaugucccgacgaucagagagcguggaauauuugggaggucgaggacuauggcuucgguguguuuacaacgaacaucuggcuuaaguugagggauagcuacacccagaugugcgaccaccgucucauguccgccgcuauaaaagauucaaaggcaguucaugccgacaugggguauuggauugaaagugagaaaaaugaaacuuggaagcuggcucgggccucuuucaucgaggugaagacauguauuuggccacgaagccacacccuaugguccaacggaguacuggaaucagagaugaucauacccaaaaucuacggcgguccuauuagccaacauaauuauagaccaggcuacuucacucagacagcagggccguggcaccucggaaagcuggagcuugauuuuaacuugugcgaaggcaccacggucgugguggacgagcacugcgggaauaggggacccucucugcgcacuaccacagucaccggcaaaaucauucaugaaugguguugccgguccuguacuuuaccuccacucagauucaggggugaggaugggugcugguacggaauggagauccgccccguuaaggaaaaagaggaaaaccuggugcgaaguaugguaagcgcgggcucuggugagguggacuccuuuucacuuggccuguugugugucaguauaaugauugaagaggugaugcggagccguuggucgagaaagaugcucaugacagggacccuggccguuuucuuucuacugaucaugggacagcucacauggaaugaccugaucaggcuuugcauuauggugggcgcuaacgucuccgaucgcauggggaugggaacuaccuauuuggcccugauggcaacguucaagaugcggccuauguuugcugugggcuuacucuucagaaggcugacaucucgagagguucuucugcuaaccaucggucucagccugguggccucagucgaauugccaaacagucuggaggaauuaggggacggacucgcaaugggcauuaugaugcugaaacuucugacugauuuucaaucccaccaguuguggaccacacuccugucucuaacuuucauaaagaccacgcugagccuugacuacgccuggaaaacaauggcuaugguacucuccaucgugucacuguuucccuugugucugagcaccacuagucagaagacaaccugguuaccgguucuccugggcucuuucgggugcaaaccucuuacuauguuucugauuacagagaauaagaucuggggacgcaaguccuggccauugaacgaagguauuauggcggugggcaucgucagcauacuccugucgucacuacugaaaaaugaugugccccuugccgggccucucaucgcaggaggcaugcugauugcuuguuauguaaucucugguaguuccgccgacuugagcuuagagcgggccgcugaggugucuugggaagaggaagcagagcauagcggggccucccacaacauucuggucgaaguucaggaugacggaaccaugaagaucaaagaugaggagagagacgauacgcucacuauacugcuuaaggcgacccuguuggcugugucaggcguguaccccaugaguauuccagccacacuauucgucugguauuucuggcaaaaaaagaaacagaggagcggcgugcugugggacaccccuucucccccagaaguugagcgugcaguacucgaugacgggaucuaccgcauccugcagcggggacuuuuagguagaucccaggugggcgucgggguguuucaagacggaguuuuccauacaauguggcacgugacuaggggcgccguccugauguaucaggguaagcgacucgaaccgucaugggcuagugugaagaaagauuugauuagcuacgggggaggcuggcgguuucagggcuccuggaauaccggggaggagguacaggucauagcaguggaaccuggaaagaaccccaaaaauguucaaacgacaccagguacuuucaagacccccgagggcgaagugggggccaucgcgcuggacuuuaaaccuggaacaucuggcucgccaauugucaaccgcgaggguaagaucguggggcucuacggaaauggcguugugaccacuagcggcaccuaugucucagcuauugcccaggcaaaggccucccaggaagggccccugccugagaucgaggaugaaguguucaaaaagagaaaccuuacaauaauggaccugcacccgggaagugguaaaacgaggcgguacuugccagcuaucguacgagaggccauuaagagaaaacuacgcacucugauccucgcacccaccagggugguugcuucugaaauggccgaggcguuaaagggcaugccuauucguuaucaaacaaccgccgucaagagcgaacauacugggaaagagaucguggaucugaugugccacgcaacauuuaccaugcggcuucuguccccagugagaguccccaauuacaacaugauaauuauggacgaggcucauuucacggauccugccucaaucgcugcaaggggauauaucucuacucgcguaggcaugggugaagccgccgcuauuuuuaugacagcgaccccgcccgggagcguggagaguuucccacaguccaaugcaguuauccaggacgaagagcgagauauaccugaaagaagcuggaacucuggauacgacuggauuaccgauuuucccggcaagacugugugguucgucccaucaaucaaauccggcaaugacauugccaacugucuccggaagaacgggaaaagggugauccaguugagucgcaagacauucgacaccgaguaucaaaagacaaaaaauaacgauugggacuacguugugacuacggauauaagcgagaugggagcuaauuuucgugccgacagagucauugauccucggaggugccugaagcccgugauccucaaagacgguccagaacgcguaauccuggcaggcccgaugccugugaccgccgcuucggcggcccagcgaagagggcggauuggaaggaaccagaauaaggagggcgaucaguacaucuauaugggucaaccccuuaacaaugacgaagaucacgcacauuggacagaggcuaaaaugcuacuggacaacauuaauacuccagaggggauaauccccgccuuguucgaaccugagcgcgaaaagucugcagccauugauggcgaguacagauuaaggggagaagcucggaagaccuuuguugagcugaugcgucgcggcgaccucccagucuggcuguccuauaaaguggccagcgagggguuccaguacucagaucgaagauggugcuuugacggagaaaggaacaaucaggugcuugaggaaaacauggacgucgagaucuggacaaaggaaggugagcggaaaaagcugcgccccagauggcucgaugcgaggaccuauagugacccuuuggcacugcgggaguucaaagaauuugccgcuggccgaagaucuguuuccggggaucuaauccuggagauuggaaagcucccgcagcaccuuacucugcgcgcccaaaaugcuuuagacaacuuggugaugcugcacaauagcgaacagggcgguaaagcauacaggcaugccauggaggaacucccagauacgauagagacccugaugcuucuggcucucaucgccguauugacagggggcgugacucuguucuuuuuaucaggaaagggccuagggaagaccaguauuggacugcucugugucauggcaagcuccgugcuucuguggauggcgucuguugagccccacuggaucgccgcuagcauuaucuuggaauucuuucugauggugcuccugauaccugagcccgaccggcagcguacaccacaggauaaccaacuugccuaugucguaaucggucuccuguucaugauuuugaccguggcagcuaacgaaaugggccuguuagagacuacaaaaaaggaccuagggaucggacauguuguggccgagaaucaccaccaugcaacgaugcuggauauugaccuccacccugccuccgcuuggacccuuuacgcggucgccacuacaaucauaacccccaugaugagacauaccauugaaaacacaacugcaaauaucucacugacggcuauugccaaccaggccgcaaucuugaugggccuggauaaagguuggccaauaucuaagauggacaucggggugccucuccuggcucuuggcugcuacagucaggucaauccguuaacccugacagccgcggugcucauguugguugcucacuaugccauuaucggacccggccugcaagcaaaagccacuagggaggcucagaagcgcaccgcagccgggauuaugaagaacccaacaguggauggaaucguagcgauagaccuagacccuguggucuacgaugcuaaauuugaaaagcagcugggccagauuaugcuccuuauccuguguaccucgcaaaucuugcugaugcggacuacgugggcccucugcgagagcauuacacuggcaaccggucccuuaacuacccuuugggaaggguccccaggaaaauucuggaauacaacuaucgccguuucuauggcuaacauauuccgaggcucauaucuggccggugcaggccucgcuuuuagccuaaugaagucccuggggggaggcagaagggggaccggagcccagggcgagacauugggugagaaauggaagcgccagcugaaucagcucaguaagucugaauucaacacguacaaacggagcgggauuauggagguggacagaucagaagcgaaggagggacuuaaacguggcgaaaccacuaagcaugccgucuccagggguacagcaaaacugcggugguuuguggagcgcaauuugguaaagccugagggcaaggugaucgaucugggguguggacgaggcggguggaguuauuacugcgcuggacucaaaaagguuaccgaagugaaaggcuauacuaagggugggcccggacacgaggaaccgauuccaauggccacauacggcuggaacaucgucaaauuacacagcggcagagacguguucuuuaccccucccgagaagugugauacgcugcuuugcgacauaggggaaucuuccccaaaucccaccaucgaggagggaaggacacugcggguccuaaaaaugguggaaccuuggcuccgcgguaaccaauucuguauuaagauccugaauccguacaugcccucaguuguagagacuuuggaacagaugcagagaaagcauggcgggaugcuggugaggaacccacucagccgaaauucgacccacgagauguauugggucucuugcggaacaggcaacauugugagugcaguuaacaugacuucccggaugcuucugaaucguuuuaccauggcucauagaaaaccuacauacgagcgcgauguggacuuaggugccgggaccaggcacgucgccguggaacccgagaucgcgaaccuggauauuaucggacagcggauagaaaauauuaagaacgagcacaaaagcacuuggcauuaugacgaagauaauccuuacaagacgugggcuuaucacggcucauacgagguaaaaccauccggcucugcaagcaguauggugaacgggguugucagauugcucacaaagcccugggacgugaucccuauggugacccaaaucgccaugacugacaccacaccauucggacagcagcgcgucuuuaaggagaaaguugauacgaggaccccccgaccgaagcgggguacugcucaaauuauggaagugacagccaaauggcuguggggcuuccuauccagaaauaagaaaccuaggauauguacccgcgaggaauuuacucguaagguacggagcaacgcagccaucggggcuguguucgucgacgagaaucaguggaacucugcgaaggaagccguggaggaugagagauuuugggaccuuguucauagggaacgcgagcugcacaaacagggaaagugcgcaacaugcguguauaauaugaugggcaaacgagaaaagaaacucggugaguucgggaaggcuaagggaucacgggccauuugguacauguggcugggcgcaagauucuuggaauuugaggcccugggcuucaugaacgaggaucauugguuuaguagggaaaauucccucagcggggucgagggagaaggucuucacaaacugggcuacaucuuacgcgacauuucuaagaucccagggggaaacauguaugcugaugacaccgccggcugggauacaagaauaacugaggacgaucugcagaaugaggcgaaaaucaccgacauuauggaacccgagcacgcauugcucgccacgucgaucuucaagcugaccuaccaaaacaaagugguacggguucagaggccugcuaagucagguacagugauggaugucauuagccgucgagaccagcgcggguccggacaggugggcacuuauggccuaaacaccuuuacaaauauggaagugcaacuuaucagacagauggagagugaagggauauucucuccaagcgagcuggagaacuccaaucucgccgaacggguccuggacugguuggagaaacauggaguugaaagguuaaagcgcauggcaauuucaggugaugacugugugguaaagcccacugaugacagauuugcuaccgcccugacggcucucaacgauaugggcaaagugcggaaggacaucccgcagugggagccuaguaaaggguggaaugauuggcagcaaguccccuucugcucucaccauuuucaccagcuuaucaugaaggacggaagggaaauugugguuccaugucgaaaccaggaugagcuggugggccgugccagagucagccagggugcaggguggucccuacgcgagacagcgugccugggaaaaucauacgcccaaauguggcagcucauguauuuccaccggagggacuugagacuggcugccaaugcaauauguagcgcugugccuguaaacuggguucccaccucucgcacuacaugguccauccaugcccaccaucaguggaugaccacugaagauaugcuuaguguguggaaucgggucuggauugaggaaaacccauggauggaggacaagacccacgugagcucgugggaagacguucccuaccugggcaagagggaggaucaauggugcggcucccucaucggguuaacagcacgagccacgugggcgaccaauauucagguggcuaucaaccaggucagacggcugauaggaaaugagaacuauuuggacuacaugacuucuaugaaaagguuuaagaaugaaucagauccugagggugcccugugguga

SEQ ID NO: 14210 - RNA, 9879 nt, Artificial Sequence
  derived and/or modified CDS sequence (opt3) from DENV-1__KM403575__SS-prME
agcgugaccaugcugcucaugcuucugcccaccgcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagaacgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacuaagaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagcuccgccccagaugguuggaugcaaggaccuauucagacccucuggcccuacgggaguuuaaagaguucgcugccggccgaagaaguguuucuggggaucugauccucgagauuggaaaacuuccgcagcaccugacuuuacgcgcucaaaaugcauuggacaaccuggugaugcuccacaauuccgaacagggcgguaaagccuacaggcaugcuauggaggaacugccagauacgauagagacccuuaugcugcucgccuugaucgcaguacugacagggggcgugacuuuauuuuuccuaagcggaaagggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccggcagcguacaccacaggauaaccaacucgcauaugucguaaucggucuguuguuuaugauucugaccguggcugccaacgaaaugggcuuacuagagacuacuaagaaggaccuggggaucggacauguuguggcagagaaucaccaccaugccacgaugcucgauauugaccuucacccugcuagcgcguggacccuguacgccgucgcaacuacaaucauaacccccaugaugagacauaccauugaaaacacaacugcuaauaucuccuugacggccauugccaaccaggcagcuauccugaugggccucgauaaagguuggccaauaucaaagauggacaucggggugccucugcuugccuuaggcugcuacucucaggucaauccgcugacccucacagcggcuguguugaugcugguugcccacuaugcaauuaucggacccggccuacaagccaaagcuacuagggaggcacagaagcgcaccgccgcggggauuaugaagaacccaacaguggauggaaucguagcuauagaccuggacccuguggucuacgaugccaaauucgaaaagcagcucggccagauuaugcuucugaucuuguguaccagucaaauccugcucaugcggacuacgugggcacugugcgagucgauuacauuagccaccgguccccuuacuacccugugggaagggagcccaggaaaauuuuggaauacaacuaucgcuguuuccauggccaacauauuccgaggcucuuaucucgccggugcuggccuagccuucucacugaugaaaagccuagggggaggcagaagggggaccggagcgcagggcgagacacugggugagaaauggaagcgccagcucaaucagcuuuccaagagugaauuuaacacguacaaacggucugggauuauggagguggacagaagcgaagccaaggagggacugaaacguggcgaaaccacuaagcaugcagucucaagggguacagcuaaauugcggugguucguggagcgcaaucugguaaagccugagggcaaggugaucgaucucggguguggacgaggcgggugguccuauuacugcgccggacugaaaaagguuaccgaagugaaaggcuauacuaagggugggcccggacacgaggaaccgauuccaauggcaacauacggcuggaacaucgucaaacuacacaguggcagagacguguuuuucaccccucccgagaagugugauacgcuucugugcgacauaggggaaagcucuccaaaucccaccaucgaggagggaaggacacuacggguccucaaaaugguggaaccuuggcugcgcgguaaccaauuuuguauuaagaucuugaauccguacaugcccuccguuguagagacucuggaacagaugcagagaaagcauggcgggaugcucgugaggaacccacuuucacgaaauagcacccacgagauguauugggucucgugcggaacaggcaacauugugucugcuguuaacaugacaagucggaugcuguuaaaucguuucaccauggcccauagaaaaccuacauacgagcgcgauguggaccugggugccgggaccaggcacgucgcgguggaacccgagaucgcuaacuuggauauuaucggacagcggauagaaaauauuaagaacgagcacaaauccacuuggcauuaugacgaagauaauccuuacaagacgugggcauaucacggcagcuacgagguaaaaccaucaggcuccgccucuagcauggugaacgggguugucagacuccugacaaagcccugggacgugaucccuauggugacccaaaucgcuaugacugacaccacaccauuuggacagcagcgcgucuucaaggagaaaguugauacgaggacaccccgaccgaagcgggguacugcccaaauuauggaagugacagcaaaauggcuauggggcuuucuuaguagaaauaagaaaccuaggauauguacccgcgaggaguucacucguaagguacgguccaacgccgcuaucggggcgguguuugucgacgagaaucaguggaacagcgccaaggaagcaguggaggaugagagauucugggaccugguucauagggaacgcgagcuccacaaacagggaaagugcgcuacaugcguguauaauaugaugggcaaacgagaaaagaaacugggugaguuugggaaggccaagggaucucgggcaauuugguacaugugguugggcgccagauuccuggaguucgaggcucucggcuuuaugaacgaggaucauugguucucaagggaaaauagucuuuccggggucgagggagaaggucugcacaaauuaggcuacauccugcgcgacauuagcaagaucccagggggaaacauguaugccgaugacaccgcgggcugggauacaagaauaacugaggacgauuugcagaaugaggcaaaaaucaccgacauuauggaacccgagcacgcccuccuggcuacgucuaucuuuaagcuaaccuaccaaaacaaagugguacggguucagaggccugccaagucggguacagugauggaugucauuucacgucgagaccagcgcgggagcggacaggugggcacuuauggccuuaacaccuucacaaauauggaagugcaacugaucagacagauggaguccgaagggauauuuaguccaucugagcucgagaacagcaaucuggcagaacgggucuuggacugguuagagaaacauggaguugaaaggcugaagcgcauggcuauuuccggugaugacugugugguaaagcccacugaugacagauucgccaccgcucucacggcccuuaacgauaugggcaaagugcggaaggacaucccgcagugggagccuucaaaaggguggaaugauuggcagcaaguccccuuuugcagucaccauuuccaccagcugaucaugaaggacggaagggaaauugugguuccaugucgaaaccaggaugagcuagugggccgugcaagagucucucagggugcgggguggagccugcgcgagacagccugccucggaaaauccuacgcucaaauguggcaguugauguauuuucaccggagggaccugagacuugccgcaaaugcuauauguucagccgugccuguaaacuggguucccaccagccgcacuacauggucuauccaugcacaccaucaguggaugaccacugaagauaugcuguccguguggaaucgggucuggauugaggaaaacccauggauggaggacaagacccacgugaguagcugggaagacguucccuaccucggcaagagggaggaucaauggugcggcucguuaaucgggcugacagcccgagcgacgugggcuaccaauauucagguggccaucaaccaggucagacgguugauaggaaaugagaacuaucuggacuacaugacuuccaugaaaagguucaagaaugaaucugauccugagggugcacucugguga

SEQ ID NO: 14211 - RNA, 9879 nt, Artificial Sequence
  derived and/or modified CDS sequence (opt3) from DENV-1__KM403586__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagagcaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagguccagcucacagacuacggggcccuuacccuggacuguaguccaaggacuggauuggauuuuaacgaaauggugcuacugacaaugaaggagaaaagcuggcucguacauaagcagugguuccuggaccuuccgcugcccuggacgucuggcgcauccaccucacaagagacuuggaaucggcaggauuugcucguuacauuuaaaaccgcucacgccaagaagcaggaaguggucgugcuggguagccaagagggggcuaugcacacagccuuaacuggcgcaaccgaaauccagacgaguggaaccacaacuaucuucgccggccaucugaaaugccgucuaaagauggacaaacucacccugaagggggucucuuaugugauguguacaggauccuucaaacuugagaaggaaguugcugagacucagcacgguaccguguugguacaggucaaguacgagggcacggaugcgccuugcaaaauuccaauaagcacacaagacgaaaagggggugacccagaacggacgccugaucacugcaaaucccauuguuacagauaaagagaagccugugaacaucgaaaccgagccacccuuuggcgagucguauauagucauuggugccggggaaaaagcucucaagcugucuugguucaagaaaggcuccucaaucggaaagauguuugaggccacugcaagaggcgccaggcggauggcuauccuuggggacaccgccugggauuucggaaguauugguggcguguuuacaagcguagggaaacuggugcaucagguuuucggaacggcauacggcgucuuguuuuccggugugucuuggaccaugaagaucgggauuggcauacuccugacuugguuaggacugaauagccgaucaacaagucuauccaugaccuguaucgcggugggcauggucacacucuaccuggggguuauggugcaggcugacagcggaugcgugauuaacuggaaaggccgcgaacuuaagugugguucugggaucuucguaacuaacgagguccacaccuggacggaacaauauaaguuucaggccgauucaccgaaaagauugagugcagccaucggaaaggcuugggaggagggcgugugcgguauuaggagcgccacacggcuggaaaauauaauguggaaacagaucuccaacgagcucaaucauauucuguuagaaaacgacaugaaguucaccguuguggucggcgacgcauacgggauccugacucagggaaaaaagaugauucgcccucaacccauggagcacaaauauucuuggaagucguggggcaaggcuaaaaucauaggggccgauacccagaauacaacuuuuaucauugacggaccagauaccccugaaugucccgacgaucagagagcguggaacaucugggagguggaggacuacggcuucgguguuuuuacaacgaauauuuggcuuaaguugagggauagcuauacccagaugugcgaccaccgucucauguccgccgcuaucaaagauucaaaggcagugcaugccgacaugggguacuggauagaaagugagaaaaacgaaacuuggaagcuggcucgggccucuuucauugagguaaagacauguaucuggccacgaagccacacccuaugguccaauggaguccuggaaucagagaugauuauccccaaaauauauggcgguccuaucagccaacauaacuacagaccaggcuacuucacucagacagcagggccguggcaccucggaaagcuggagcuugauuuuaauuugugcgaaggcaccacggugguggucgacgagcacugcgggaacaggggacccucucugcgcacuaccacaguuaccggcaaaauuauccaugaaugguguugccgguccuguacuuuaccuccacucagauucaggggugaggaugggugcugguauggaauggagauucgccccgugaaggaaaaagaggaaaaucugguacgaaguauggugagcgcgggcucuggugaggucgacuccuuuucacuuggccuguugugugugaguaucaugauagaagagguuaugcggagccguuggucgagaaagaugcucaugacagggacccuggccguguucuuucuacugauuaugggacagcucacauggaacgaccugaucaggcuuugcaucauggucggcgcuaauguguccgaucgcauggggaugggaacuaccuacuuggcccugauggcaacguucaagaugcggccuauguuugcuguuggcuuacucuucagaaggcugacaucucgagaggugcuucugcuaaccauuggucucagccuggucgccucaguagaauugccaaacagucuggaggaauuaggggacggacucgcaaugggcaucaugaugcugaaacuucugacugauuuucaaucccaccaguuguggaccacacuccugucucuaacuuucauuaagaccacgcugagccuugacuaugccuggaaaacaauggcuauggugcucuccauaguuucacuguuucccuugugucugagcaccacuagucagaagacaaccugguuaccggugcuccugggcucuuucgggugcaaaccucuuacuauguuucugaucacagagaacaagauuuggggacgcaaguccuggccauugaaugaagguaucauggcggucggcauugugagcauccuccugucgucacuacugaaaaacgauguaccccuugccgggccucucauagcaggaggcaugcugaucgcuuguuacgugauuucugguaguuccgccgacuugagcuuagagcgggccgcugaggucucuugggaagaggaagcagagcauagcggggccucccacaauauccugguugaagugcaggaugacggaaccaugaagauuaaagaugaggagagagacgauacgcucacuauccugcuuaaggcgacccuguuggcugugucaggcgucuaucccaugaguauaccagccacacuauucgugugguacuucuggcaaaaaaagaaacagaggagcggcguucugugggacaccccuucucccccagaaguagagcgugcagugcucgaugacgggauuuaucgcauccugcagcggggacuuuuagguagaucccaggucggcguggggguuuuucaagacggaguguuccauacaauguggcacgucacuaggggcgccgugcugauguaccaggguaagcgacucgaaccgucaugggcuaguguaaagaaagauuugaucagcuacgggggaggcuggcgguuucagggcuccuggaacaccggggaggagguccaggugauugcaguugaaccuggaaagaaucccaaaaacgugcaaacgacaccagguacuuucaagacccccgagggcgaagucggggccauagcgcuggacuuuaaaccuggaacaucuggcucgccaaucgugaaucgcgaggguaagauuguugggcucuauggaaacggcguggucaccacuagcggcaccuacgugucagcuaucgcccaggcaaaggccucccaggaagggccccugccugagauugaggaugaaguauucaaaaagagaaaucuuacaaucauggaccugcacccgggaagugguaaaacgaggcgguauuugccagcuauagugcgagaggccaucaagagaaaacuacgcacucugauucucgcacccaccaggguugucgcuucugaaauggccgaggcguuaaagggcaugccuauccguuaccaaacaaccgccgugaagagcgaacauacugggaaagagauuguggaucugaugugccacgcaacauuuaccaugcggcuucuguccccagucagaguacccaacuauaauaugaucauaauggacgaggcucauuucacggauccugccucaauugcugcaaggggauacaucucuacucgcgugggcaugggugaagccgccgcuaucuuuaugacagcgaccccgcccgggagcguugaggcauucccacagaguaacgccgugauucaggacgaagagcgagauaucccugaaagauccuggaauagcggauaugacuggauaaccgauuuucccggcaagacugucugguucgugccaucuauuaaaucaggcaacgacaucgcuaauugucuccggaagaacgggaaaaggguuauucaguugucccgcaagacauucgacaccgaguaccaaaagacaaaaaacaaugauugggacuacguggucacuacggauaucagugagaugggagccaacuuucgugcagacagagugauagauccucggaggugccugaagcccguaauucucaaagacgguccagaacgcgugauccuggccggcccgaugccuguuaccgcugcgagcgccgcacagcgaagagggcggaucggaaggaaucagaacaaggagggcgaucaguauauuuacaugggucaaccccuuaauaacgacgaagaucacgcucauuggacagaggccaaaaugcuacuggacaauaucaacacuccagaggggauuauacccgcauuguucgaaccugagcgcgaaaagucggccgcuaucgauggcgaguauagauuaaggggagaagcccggaagaccuuugucgagcugaugcgucgcggcgaccucccaguguggcugucuuacaaaguggcguccgagggguuccaguauagcgaucgaagauggugcuuugacggagaaaggaauaaccagguccuugaggaaaauauggacguugagauuuggacaaaggaaggugagcggaaaaagcugcgccccagauggcucgaugcaaggaccuacucagacccuuuggcccugcgggaguucaaagaauuugcugccggccgaagaagugugucuggggaucuaauccuggagaucggaaagcucccgcagcaccuuacucugcgcgcucaaaacgcauuagacaauuugguaaugcugcacaacuccgaacagggcgguaaagccuauaggcaugcuauggaggaacucccagauacgauugagacccugaugcuucuggcccucauagcaguguugacagggggcgucacucuguucuuuuuaagcggaaagggccuagggaagaccucaaucggacugcucugugugauggcgaguagcguucuucuguggauggccuccguggagccccacuggauugcugccucuaucauuuuggaauucuuucugaugguccuccugaucccugagcccgaccggcagcguacaccacaggauaaucaacuugcauacguagugauaggucuccuguucaugaucuugaccguugcugccaacgaaaugggccuguuagagacuacaaaaaaggaccuagggauuggacauguggucgcagagaaccaccaccaugccacgaugcuggauaucgaccuccacccugcuagcgcguggacccuuuacgccguggcaacuacaauuaucacccccaugaugagacauaccauagaaaauacaacugcuaacauuucccugacggccaucgccaaucaggcagcuauuuugaugggccuggauaaagguuggccaaucucaaagauggacauaggggucccucuccuggcccuuggcugcuauucucaggugaacccguuaacccugacagcggcuguucucauguugguggcccacuacgcaaucauuggacccggccugcaagccaaagcuacuagggaggcacagaagcgcaccgccgcggggaucaugaagaauccaacaguagauggaauuguggcuaucgaccuagacccugucguuuaugaugccaaauuugaaaagcagcugggccagauaaugcuccuuauucuguguaccagucaaaucuugcugaugcggacuacgugggcacucugcgagucgaucacacuggccaccggucccuuaacuacccuuugggaagggagcccaggacgauucuggaacacaacuauugcuguguccauggccaauaucuucagaggcucuuaccuggcaggugcuggccucgccuuuucacuaaugaaaagccuggggggaggcaggcgcgggaccggagcgcagggcgagacauugggugagaaguggaaacggcagcugaaccagcucuccaagagugaauucaauacguauaagagaucugggauaauggaggucgaccguagcgaagccaaagagggaaugaagaggggcgaaaccacuaaacaugcagugucacgggguacagcuaagcuucgcugguuuguagagcgaaaccuggugaaaccugagggcaagguuauugauuugggguguggaagaggcgggugguccuacuauugcgccggacugaagaaagugaccgaagucaagggcuacacuaaaggugggcccggacacgaggaaccgaucccaauggcaacauacggcuggaauauugugaagcuccacaguggcagggacgucuucuuuaccccucccgagaaaugugauacguuacugugcgacaucggggaaagcucuccaaaccccaccauagaggagggacggacacuucgcgugcugaagaugguugaaccuuggcuaagagguaaucaauucuguaucaaaauucucaacccguauaugcccuccguaguggagacucuggaacagaugcagaggaagcauggcgggauguugguccgaaauccacugucacggaacagcacccacgagauguacugggugucgugcggaacaggcaauaucguuucugcugugaacaugacuagucguaugcuccuuaacagauuuaccauggcccaucgcaagccuacauaugagagggaugucgaccugggugccgggacccggcacguggcgguagaacccgagauugcuaauuuagauaucauuggacagagaaucgaaaacauaaaaaaugagcacaaguccacuuggcauuacgacgaagauaacccuuauaaaacgugggcauaccacggcagcuaugaggugaagccaucaggcuccgccucuagcaugguuaauggggucgugcgccuguugacaaaacccugggacgugauuccuauggucacccaaaucgcuaugacugacaccacaccauucggacagcagaggguuuuuaaggagaagguggauacgcgaaccccccggccgaaaagagguacugcccaaaucauggaaguaacagcaaaguggcucuggggcuuccugaguaggaacaaaaagccucgcauuuguacccgugaggaauuuacucggaaagugagauccaaugccgcuauaggggcggucuucguggacgagaaccaguggaauagcgccaaggaagcaguugaggaugagagguuuugggaccuagugcaucgcgaacgagagcuucacaagcagggaaaaugcgcuacaugcgucuacaacaugaugggcaagcgggaaaaaaagcugggugaguucgggaaagccaagggaucuagagcaaucugguacauguggcucggcgccagguuccuggaauuugaggcuuugggcuucaugaaugaggaucauugguuuucacgcgaaaacagucuguccgggguggagggagaaggucuccacaagcuuggcuauauucugagagacaucagcaaaauuccagggggaaauauguacgccgaugacaccgcgggcugggauacacggaucacugaggacgauuuacagaacgaggcaaagauaaccgacaucauggaacccgagcacgcccuguuggcuacgucuauuuucaaacucaccuaucaaaauaagguaguuagggugcagcguccugccaaaucggguacagucauggaugugaucucacgacgcgaccagagagggagcggacaggugggcacuuacggccugaacaccuuuacaaacauggaaguccaacuaauucggcagauggaguccgaagggaucuucaguccaucugagcuugagaauagcaaccuggcagaaaggguucucgacuggcuggagaagcauggaguggaacgcuugaaaagaauggcuauauccggugaugacuguguagugaagcccacugaugaccgguuugccaccgcuuuaacggcccugaaugauaugggcaaggucaggaaagacauuccgcagugggagccuucaaagggguggaacgauuggcagcaagugcccuucugcagucaccauuuucaccagcucaucaugaaagacggacgagaaaucguugugccaugucguaaucaggaugagcuugucggcagagcacgcgugucucagggugcgggguggagccugcgggagacagccugccuaggaaaguccuaugcucaaauguggcagcugauguacuuccacaggagagaccuccgcuuggccgcaaacgcuauuuguucagccguaccuguuaauugggugcccaccagccggacuacauggucuauacaugcacaccaucaguggaugaccacugaagauaugcuguccgucuggaacaggguguggaucgaggaaaauccauggauggaggacaaaacccacguuaguagcugggaagacgugcccuaucuuggcaagcgagaggaucaauggugcggcucgcugauugggcucacagccagagcgacgugggcuaccaacauccaggucgccauuaaucaggugcggagguuaaucggaaacgagaauuaccuggacuacaugacuuccaugaagcgcuuuaaaaacgaaucugauccugagggugcauugugguga

SEQ ID NO: 14212 - RNA, 9879 nt, Artificial Sequence
  derived and/or modified CDS sequence (opt3) from DENV-1__KM403602__SS-prME
agcgugaccaugcugcucaugcuucugcccacagcauuggcuuuccacuuaacuacgagaggaggggaaccucauaugaucgucuccaagcaggaaagaggaaaaucucugcuguuuaagaccucagccgguguuaauaugugcacacucauugccauggaccugggagagcuuugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguuccguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaagaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggccaucacccuggacuguaguccaaggacuggauuggauuucaacgaaaugguccuacugacaaugaaggagaaaagcuggcucgugcauaagcagugguuucuggaccuuccgcugcccuggacgucuggcgcauccaccucacaagagacuuggaaucggcaggauuugcucguaacauucaaaaccgcucacgccaagaagcaggaaguugugguccuggguagccaagagggggcuaugcacacagccuuaacuggcgcaaccgaaauucagacgaguggaaccacaacuauauuugccggccaucugaaaugccgucuaaagauggacaaacucacccugaagggggugucuuaugucauguguacaggauccuucaaacuugagaaggaaguggcugagacucagcacgguaccguuuuggugcagguaaaguacgagggcacggaugcgccuugcaaaaucccaauuagcacacaagacgaaaagggggucacccagaacggacgccugaucacugcaaaucccauagugacagauaaagagaagccuguuaacauugaaaccgagccacccuucggcgagucguauaucgugaucggugccggggaaaaagcucucaagcugucuugguuuaagaaaggcuccucaauuggaaagauguucgaggccacugcaagaggcgccaggcggauggcuauccuuggggacaccgccugggauuuuggaaguauugguggcgucuucacaagcguggggaaacugguacaucagguguuuggaacggcauacggcguuuuguucuccggugucucuuggaccaugaagauagggaucggcauucuccugacuugguuaggacugaauagccgaucaacaagucuauccaugaccuguaucgcggugggcauggugacacucuaccugggggucaugguucaggcugacagcggaugcgugaucaacuggaaaggccgcgaacuuaagugugguucugggauuuuugugacuaacgagguacacaccuggacggaacaauauaaguuccaggccgauucaccgaaaagauugagugcagccauaggaaaggcuugggaggagggcgucugcgguaucaggagcgccacacggcuggaaaauauuauguggaaacagaucuccucugagcucaaccauauucuguuagaaaaugacaugaaguuuaccgugguugugggcgacgcaaacgggauccugacucagggcaagaagaugauacgcccucaacccauggagcacaaauacucguggaaaagcuggggcaaggcuaagaucauuggggccgauacccagaauacaacuuucaucauugacggaccagauaccccugaaugucccgacgaucagagagcguggaacaucugggaggucgaggacuauggcuuugguguguucacaacgaauauauggcuuaaguugagggauuccuacacccagaugugcgaccaccgucucaugucagccgcuauuaaagauaguaaggcaguucaugccgacaugggguauuggaucgaaucugagaaaaacgaaacuuggaagcuggcucgggccagcuuuauugaggugaagacauguaucuggccacgaucccacacccuauggucaaauggaguacuggaaagcgagaugauaauccccaaaauuuacggcgguccuaucucucaacauaacuauagaccaggcuacuucacucagacagcagggccguggcaccucggaaagcuggagcuugauuucaauuugugcgaaggcaccacggucgugguggacgagcacugcgggaacaggggacccucccugcgcacuaccacagucaccggcaaaauuauccaugaaugguguugccggaguuguacuuuaccuccacucagauuuaggggugaggaugggugcugguacggaauggagauacgccccguuaaggaaaaagaggaaaaucuggugcgaagcaugguaucugcgggcuccggugagguggacucauucagucuuggccuguugugugucagcauuaugaucgaagaggugaugcggucgcguugguccaagaagaugcucaugacagggacccuggccguauuuuuccuacugaucaugggacagcucacauggaacgaccugauuagacuuugcaucauggugggcgcuaaugucucugauaggauggggaugggaacuaccuauuuggcccugauggcaacguuuaaaaugcgcccuauguucgcugugggcuuacucuuucggagacugacaagcagggagguucuucugcuaaccauuggucucucacugguggccagugucgaauugccaaacucccuggaggaauuaggggacggacucgcaaugggcauaaugaugcugaaacuucugacugauuuccaaucucaccaguuguggaccacacuccugagccuaacuuuuaucaaaaccacgcugucccuugacuacgccuggaagacaauggcuaugguacucucaauugugagccuguuccccuugugucugaguaccacuucucagaaaacaaccugguuaccgguucuccugggcuccuuugggugcaagccucuuacuauguuccugaucacagagaacaagauuuggggacgaaaaagcuggccauugaaugaagguaucauggcggugggcauagucucgauccuccugucaucucuacugaagaacgaugugccccuugccgggccucucauugcaggaggcaugcugaucgcuuguuauguaauuagugguuccagcgccgacuugucuuuagagcgcgccgcugaggugagcugggaagaggaagcagagcauuccggggccucacacaauauccuggucgaaguucaggaugacggaaccaugaaaauaaaggaugaggagcgggacgauacgcucacuauucugcuuaaagcgacccuguuggcugugaguggcguguaccccaugagcaucccagccacacuauuugucugguauuucuggcaaaagaaaaagcagagaucuggcgugcugugggacaccccuucacccccagaaguugagagggcaguacucgaugacgggaucuaccguauucugcagcgcggacuuuuaggucggagccaggugggcgucgggguguuccaagacggaguuuuucauacaauguggcacgugacuagaggcgccguccugauguaucaggguaagaggcucgaaccgaguugggcuagcgugaaaaaggauuugauauccuacgggggaggcuggcgauuccagggcucuuggaacaccggggaggagguacaggucaucgcaguggaaccuggcaaaaaucccaagaacguucaaacgacaccagguacuuuuaaaacccccgagggcgaagugggggccauugcgcuggacuucaagccuggaacaucgggcagcccaaucgucaaucgggaggguaagauuguggggcucuacggaaacggcguugugaccacuucaggcaccuaugucuccgcuaucgcccaggcaaaagccagucaggaagggccccugccugagauagaggaugaaguguuuaagaaacgcaaucuuacaaucauggaccugcacccgggaucugguaagacgagaagguacuugccagcuauuguacgggaggccaucaaacgaaagcuaagaacucugauucucgcacccacccgcgugguugcuagcgaaauggccgaggcguuaaagggcaugccuaucagguaucaaacaaccgccgucaaauccgaacauacugggaaggagauaguggaucugaugugccacgcaacauucaccaugcgucuucugucaccagugcggguccccaacuacaauaugauuaucauggacgaggcucauuuuacggauccugccucuaucgcugcaagaggauauauuagcacuaggguaggcaugggugaagccgccgcuaucuucaugacagcgaccccgcccgggaguguggaggcauuuccacaguccaacgccguuauacaggacgaagaacgcgauauuccugaacgaagcuggaacucuggauacgacuggaucaccgauuuccccggcaaaacugugugguuugucccaucaauuaaguccggcaacgacaucgcuaauugucucaggaaaaaugggaagcgggugauacaguugaguaggaagacauucgacaccgaguaucagaaaacaaagaacaaugauugggacuacguugugacuacggauauuagcgagaugggagccaacuuccgcgcagaccgugucaucgauccuagacggugccugaaacccgugauccucaaggacgguccagaaaggguaauucuggccggcccgaugccugugaccgcugcgucggccgcacagcgccgagggagaaucggacggaaucagaacaaagagggcgaucaguacauuuauaugggucaaccccuuaauaacgacgaagaucacgcucauuggacagaggccaagaugcuacuggacaauauaaacacuccagaggggaucauucccgcauuguuugaaccugagagggaaaagucugccgcuaucgauggcgaguaccgcuuaagaggagaagccaggaaaaccuucguugagcugaugcggcguggcgaccucccagucuggcuguccuauaagguggcgagcgagggguuucaguacucagaucgccgauggugcuucgacggagaaagaaauaaccaggugcuugaggaaaauauggacgucgagaucuggacaaaagaaggugagaggaagaaacugcggccccgcuggcucgaugcaagaaccuauagugacccuuuggcccugagggaguuuaaggaguucgcugccggccggcgaucuguuuccggggaucuaauucuggagauaggaaaacucccgcagcaccuuacucugagagcucaaaacgcauuagacaauuuggugaugcugcacaacagcgaacagggcgguaaggccuaccgccaugcuauggaggaacucccagauacgaucgagacccugaugcuucuggcccucauugcaguauugacagggggcgugacucuguuuuucuuaucaggaaagggccuagggaaaaccaguaucggacugcucugugucauggcgagcuccgugcuucuguggauggccucuguugagccccacuggauugcugccagcaucauauuggaauuuuuccugauggugcuccugaucccugagcccgacaggcagcggacaccacaggauaaucaacuugcauaugucguaauuggucuccuguuuaugaucuugaccguggcugccaacgaaaugggccuguuagagacuacaaagaaagaccuagggauuggacauguuguggcagagaaccaccaccaugccacgaugcuggauaucgaccuccacccugcuuccgcguggacccuuuacgccgucgcaacuacaauaauuacccccaugaugcgucauaccaucgaaaauacaacugcuaacauuucacugacggccaucgccaaucaggcagcuauauugaugggccuggauaaggguuggccaaucucuaaaauggacauuggggugccucuccuggcccuuggcugcuacagucaggucaacccguuaacccugacagcggcugugcucauguugguugcccacuaugcaaucauuggacccggccugcaagccaaggcuacuagagaggcacagaagaggaccgccgcggggaucaugaaaaauccaacaguggauggaauaguagcuauugaccuagacccuguggucuacgaugccaaguucgaaaaacagcugggccagaucaugcuccuuauccuguguaccucgcaaauuuugcugaugcgcacuacgugggcacucugcgagagcaucacacuggccaccggucccuuaacuacccuuugggaaggguccccaggaaaguuuuggaacacaacuauagcuguuucuauggccaauauuuuccggggcucauaucuggcaggagcuggccucgccuucagccuaaugaaaucccuaggggguggccgaagagggaccggagcgcagggcgagacauugggugagaaguggaagaggcagcugaaccagcucaguaaaucugaauuuaauacguacaagcgcagcgggaucauggagguggaccggucagaagccaaagagggacuuaagagaggcgaaaccacuaaacaugcagucucccgugguacagcuaagcugaggugguucguggagcggaacuugguaaagccugagggcaaagugauugaucugggguguggacgcggcggguggaguuauuacugcgccggacucaagaaaguuaccgaagugaagggcuauacuaaaggugggcccggacacgaggaaccgaucccaauggcaacauacggcuggaauauagucaaguuacacagcggccgagacguguuuuucaccccucccgagaaaugugauacgcugcuuugcgacaucggggaaucuuccccaaaccccaccauugaggagggaagaacacugaggguccuaaagaugguggaaccuuggcuccgggguaaucaauuuuguaucaagauucugaacccguacaugcccucaguuguagagacuuuggaacagaugcagcgcaaacauggcgggaugcuggugagaaauccacucagcaggaacucgacccacgagauguauugggucucuugcggaacaggcaauaucgugagugcuguuaacaugacuucccgaaugcuucugaaccgguucaccauggcccaucguaagccuacauacgagagagauguggacuuaggugccgggacccgccacgucgcgguggaacccgagauugcuaaucuggauaucauaggacagaggauugaaaacaucaaaaaugagcacaagagcacuuggcauuaugacgaagauaacccuuacaaaacgugggcauaucacggcucauacgagguaaagccauccggcucugccagcaguauggugaaugggguuguccgguugcucacaaagcccugggacgugaucccuauggugacccaaauugcuaugacugacaccacaccauuuggacagcagagagucuucaaagagaagguugauacgcgcacccccaggccgaaacgagguacugcccaaauaauggaagugacagcaaaguggcuguggggcuuucuaucccggaacaaaaagccuagaaucuguaccagggaggaguucacucgcaagguacguagcaaugccgcuauuggggcgguguuugucgacgagaaccaguggaacucugccaaagaagcaguggaggaugagcgguucugggaccuuguucauagagaaagggagcugcacaagcagggaaaaugcgcuacaugcguguauaacaugaugggcaagcgcgagaaaaagcucggugaguuugggaaggccaaaggaucacgagcaaucugguacauguggcugggcgcccgguucuuggaguucgaggcucugggcuuuaugaaugaggaucauugguucaguagagaaaacucccucagcggggucgagggagaaggucuucacaagcugggcuacauuuuaagggacaucucuaaaauaccagggggaaauauguaugccgaugacaccgcgggcugggauacacgcaucacugaggacgaucugcagaacgaggcaaagauuaccgacaucauggaacccgagcacgccuugcucgcuacgucgauuuuuaaacugaccuaccaaaauaaggugguaagaguucagcggccugccaaaucagguacagugauggaugucaucagcaggcgugaccagcgaggguccggacaggugggcacuuauggccuaaacaccuucacaaacauggaagugcaacuuauacgccagauggagagugaagggauauuuucuccaagcgagcuggaaaauuccaaccucgcagaaagaguccuggacugguuggagaagcauggaguugaacgguuaaagaggauggcuaucucaggugaugacugugugguaaaacccacugaugaccgcuucgccaccgcucugacggcccucaaugauaugggcaaggugagaaaagacaucccgcagugggagccuaguaagggguggaacgauuggcagcaaguccccuuuugcucucaccauuuccaccagcuuauuaugaaagacggacgggaaauagugguuccauguaggaaucaggaugagcuggugggccgagcacgugucagccagggugcgggguggucccuaagagagacagccugccugggaaagucauacgcucaaauguggcagcucauguauuuucaccgccgggacuugaggcuggccgcaaacgcuaucuguagcgccgugccuguaaauuggguucccaccucuagaacuacaugguccauucaugcacaccaucaguggaugaccacugaagauaugcuuaguguguggaaccgcgucuggaucgaggaaaauccauggauggaggacaagacccacgugagcucgugggaagacguucccuaccugggcaaacgggaggaucaauggugcggcucccucauuggguuaacagccagggcgacgugggcuaccaacauccagguggccauaaaucagguccgaagacugaucggaaacgagaauuauuuggacuacaugacuucuaugaagcgguucaaaaacgaaucagauccugagggugcacugugguga

SEQ ID NO: 14213 - RNA, 9879 nt, Artificial Sequence
  derived and/or modified CDS sequence (opt3) from DENV-1__KM403582__SS-prME
agcgugaccaugcugcucaugcuucugcccacagcauuggcuuuccacuuaacuacgagaggaggggaaccucauaugaucgucuccaagcaagaaaggggaaaaucucuguuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagaccguagaagcguggcccuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauuuucaucuuacugaugcuugugacgccaucaauggccaugaggugcgucgggauuggaaaccgggauuuuguggaggguuugagcggcgcgacuuggguagacguugugcuggagcacgggaguugugucacaaccauggccaagaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagaacaagaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacguacuggacuagauuucaacgaaaugguccugcucacaaugaaggagaaaagcuggcuggugcauaagcagugguuucuugaccugccguugcccuggacgucuggcgcauccaccucacaagagacuuggaaucgccaggaucuccugguaacauucaaaaccgcucacgccaagaaacaggaaguuguggucuuagguagccaagagggggcuaugcacacagcccugacuggcgcaaccgaaauccagacgaguggaaccacaacuauuuuugccggccaucuaaagugcagacucaagauggacaaacugacccuuaagggggugucuuaugucauguguacaggauccuucaaauuggagaaggaaguggcugagacucagcacgguaccguucuggugcagguaaaauacgagggcacggaugcgccuugcaagauaccaaucagcacacaagacgaaaagggggucacccagaacggaaggcucauuacugcaaaucccaucgugacagauaaagagaagccuguuaacauagaaaccgagccacccuucggcgagucguauauugugaucggugccggggaaaaagcucugaaacuuucuugguuuaaaaagggcuccucaaucggaaagauguucgaggccacugcacggggcgcccgacgcauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagcagaucaacaagucucuccaugaccuguauugcggugggcauggugacacuguaccuuggggucaugguucaggcugacagcggaugcgugaucaacuggaaaggcagggaauugaagugugguucugggaucuuugugacuaacgagguacacaccuggacggaacaauauaaauuccaggccgauucaccgaagcggcugagugcagccauuggaaaggcuugggaggagggcgucugcgguauacgcagcacaaccagacucgaaaauaucauguggaaacagauuuccaacgagcugaaucauaucuuacuggaaaacgacaugaaguuuacugugguugugggcgacgccaaugggauucuuacccagggcaagaagaugaucaggccucaacccauggagcacaaauacucuuggaagucguggggcaaagcaaagauaaucggggcugauacacagaacacuaccuucauuaucgacggaccagauacaccugaaugucccgacgaucagcgugccuggaauauuugggaggucgaggacuauggcuuugguguguucacgaccaacaucugguugaagcuccgggauagcuacacucagaugugcgaccaccgacugauguccgcggccauaaaagauucaaaggcuguucaugcagacaugggguauuggauugaaagugagaaaaaugaaacauggaagcuagccagagcuucuuuuaucgaggugaaaaccuguauuuggccaaggagccacacucugugguccaacggaguacucgaaucagagauggucauccccaagauauacggcgguccuaucagccaacauaauuaucgcccaggcuacuucacacagaccgccgggccguggcaccugggaaaacuugaguuggauuucaaccugugcgaaggcacgacugugguggucgacgagcacugcgggaaucggggacccucuuuaagaaccacaaccguuacuggcaaaauuauccaugaaugguguugcagguccuguacacucccuccacugcgcuuucgaggugaggaugggugcugguacggaauggagauucggcccgugaaggaaaaagaggaaaaccuuguacguaguauggugagcgcaggcucuggugaggucgacuccuucucacugggcuugcucugugugaguaucaugauagaagagguuaugagaagcagauggucgcgcaagaugcugaugaccgggacacuagcgauauuuuuccugcucaucaugggacagcugacuuggaaugaccuuauccgguugugcauuauggugggcgccaacgucuccgauagaauggggaugggaaccacguaucuggcuuuaauggccacauuuaaaaugaggccuauguucgcagugggccuccuguuucgacgccuuaccucucgggagguucugcuacucacuaucggucugagcuugguggcuucagucgaacugccaaacaguuuagaggaacucggggacggacuggccaugggcauuaugaugcuuaagcuguugaccgauuuccaaucccaccagcucuggacaacucugcuaucucugaccuuuauaaagacgacacuuagccucgacuacgcauggaaaaccauggccaugguacuguccaucgugucauuguucccccuguguuuaagcacuacaagucagaagaccacuuggcucccgguucugcuuggcucuuuugggugcaaaccucugacaauguucuugauuaccgagaauaagaucuggggaagaaaauccuggccacucaacgaagguauuauggcugugggcaucgucagcauacugcuaucgucacugcuuaagaaugaugugccccucgcggggccucugaucgccggaggcauguugauugcauguuauguaaucucugguaguuccgcugacuuaagccuggagagggccgccgaggugucuugggaagaggaagcugagcauagcggggcaucccacaacauucucgucgaaguucaggaugacggaacgaugaagaucaaagaugaggagcgugacgauacucugaccauacuucugaaggccacauugcuagcggugucaggcguguaccccaugaguauuccagcuacccuguuugucugguauuucuggcagaagaagaaacagcgcagcggcgugcucugggacacaccuucucccccagaaguugagcgggccguacuggaugacgggaucuacagaauccuucagaggggauuacugggucgaucccaggugggcgucgggguguuccaagacggaguuuuucauacuauguggcacgugacccggggcgcaguccucauguaucaggguaagcgcuuggaaccgucaugggccagugugaaaaaggaucugauuagcuacgggggaggcuggagauuccagggcuccuggaauacgggggaggagguacaggucauagcuguggaaccuggaaagaaccccaaaaauguucaaacaacuccagguaccuuuaagacacccgagggcgaagugggggcaaucgcccucgacuucaaaccuggaaccucuggcucgccaauugucaacagggaggguaagaucguggggcuguacggaaauggcguugugacuaccagcggcacauaugucucagcgauugcucaggccaaagcaucccaggaagggccccuuccugagaucgaggaugaaguguuuaagaagcggaaccugacgauaauggacuugcacccgggaagugguaaaacucgaagauaccuaccagccaucguacgcgaggcuauuaagaggaaacugcguacccucaucuuagcccccacacgggugguugcaucugaaauggcugaggcccugaagggcaugccuauuagauaucaaaccacugcggucaaaagcgaacauacagggaaggagaucguggaucuuaugugccacgccaccuucacgaugaggcugcucuccccagugcgcguccccaauuacaacaugauaauuauggacgaggcacauuuuacugauccugcuucaaucgccgcucgaggauauaucucuacaagaguaggcaugggugaagcagccgccauuuucaugaccgcuaccccgcccgggagcguggaggcguuuccacagaguaaugcaguuauccaggacgaagaacgggauauaccugaaagguccuggaacagcggauacgacuggauuacugauuuccccggcaagacagugugguuugucccaucuaucaaaucaggcaaugacauugccaacuguuugcgcaagaacgggaaacgugugauccagcuguccagaaagaccuucgacacagaguaucagaagacuaagaauaacgauugggacuacguugugacgaccgauauaagugagaugggagcuaauuuccgggccgacagggucauugauccucgccgaugccucaagcccgugauccugaaagacgguccagaaagaguaauccuugcaggcccgaugccugugacagccgcuagcgcggcccagcggagggggcgcauuggaagaaaccagaauaaggagggcgaucaguacaucuauaugggucaaccccuaaacaaugacgaagaucacgcacauuggacugaggcuaaaaugcuguuggacaacauuaauaccccagaggggauaauccccgccuuauuugaaccugagagggaaaagucggcagccauugauggcgaguaccggcugcguggagaagcucgcaaaacauucguugagcucaugcgaagaggcgaccugccagucuggcuuucuuauaagguggccuccgagggguuucaguacagcgauaggcgguggugcuucgacggagaacgcaacaaucaggugcuggaggaaaacauggacgucgagaucuggaccaaggaaggugagaggaaaaagcucaggccccggugguuggaugcgcgaacuuauucagacccucuggcacuaagagaguuuaaagaguucgccgcuggccgcaggaguguuucuggggaucugauccucgagauuggaaaacuuccgcagcaccugacguuacgggcccaaaaugcuuuggacaaccuggugaugcuccacaauuccgaacagggcgguaaagcauaccgucaugccauggaggaacugccagauaccauagagacacuuaugcugcucgcuuugaucgccguacugacugggggcgugaccuuauuuuuccuaagcggaaagggccuggggaaaacaucaauuggacuccuuugugucauggcaaguagcgugcuguuguggauggcguccguugagccccacuggaucgccgcuucuauuauccuggaauuuuuccucauggugcugcuuauaccugagcccgacagacagaggaccccacaggauaaccaacucgccuaugucguaaucggucuguuguuuaugauucugacuguggcagcuaacgaaaugggcuuacuagagacaacgaagaaggaccuggggaucggacauguuguggccgagaaucaccaccaugcaaccaugcucgauauugaccuucacccugccagcgcuuggacucuguacgcggucgccacaaccaucauaacccccaugaugcgccauacaauugaaaacacuacggcaaauaucuccuugaccgcuauugccaaccaggccgcaauccugaugggccucgauaaagguuggccaauaucaaagauggacaucggggugccucugcuugcuuuaggcugcuacucucaggucaauccgcugacacucacugccgcgguguugaugcugguugcucacuaugccauuaucggacccggccuacaagcaaaagccacccgggaggcucagaagcgaacagcagccgggauuaugaaaaacccaaccguggauggaaucguagcgauagaccuggacccuguggucuacgaugcuaaguucgaaaagcagcucggccagauuaugcuucugaucuuguguacgagucaaauccugcucaugagaacuacaugggcccugugcgagucgauuaccuuagcaacugguccccuuaccacacugugggaagggagcccaggaaaauuuuggaauacuaccaucgccguuuccauggcuaacauauucaggggcucuuaucucgccggugcaggccuagcuuucucacugaugaaaagccuagggggaggccgccgggggacaggagcccagggcgagacgcugggugagaaauggaagagacagcucaaucagcuuuccaaaagugaauuuaacaccuacaagcguucugggauuauggagguggacaggagcgaagcgaaggagggacugaaacggggcgaaacuacaaagcaugccgucucacgcgguaccgcaaaauugcgaugguucguggagagaaaucugguaaagccugagggcaaagugaucgaucucggguguggaaggggcgggugguccuauuacugcgcuggauuaaagaagguuacugaagugaaaggcuauacaaagggugggcccggacacgaggaaccgauuccaauggccaccuacggcuggaacaucgucaaacugcacaguggccgggacguguuuuucacgccucccgagaagugugauacccuucugugcgacauaggggaaagcucuccaaaucccacaaucgaggagggacgcacucuaagaguccucaaaaugguggaaccuuggcugagggguaaccaauuuuguauuaagaucuugaauccguacaugcccuccguuguagagacccuggaacagaugcagcgaaaacauggcgggaugcucgugcggaacccacuuucacguaauagcacacacgagauguauugggucucgugcggaacuggcaacauugugucugcaguuaacaugaccaguagaaugcuguuaaaucgcuucacaauggcucauaggaagccuaccuacgagcgggauguggaccugggugccgggacuagacacgucgccguggaacccgagacggcgaacuuggauaucauuggacagcgcaucgaaaauauaaagaacgagcacaaauccacauggcauuaugacgaagauaauccuuacaagaccugggcuuaucacggcagcuacgagguaaaaccaucaggcuccgcaucuagcauggugaacgggguugucaggcuccugacuaagcccugggacgugauuccuauggugacccaaaucgccaugacagacacgaccccauuuggacagcagcgagucuucaaagagaagguugauacucggacacccagaccgaagagggguaccgcucaaaucauggaagugacugccaaauggcuauggggcuuucuuagucgcaauaagaaaccucguauuuguacacgggaggaguucaccagaaagguaagguccaacgcagccauaggggcuguguuugucgacgagaaucaguggaacagcgcgaaagaagccguggaggaugagcgcuucugggaccugguucaucgagaacgggagcuccacaagcagggaaagugcgcaacaugcguguauaauaugaugggcaaaagagaaaagaaacugggugaguuugggaaggcuaaaggaucuagggccaucugguacaugugguugggcgcacgcuuccuggaguucgaggcccucggcuuuaugaacgaggaucauugguucucaagagaaaauagucuuuccggggucgagggagaaggucugcacaaguuaggcuacauucugcgggacaucagcaagauuccagggggaaacauguaugcugaugacacugccggcugggauaccaggaucacggaggacgauuugcagaaugaggcgaaaauaaccgacaucauggaacccgagcacgcacuccuggccacaucuauuuuuaagcuaacuuaccaaaacaaagugguacguguucagcgaccugcuaagucggguaccgugauggaugucaucucacgcagagaccagcgggggagcggacaggugggcacauauggccuuaacacuuucaccaauauggaagugcaacugauuaggcagauggaguccgaagggaucuuuaguccaucugagcucgagaacagcaaucuggccgaacgcgucuuggacugguuagagaaacauggaguugaaagacugaagcggauggcaauauccggugaugacugugugguaaaacccacggaugacagguucgcuacagcccucaccgcucuuaacgauaugggcaaggugcgaaaggacauuccgcagugggagccuucaaaaggguggaaugauuggcagcaaguccccuuuugcagucaccauuuccaccagcugaucaugaaggacggacgugaaaucgugguuccauguagaaaccaggaugagcuagugggccgcgcccgggucucucagggugcaggguggagccugagggagacugcgugccucggaaaauccuacgcccaaauguggcaguugauguauuuucacagacgcgaccugcggcuugcugccaaugcaauuuguucagcugugccuguaaacuggguucccacaagcaggaccacuuggucuauacaugcccaccaucaguggaugaccacagaagauaugcuguccguguggaaucgagucuggaucgaggaaaacccauggauggaggacaagacgcacgugaguagcugggaagacguucccuaccucggcaaaagagaggaucaauggugcggcucguuaauugggcugaccgcacgggccacuugggcgacaaauauccagguggcuauuaaccaggucaggcgcuugaucggaaaugagaacuaucuggacuacaugaccuccaugaagcguuucaagaaugaaucugauccugagggugcccucugguga

SEQ ID NO: 14214 - RNA, 9879 nt, Artificial Sequence
  derived and/or modified CDS sequence (opt3) from DENV-1__KM403577__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagagcaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaagggggugucuuaugucauguguacaggauccuucaaacuugagaaggaaguggcugagacucagcacgguaccguuuuggugcagguaaaguacgagggcacggaugcgccuugcaaaauaccaaucagcacacaagacgaaaagggggucacccagaacggacgccugauuacugcaaaucccaucgugacagauaaagagaagccuguuaacauagaaaccgagccacccuuuggcgagucguauauugugaucggugccggggaaaaagcucucaagcugucuugguucaagaaaggcuccucaaucggaaagauguuugaggccacugcaagaggcgccaggcggauggcuauucuuggggacaccgccugggauuucggaaguaucgguggcgucuuuacaagcguggggaaacugguacaucagguguucggaacggcauacggcguuuuguuuuccggugucucuuggaccaugaagauugggauaggcauccuccugacuugguuaggacugaauagccgaucaacaagucuauccaugaccuguauugcggugggcauggugacacucuaccugggggucaugguucaggcugacagcggaugcgugaucaacuggaaaggccgcgaacuuaagugugguucugggaucuucgugacuaacgagguacacaccuggacggaacaauauaaguuucaggccgauucaccgaaaagauugagugcagccauuggaaaggcuugggaggagggcgucugcgguauaaggagcgccacacggcuggaaaauaucauguggaaacagauuuccaacgagcucaaucauauccuguuagaaaacgacaugaaguucaccgugguugugggcgacgcaaaugggauucugacucagggaaaaaagaugauccgcccucaacccauggagcacaaauacucuuggaagucguggggcaaggcuaaaauaaucggggccgauacccagaacacaacuuuuauuaucgacggaccagauaccccugaaugucccgacgaucagagagcguggaauauuugggaggucgaggacuauggcuucgguguguuuacaacgaacaucuggcuuaaguugagggauagcuacacccagaugugcgaccaccgucucauguccgccgcuauaaaagauucaaaggcaguucaugccgacaugggguauuggauugaaagugagaaaaaugaaacuuggaagcuggcucgggccucuuucaucgaggugaagacauguauuuggccacgaagccacacccuaugguccaacggaguacuggaaucagagaugaucauacccaaaaucuacggcgguccuauuagccaacauaauuauagaccaggcuacuucacucagacagcagggccguggcaccucggaaagcuggagcuugauuuuaacuugugcgaaggcaccacggucgugguggacgagcacugcgggaauaggggacccucucugcgcacuaccacagucaccggcaaaaucauucaugaaugguguugccgguccuguacuuuaccuccacucagauucaggggugaggaugggugcugguacggaauggagauccgccccguuaaggaaaaagaggaaaaccuggugcgaaguaugguaagcgcgggcucuggugagguggacuccuuuucacuuggccuguugugugucaguauaaugauugaagaggugaugcggagccguuggucgagaaagaugcucaugacagggacccuggccguuuucuuucuacugaucaugggacagcucacauggaaugaccugaucaggcuuugcauuauggugggcgcuaacgucuccgaucgcauggggaugggaacuaccuauuuggcccugauggcaacguucaagaugcggccuauguuugcugugggcuuacucuucagaaggcugacaucucgagagguucuucugcuaaccaucggucucagccugguggccucagucgaauugccaaacagucuggaggaauuaggggacggacucgcaaugggcauuaugaugcugaaacuucugacugauuuucaaucccaccaguuguggaccacacuccugucucuaacuuucauaaagaccacgcugagccuugacuacgccuggaaaacaauggcuaugguacucuccaucgugucacuguuucccuugugucugagcaccacuagucagaagacaaccugguuaccgguucuccugggcucuuucgggugcaaaccucuuacuauguuucugauuacagagaauaagaucuggggacgcaaguccuggccauugaacgaagguauuauggcggugggcaucgucagcauacuccugucgucacuacugaaaaaugaugugccccuugccgggccucucaucgcaggaggcaugcugauugcuuguuauguaaucucugguaguuccgccgacuugagcuuagagcgggccgcugaggugucuugggaagaggaagcagagcauagcggggccucccacaacauucuggucgaaguucaggaugacggaaccaugaagaucaaagaugaggagagagacgauacgcucacuauacugcuuaaggcgacccuguuggcugugucaggcguguaccccaugaguauuccagccacacuauucgucugguauuucuggcaaaaaaagaaacagaggagcggcgugcugugggacaccccuucucccccagaaguugagcgugcaguacucgaugacgggaucuaccgcauccugcagcggggacuuuuagguagaucccaggugggcgucgggguguuucaagacggaguuuuccauacaauguggcacgugacuaggggcgccguccugauguaucaggguaagcgacucgaaccgucaugggcuagugugaagaaagauuugauuagcuacgggggaggcuggcgguuucagggcuccuggaauaccggggaggagguacaggucauagcaguggaaccuggaaagaaccccaaaaauguucaaacgacaccagguacuuucaagacccccgagggcgaagugggggccaucgcgcuggacuuuaaaccuggaacaucuggcucgccaauugucaaccgcgaggguaagaucguggggcucuacggaaauggcguugugaccacuagcggcaccuaugucucagcuauugcccaggcaaaggccucccaggaagggccccugccugagaucgaggaugaaguguucaaaaagagaaaccuuacaauaauggaccugcacccgggaagugguaaaacgaggcgguacuugccagcuaucguacgagaggccauuaagagaaaacuacgcacucugauccucgcacccaccagggugguugcuucugaaauggccgaggcguuaaagggcaugccuauucguuaucaaacaaccgccgucaagagcgaacauacugggaaagagaucguggaucugaugugccacgcaacauuuaccaugcggcuucuguccccagugagaguccccaauuacaacaugauaauuauggacgaggcucauuucacggauccugccucaaucgcugcaaggggauauaucucuacucgcguaggcaugggugaagccgccgcuauuuuuaugacagcgaccccgcccgggagcguggaggcauucccacagaguaaugccguuauccaggacgaagagcgagauauaccugaaagauccuggaacagcggauacgacuggauuaccgauuuucccggcaagacugugugguucgucccaucuaucaaaucaggcaaugacauugcuaacugucuccggaagaacgggaaaagggugauccaguugucccgcaagacauucgacaccgaguaucaaaagacaaaaaauaacgauugggacuacguugugacuacggauauaagugagaugggagccaauuuucgugcagacagagucauugauccucggaggugccugaagcccgugauccucaaagacgguccagaacgcguaauccuggccggcccgaugccugugaccgcugcgagcgccgcacagcgaagagggcggauuggaaggaaccagaauaaggagggcgaucaguacaucuauaugggucaaccccuuaacaaugacgaagaucacgcucauuggacagaggccaaaaugcuacuggacaacauuaauacuccagaggggauaauccccgcauuguucgaaccugagcgcgaaaagucggccgcuauugauggcgaguacagauuaaggggagaagcccggaagaccuuuguugagcugaugcgucgcggcgaccucccagucuggcugucuuauaaaguggcguccgagggguuccaguacagcgaucgaagauggugcuuugacggagaaaggaacaaucaggugcuugaggaaaacauggacgucgagaucuggacaaaggaaggugagcggaaaaagcugcgccccagauggcucgaugcaaggaccuauucagacccuuuggcccugcgggaguucaaagaauuugcugccggccgaagaaguguuucuggggaucuaauccuggagauuggaaagcucccgcagcaccuuacucugcgcgcucaaaaugcauuagacaacuuggugaugcugcacaauuccgaacagggcgguaaagccuacaggcaugcuauggaggaacucccagauacgauagagacccugaugcuucuggcccucaucgcaguauugacagggggcgugacucuguucuuuuuaagcggaaagggccuagggaagaccucaauuggacugcucugugucauggcgaguagcgugcuucuguggauggccuccguugagccccacuggaucgcugccucuauuaucuuggaauucuuucugauggugcuccugauaccugagcccgaccggcagcguacaccacaggauaaccaacuugcauaugucguaaucggucuccuguucaugauuuugaccguggcugccaacgaaaugggccuguuagagacuacaaaaaaggaccuagggaucggacauguuguggcagagaaucaccaccaugccacgaugcuggauauugaccuccacccugcuagcgcguggacccuuuacgccgucgcaacuacaaucauaacccccaugaugagacauaccauugaaaacacaacugcuaauaucucccugacggccauugccaaccaggcagcuaucuugaugggccuggauaaagguuggccaauaucaaagauggacaucggggugccucuccuggcccuuggcugcuacucucaggucaauccguuaacccugacagcggcugugcucauguugguugcccacuaugcaauuaucggacccggccugcaagccaaagcuacuagggaggcacagaagcgcaccgccgcggggauuaugaagaacccaacaguggauggaaucguagcuauagaccuagacccuguggucuacgaugccaaauuugaaaagcagcugggccagauuaugcuccuuauccuguguaccagucaaaucuugcugaugcggacuacgugggcacucugcgagucgauuacacuggccaccggucccuuaacuacccuuugggaagggagcccaggaaaauucuggaauacaacuaucgcuguuuccauggccaacauauuccgaggcucuuaucuggcaggugcuggccucgccuuuucacuaaugaagagccuggggggaggcagaagggggaccggagcgcagggcgagacauugggugagaaauggaagcgccagcugaaucagcucuccaagagugaauucaacacguacaaacggucugggauuauggagguggacagaagcgaagccaaggagggacuuaaacguggcgaaaccacuaagcaugcagucucaagggguacagcuaaacugcggugguuuguggagcgcaauuugguaaagccugagggcaaggugaucgaucugggguguggacgaggcgggugguccuauuacugcgccggacucaaaaagguuaccgaagugaaaggcuauacuaagggugggcccggacacgaggaaccgauuccaauggcaacauacggcuggaacaucgucaaauuacacaguggcagagacguguucuuuaccccucccgagaagugugauacgcugcuuugcgacauaggggaaagcucuccaaaucccaccaucgaggagggaaggacacugcggguccuaaaaaugguggaaccuuggcuccgcgguaaccaauucuguauuaagauccugaauccguacaugcccuccguuguagagacuuuggaacagaugcagagaaagcauggcgggaugcuggugaggaacccacucucacgaaauagcacccacgagauguauugggucucgugcggaacaggcaacauugugucugcuguuaacaugacuagucggaugcuucugaaucguuuuaccauggcccauagaaaaccuacauacgagcgcgauguggacuuaggugccgggaccaggcacgucgcgguggaacccgagaucgcuaaccuggauauuaucggacagcggauagaaaauauuaagaacgagcacaaauccacuuggcauuaugacgaagauaauccuuacaagacgugggcauaucacggcagcuacgagguaaaaccaucaggcuccgccucuagcauggugaacgggguugucagauugcucacaaagcccugggacgugaucccuauggugacccaaaucgcuaugacugacaccacaccauucggacagcagcgcgucuuuaaggagaaaguugauacgaggaccccccgaccgaagcgggguacugcccaaauuauggaagugacagcaaaauggcuguggggcuuccuaaguagaaauaagaaaccuaggauauguacccgcgaggaauuuacucguaagguacgguccaacgccgcuaucggggcgguguucgucgacgagaaucaguggaacagcgccaaggaagcaguggaggaugagagauuuugggaccuuguucauagggaacgcgagcugcacaaacagggaaagugcgcuacaugcguguauaauaugaugggcaaacgagaaaagaaacucggugaguucgggaaggccaagggaucucgggcaauuugguacauguggcugggcgccagauucuuggaauuugaggcucugggcuucaugaacgaggaucauugguuuucaagggaaaauagucucuccggggucgagggagaaggucuucacaaacugggcuacaucuuacgcgacauuagcaagaucccagggggaaacauguaugccgaugacaccgcgggcugggauacaagaauaacugaggacgaucugcagaaugaggcaaaaaucaccgacauuauggaacccgagcacgccuugcucgcuacgucuaucuucaagcugaccuaccaaaacaaagugguacggguucagaggccugccaagucggguacagugauggaugucauuucacgucgagaccagcgcgggagcggacaggugggcacuuauggccuaaacaccuuuacaaauauggaagugcaacuuaucagacagauggaguccgaagggauauucaguccaucugagcuggagaacagcaaucucgcagaacggguccuggacugguuggagaaacauggaguugaaagguuaaagcgcauggcuauuuccggugaugacugugugguaaagcccacugaugacagauuugccaccgcucugacggcccucaacgauaugggcaaagugcggaaggacaucccgcagugggagccuucaaaaggguggaaugauuggcagcaaguccccuucugcagucaccauuuucaccagcuuaucaugaaggacggaagggaaauugugguuccaugucgaaaccaggaugagcuggugggccgugcaagagucucucagggugcgggguggagccuacgcgagacagccugccugggaaaauccuacgcucaaauguggcagcucauguauuuccaccggagggacuugagacuggccgcaaaugcuauauguucagccgugccuguaaacuggguucccaccagccgcacuacauggucuauccaugcacaccaucaguggaugaccacugaagauaugcuuuccguguggaaucgggucuggauugaggaaaacccauggauggaggacaagacccacgugaguagcugggaagacguucccuaccugggcaagagggaggaucaauggugcggcucgcucaucggguuaacagcccgagcgacgugggcuaccaauauucagguggccaucaaccaggucagacggcugauaggaaaugagaacuauuuggacuacaugacuuccaugaaaagguuuaagaaugaaucugauccugagggugcacugugguga

SEQ ID NO: 14215 - RNA, 9879 nt, Artificial Sequence
  derived and/or modified CDS sequence (opt3) from DENV-1__KM403631__SS-prME
agcgugaccaugcugcucaugcuucugcccaccgcauuggcuuuccacuuaacuacgagaggaggggaaccucauaugaucgucuccaagcaagaaaggggaaaaucucuguuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuauaaacauugaaaccgagccacccuucggcgagucguauaucguuaucggugccggggaaaaagcucugaaacuuucuugguuuaagaaaggcuccucaauuggaaagauguucgaggccacugcaagaggcgccaggcggauggcuauccugggggacaccgccugggauuuuggaaguauugguggcguguucacaagcgucgggaaauuggugcaucagguauuuggaacggcauacggcguacucuucuccgguguuucuuggaccaugaagauagggaucggcauucuguuaacuuggcugggacuaaauagccgaucaacaagucucuccaugaccuguaucgcggucggcauggugacacuguaccuuggggugaugguccaggcugacagcggaugcguuaucaacuggaaaggccgcgaauugaagugugguucugggauuuuugugacuaacgaggugcacaccuggacggaacaauauaaguuccaggccgauucaccgaaaagacugagugcagccauaggaaaggcuugggaggagggcguaugcgguaucaggagcgccacacggcucgaaaauauuauguggaaacagaucuccaacgagcugaaucauauuuuacuggaaaacgacaugaaguuuaccgucgugguuggcgacgcaaaugggauccuuacucagggcaagaagaugauacgcccucaacccauggagcacaaauacucuuggaagucguggggcaaggcuaaaaucauuggggccgauacccagaacacaacuuucaucauugacggaccagauaccccugaaugucccgacgaucagagagcguggaauaucugggagguggaggacuauggcuuuggugucuucacaacgaacauaugguugaagcucagggauagcuacacccagaugugcgaccaccgucugauguccgccgcuauuaaagauucaaaggcagugcaugccgacaugggguauuggaucgaaagugagaaaaaugaaacuuggaagcuagcucgggccucuuuuauugagguuaagacauguaucuggccacgaagccacacccugugguccaacggagugcucgaaucagagaugauaauccccaaaauuuacggcgguccuaucagccaacauaauuauagaccaggcuacuucacucagacagcagggccguggcaccugggaaaacuugaguuggauuucaaccugugcgaaggcaccacgguagucguggacgagcacugcgggaauaggggacccucuuuacgcacuaccacagugaccggcaaaauuauccaugaaugguguugccgguccuguacucucccuccacugagauuuaggggugaggaugggugcugguacggaauggagauacgccccgucaaggaaaaagaggaaaaccuuguucgaaguauggugagcgcgggcucuggugagguagacuccuucucacugggcuugcucugugugaguauuaugaucgaagaggucaugcggagccguuggucgagaaagaugcugaugacagggacccuagccguguuuuuccugcucaucaugggacagcugacauggaaugaccuuauuagguugugcaucaugguuggcgcuaacguguccgaucgcauggggaugggaacuaccuaucuggccuuaauggcaacguuuaagaugcggccuauguucgcugucggccuccuguuuagaaggcuuacaucucgagaggugcugcuacucaccauuggucugagcuugguugccucaguggaacugccaaacaguuuagaggaacucggggacggacuggcaaugggcauaaugaugcuuaaacuguugacugauuuccaaucccaccagcucuggaccacacugcuaucucugacuuuuaucaagaccacgcuuagccucgacuacgccuggaaaacaauggcuaugguccuguccauuguaucauuguucccccuguguuuaagcaccacaagucagaagacaaccuggcucccggugcugcuuggcucuuuugggugcaaaccucugacuauguucuugaucacagagaauaagauuuggggacgcaaguccuggccacucaacgaagguaucauggcgguuggcauagugagcauccugcuaucgucacugcuuaaaaaugaugucccccucgccgggccucugauugcaggaggcauguugaucgcuuguuaugugauuucugguaguuccgccgacuuaagccuggagcgggccgcugagguaucuugggaagaggaagcagagcauagcggggccucccacaacauccucguggaaguccaggaugacggaaccaugaagauaaaagaugaggagagagacgauacgcugacuauucuucugaaggcgaccuugcuagcuguuucaggcguguaccccaugaguaucccagccacacuguuugugugguauuucuggcagaagaagaaacagaggagcggcguccucugggacaccccuucucccccagaaguggagcgugcaguucuggaugacgggaucuaccgcauucuucagcggggauuacuggguagaucccagguaggcgugggggucuuccaagacggaguguuucauacaauguggcacguuacuaggggcgccgugcucauguaucaggguaagcgauuggaaccgucaugggcuagugucaagaaagaucugauaagcuacgggggaggcuggcgguuccagggcuccuggaauaccggggaggaggugcagguaaucgcagucgaaccuggaaagaaccccaaaaaugugcaaacgacaccagguacuuuuaagacccccgagggcgaaguuggggccauugcgcucgacuucaaaccuggaacaucuggcucgccaaucgugaaccgcgaggguaagauugucgggcuguacggaaauggcgugguuaccacuagcggcaccuaugugucagcuaucgcccaggcaaaggccucccaggaagggccccuuccugagauagaggaugaagucuuuaaaaagagaaaccugacaaucauggacuugcacccgggaagugguaaaacgaggcgguaccuaccagcuauugugcgagaggccaucaagagaaaacugcgcacucucauuuuagcacccaccaggguaguggcuucugaaauggccgaggcgcugaagggcaugccuauccguuaucaaacaaccgccguuaagagcgaacauacugggaaagagauagucgaucuuaugugccacgcaacauucaccaugcggcugcucuccccagugagagugcccaauuacaacaugauuaucauggacgaggcucauuuuacggauccugccucaaucgcugcaaggggauauauuucuacucgcgucggcaugggugaagccgccgcuaucuucaugacagcgaccccgcccgggagcguagaggcauuuccacagaguaaugccgugauacaggacgaagaacgagauauuccugaaagauccuggaacagcggauacgacuggaucaccgauuuccccggcaagacuguuugguuugugccaucuauuaaaucaggcaaugacaucgcuaacuguuugcggaagaacgggaaaagggucauacagcugucccgcaagacauucgacaccgaguaucaaaagacuaagaauaacgauugggacuacgugguuacuacggauauuagugagaugggagccaauuuccgugcagacagagugaucgauccucggaggugccucaagcccgucauccugaaagacgguccagaacgcgugauucuugccggcccgaugccuguaaccgcugcgagcgccgcacagcgaagagggcggaucggaaggaaccagaauaaggagggcgaucaguacauuuauaugggucaaccccuaaacaaugacgaagaucacgcucauuggacagaggccaaaaugcuguuggacaacauaaauacuccagaggggaucauucccgcauuauuugaaccugagcgcgaaaagucggccgcuaucgauggcgaguacagacugaggggagaagcccggaagaccuucguggagcucaugcgucgcggcgaccugccaguuuggcuuucuuauaaagucgcguccgagggguuucaguacagcgaucgaagauggugcuucgacggagaaaggaacaaucaggugcuggaggaaaacauggacguggagaucuggacaaaggaaggugagcggaaaaagcuccgccccagaugguuggaugcaaggaccuauucagacccucuggcccuacgggaguuuaaagaguucgcugccggccgaagaagugucucuggggaucugauucucgagauaggaaaacuuccgcagcaccugacuuuacgcgcucaaaaugcauuggacaaccugguuaugcuccacaauuccgaacagggcgguaaagccuacaggcaugcuauggaggaacugccagauacgaucgagacccuuaugcugcucgccuugauugcagugcugacagggggcguaacuuuauuuuuccuaagcggaaagggccuggggaagaccucaaucggacuccuuugugugauggcgaguagcguccuguuguggauggccuccguggagccccacuggauugcugccucuaucauacuggaauuuuuccucaugguucugcuuaucccugagcccgaccggcagcguacaccacaggauaaccaacucgcauauguggucauuggucuguuguuuaugauccugaccguagcugccaacgaaaugggcuuacuagagacuacuaagaaggaccuggggauuggacaugugguugcagagaaucaccaccaugccacgaugcucgauaucgaccuucacccugcuagcgcguggacccuguacgccguggcaacuacaauaauuacccccaugaugagacauaccaucgaaaacacaacugcuaauauuuccuugacggccaucgccaaccaggcagcuauacugaugggccucgauaaagguuggccaaucucaaagauggacauuggggucccucugcuugccuuaggcugcuacucucaggugaauccgcugacccucacagcggcugucuugaugcugguggcccacuaugcaaucauuggacccggccuacaagccaaagcuacuagggaggcacagaagcgcaccgccgcggggaucaugaagaacccaacaguugauggaauaguggcuauugaccuggacccuguaguguacgaugccaaauucgaaaagcagcucggccagaucaugcuucugaucuuguguaccagucaaauucugcucaugcggacuacgugggcacugugcgagucgaucacauuagccaccgguccccuuacuacccugugggaagggagcccaggaaaauuuuggaauacaacuauagcugucuccauggccaacauuuuccgaggcucuuaucucgccggugcuggccuagccuucucacugaugaaaagccuagggggaggcagaagggggaccggagcgcagggcgagacacugggugagaaauggaagcgccagcucaaucagcuuuccaagagugaauuuaacacguacaaacggucugggaucauggagguugacagaagcgaagccaaggagggacugaaacguggcgaaaccacuaagcaugcagugucaagggguacagcuaaauugcggugguucgucgagcgcaaucuggugaagccugagggcaagguaauugaucucggguguggacgaggcgggugguccuauuacugcgccggacugaaaaaggugaccgaaguuaaaggcuauacuaagggugggcccggacacgaggaaccgaucccaauggcaacauacggcuggaacauagugaaacuacacaguggcagagacgucuuuuucaccccucccgagaagugugauacgcuucugugcgacaucggggaaagcucuccaaaucccaccauugaggagggaaggacacuacgggugcucaaaauggucgaaccuuggcugcgcgguaaccaauuuuguaucaagauuuugaauccguacaugcccuccgugguugagacucuggaacagaugcagagaaagcauggcgggaugcucguaaggaacccacuuucacgaaauagcacccacgagauguauugggugucgugcggaacaggcaacaucgucucugcugugaacaugacaagucggaugcuguuaaaucguuucaccauggcccauagaaaaccuacauacgagcgcgauguugaccugggugccgggaccaggcacguggcggucgaacccgagauugcuaacuuggauaucauaggacagcggauugaaaauaucaagaacgagcacaaauccacuuggcauuaugacgaagauaauccuuacaagacgugggcauaucacggcagcuacgaggugaaaccaucaggcuccgccucuagcaugguaaacggggugguuagacuccugacaaagcccugggacgucaucccuauggugacccaaauugcuaugacugacaccacaccauuuggacagcagcgcguguucaaggagaaagucgauacgaggacaccccgaccgaagcgggguacugcccaaauaauggaaguuacagcaaaauggcuauggggcuuucuuaguagaaauaagaaaccuaggaucuguacccgcgaggaguucacucguaaggugcgguccaacgccgcuauuggggcgguauuuguggacgagaaucaguggaacagcgccaaggaagcagucgaggaugagagauucugggaccuggugcauagggaacgcgagcuccacaaacagggaaagugcgcuacaugcguuuauaauaugaugggcaaacgagaaaagaaacugggugaguuugggaaggccaagggaucucgggcaaucugguacaugugguugggcgccagauuccuggaguucgaggcucucggcuuuaugaacgaggaucauugguucucaagggaaaauagucuuuccgggguggagggagaaggucugcacaaauuaggcuacauucugcgcgacaucagcaagauaccagggggaaacauguaugccgaugacaccgcgggcugggauacaagaaucacugaggacgauuugcagaaugaggcaaaaauuaccgacaucauggaacccgagcacgcccuccuggcuacgucuauuuuuaagcuaaccuaccaaaacaaagucgugcggguacagaggccugccaagucggguacaguuauggaugugaucucacgucgagaccagcgcgggagcggacaggucggcacuuauggccuuaacaccuucacaaauauggaagugcaacugauaagacagauggaguccgaagggauuuuuaguccaucugagcucgagaacagcaaucuggcagaacggguguuggacugguuagagaaacauggagucgaaaggcugaagcgcauggcuaucuccggugaugacuguguugugaagcccacugaugacagauucgccaccgcucucacggcccuuaacgauaugggcaaaguacggaaggacaucccgcagugggagccuucaaaaggguggaaugauuggcagcaagugcccuuuugcagucaccauuuccaccagcugauuaugaaggacggaagggaaauagucgugccaugucgaaaccaggaugagcuaguuggccgugcaagagugucucagggugcgggguggagccugcgcgagacagccugccucggaaaauccuacgcucaaauguggcaguugauguauuuucaccggagggaccugagacuugccgcaaaugcuaucuguucagccgucccugugaacuggguacccaccagccgcacuacauggucuauucaugcacaccaucaguggaugaccacugaagauaugcuguccguuuggaaucggguguggaucgaggaaaacccauggauggaggacaagacccacgucaguagcugggaagacgugcccuaccucggcaagagggaggaucaauggugcggcucguuaauugggcugacagcccgagcgacgugggcuaccaauauccagguugccauaaaccaggugagacgguugaucggaaaugagaacuaucuggacuacaugacuuccaugaaaagguucaagaaugaaucugauccugagggugcacucugguga

SEQ ID NO: 14216 - RNA, 9879 nt, Artificial Sequence
  derived and/or modified CDS sequence (opt3) from DENV-1__KM403632__SS-prME
agcgugaccaugcugcucaugcuucugcccacugcauuggcuuuccacuuaacuacgagaggaggggaaccucauaugaucgucuccaagcaggaaaggggaaaaucucuguuguuuaagaccucagccgguguuaacaugugcacucucauugcaauggaccugggcgaacuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaggugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacggacuggacuagauuucaacgaaaugguccugcucacaaugaaagagaaaagcuggcuggugcauaaacagugguuucuugaccugccguugcccuggacgucuggcgcauccaccucacaagaaacuuggaaucgucaggaucuccugguaacauucaagaccgcucacgccaaaaagcaggaaguuguggucuuagguagccaagagggggcuaugcacacagcccugacuggcgcaaccgaaauccagacgaguggaaccacaacuauuuuugccggccaucuaaagugccgccucaaaauggacaagcugacccuuaaaggggugucuuaugucauguguacaggauccuucaaguuggagaaagaaguggcugagacucagcacgguaccguucuggugcagguaaaguacgagggcacggaugcgccuugcaagauaccaaucagcacacaagacgaaaaaggggucacccagaacggaagacucauuacugcaaaucccaucgugacagauaaggagaaaccuguuaacauagaaaccgagccacccuucggcgagucguauauugugaucggugccggggaaaaggcucugaaacuuucuugguuuaagaagggcuccucaaucggaaaaauguucgaggccacugcaaggggcgcccggcgaauggcuauucugggggacaccgccugggauuuuggaaguaucgguggcgucuucacaagcguggggaaguugguacaucagguguuuggaacggcauacggcguucucuucuccggugucucuuggaccaugaaaauugggauaggcauccuguuaacuuggcugggacuaaauagccgcucaacaagucucuccaugaccuguauugcggugggcauggugacacuguaccuuggggucaugguucaggcugacagcggaugcgugaucaacuggaagggcagagaauugaaaugugguucugggaucuuugugacuaacgagguacacaccuggacggaacaauauaaguuccaggccgauucaccgaagaggcugagugcagccauuggaaaggcuugggaggagggcgucugcgguauacggagcgccacacgccucgaaaauaucauguggaagcagauuuccaacgagcugaaucauaucuuacuggaaaacgacaugaaauuuaccgugguugugggcgacgcaaaugggauucuuacucagggaaagaaaaugaucagaccucaacccauggagcacaaguacucuuggaaaucguggggcaaggcuaagauaaucggggccgauacccagaacacaacuuucauuaucgacggaccagauaccccugaaugucccgacgaucagagggcguggaauauuugggaggucgaggacuauggcuuugguguguucacaacgaacaucugguugaaacuccgugauagcuacacccagaugugcgaccaccggcugauguccgccgcuauaaaggauucaaaagcaguucaugccgacaugggguauuggauugaaagugagaagaaugaaacuuggaaacuagcucgagccucuuuuaucgaggugaagacauguauuuggccaagaagccacacccugugguccaacggaguacucgaaucagagaugaucauacccaagaucuacggcgguccuauuagccaacauaauuauaggccaggcuacuucacucagacagcagggccguggcaccugggaaaacuugaguuggauuucaaccugugcgaaggcaccacggucgugguggacgagcacugcgggaaucgcggacccucuuuacggacuaccacagucaccggcaagaucauucaugaaugguguugcagauccuguacucucccuccacugagguuucgcggugaggaugggugcugguacggaauggagauccgacccguuaaagaaaaggaggaaaaccuugugcggaguaugguaagcgcgggcucuggugagguggacuccuucucacugggcuugcucugugucaguauaaugauugaagaggugaugcguagcagauggucgaggaaaaugcugaugacagggacccuagccguauuuuuccugcucaucaugggacagcugacauggaaugaccuuauccgcuugugcauuauggugggcgcuaacgucuccgaucggauggggaugggaacuaccuaucuggccuuaauggcaacguuuaagaugagaccuauguucgcugugggccuccuguuuaggcgacuuacaucucgcgagguucugcuacucaccaucggucugagcuugguggccucagucgaacugccaaacaguuuagaggaacucggggacggacuggcaaugggcauuaugaugcuuaagcuguugacugauuuccaaucccaccagcucuggaccacacugcuaucucugacuuuuauaaaaaccacgcuuagccucgacuacgccuggaagacaauggcuaugguacuguccaucgugucauuguucccccuguguuuaagcaccacaagucagaaaacaaccuggcucccgguucugcuuggcucuuuugggugcaagccucugacuauguucuugauuacagagaauaaaaucuggggacggaaguccuggccacucaacgaagguauuauggcggugggcaucgucagcauacugcuaucgucacugcuuaagaaugaugugccccucgccgggccucugaucgcaggaggcauguugauugcuuguuauguaaucucugguaguuccgccgacuuaagccuggagagagccgcugaggugucuugggaagaggaagcagagcauagcggggccucccacaacauucucgucgaaguucaggaugacggaaccaugaaaaucaaggaugaggagagggacgauacgcugacuauacuucugaaagcgaccuugcuagcugugucaggcguguaccccaugaguauuccagccacacuguuugucugguauuucuggcaaaagaaaaagcagcguagcggcgugcucugggacaccccuucucccccagaaguugagcgcgcaguacuggaugacgggaucuaccggauccuucagagaggauuacuggguaggucccaggugggcgucgggguguuccaagacggaguuuuucauacaauguggcacgugacucgaggcgccguccucauguaucaggguaaacgguuggaaccgucaugggcuagugugaagaaggaucugauuagcuacgggggaggcuggcgcuuccagggcuccuggaauaccggggaggagguacaggucauagcaguggaaccuggcaaaaaccccaagaauguucaaacgacaccagguacuuuuaaaacccccgagggcgaagugggggccaucgcgcucgacuucaagccuggaacaucuggcucgccaauugucaacagagaggguaaaaucguggggcuguacggaaauggcguugugaccacuagcggcaccuaugucucagcuauugcccaggcaaaggccucccaggaagggccccuuccugagaucgaggaugaaguguuuaagaaaaggaaccugacaauaauggacuugcacccgggaagugguaagacgcggcgauaccuaccagcuaucguaagagaggccauuaaacgcaagcugaggacucucaucuuagcacccacccgugugguugcuucugaaauggccgaggcgcugaaaggcaugccuauucgguaucaaacaaccgccgucaagagcgaacauacugggaaggagaucguggaucuuaugugccacgcaacauucaccaugagacugcucuccccagugaggguccccaauuacaacaugauaauuauggacgaggcucauuuuacggauccugccucaaucgcugcacgcggauauaucucuacucgaguaggcaugggugaagccgccgcuauuuucaugacagcgaccccgcccgggagcguggaggcauuuccacagaguaaugccguuauccaggacgaagagagagauauaccugaacgguccuggaacagcggauacgacuggauuaccgauuuccccggcaaaacugugugguuugucccaucuaucaagucaggcaaugacauugcuaacuguuugaggaaaaacgggaagcgcgugauccagcugucccguaaaacauucgacaccgaguaucaaaagacaaagaauaacgauugggacuacguugugacuacggauauaagugagaugggagccaauuucagagcagaccgggucauugauccuaggcgcugccucaaacccgugauccugaaggacgguccagaacgaguaauccuugccggcccgaugccugugaccgcugcgagcgccgcacagagacgggggaggauuggacgcaaccagaauaaagagggcgaucaguacaucuauaugggucaaccccuaaacaaugacgaagaucacgcucauuggacagaggccaagaugcuguuggacaacauuaauacuccagaggggauaauccccgcauuauuugaaccugagagagaaaaaucggccgcuauugauggcgaguacaggcugcggggagaagcccguaagaccuucguugagcucaugcgccgaggcgaccugccagucuggcuuucuuauaagguggcguccgagggguuucaguacagcgauagaagguggugcuucgacggagaacggaacaaucaggugcuggaggaaaacauggacgucgagaucuggacaaaagaaggugagcgcaagaaacucagacccaggugguuggaugcacggaccuauucagacccucuggcccuacgagaguuuaaggaguucgcugccggcagacgcaguguuucuggggaucugauccucgagauuggaaaacuuccgcagcaccugacuuuaagggcucaaaaugcauuggacaaccuggugaugcuccacaauuccgaacagggcgguaaggccuaccggcaugcuauggaggaacugccagauacgauagagacccuuaugcugcucgccuugaucgcaguacugacagggggcgugacuuuauuuuuccuaagcggaaaaggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccgucagagaacaccacaggauaaccaacucgcauaugucguaaucggucuguuguuuaugauucugaccguggcugccaacgaaaugggcuuacuagagacuacaaagaaagaccuggggaucggacauguuguggcagagaaucaccaccaugccacgaugcucgauauugaccuucacccugcuagcgcguggacccuguacgccgucgcaacuacaaucauaacccccaugaugaggcauaccauugaaaacacaacugcuaauaucuccuugacggccauugccaaccaggcagcuauccugaugggccucgauaaggguuggccaauaucaaaaauggacaucggggugccucugcuugccuuaggcugcuacucucaggucaauccgcugacccucacagcggcuguguugaugcugguugcccacuaugcaauuaucggacccggccuacaagccaaggcuacucgcgaggcacagaaacggaccgccgcggggauuaugaagaacccaacaguggauggaaucguagcuauagaccuggacccuguggucuacgaugccaaguucgaaaaacagcucggccagauuaugcuucugaucuuguguaccagucaaauccugcucaugcgaacuacgugggcacugugcgagucgauuacauuagccaccgguccccuuacuacccugugggaagggagcccaggaaaguuuuggaauacaacuaucgcuguuuccauggccaacauauucagaggcucuuaucucgccggugcuggccuagccuucucacugaugaaaagccuagggggaggcaggcgcgggaccggagcgcagggcgagacacugggugagaaguggaaacggcagcucaaucagcuuuccaagagugaauuuaacacguacaagagaucugggauuauggagguggaccguagcgaagccaaagagggacugaagaggggcgaaaccacuaaacaugcagucucacgggguacagcuaaguugcgcugguucguggagcgaaaucugguaaaaccugagggcaaggugaucgaucucggguguggaagaggcgggugguccuauuacugcgccggauuaaagaaaguuaccgaagugaagggcuauacuaaaggugggcccggacacgaggaaccgauuccaauggcaacauacggcuggaacaucgucaagcugcacaguggcagggacguguuuuucaccccucccgagaaaugugauacgcuucugugcgacauaggggaaagcucuccaaaucccaccaucgaggagggacggacacuacgcguccucaagaugguggaaccuuggcugagagguaaccaauuuuguauuaaaaucuugaauccguacaugcccuccguuguagagacucuggaacagaugcagaggaagcauggcgggaugcucgugcgaaacccacuuucacggaauagcacccacgagauguauugggucucgugcggaacaggcaacauugugucugcuguuaacaugacaagucguaugcuguuaaauagauucaccauggcccaucgcaagccuacauacgagagggauguggaccugggugccgggacccggcacgucgcgguggaacccgagaucgcuaacuuggauauuaucggacagagaauagaaaauauuaaaaacgagcacaaguccacuuggcauuaugacgaagauaauccuuacaaaacgugggcauaucacggcagcuacgagguaaagccaucaggcuccgccucuagcauggugaacgggguuguccgccuccugacaaaacccugggacgugaucccuauggugacccaaaucgcuaugacugacaccacaccauuuggacagcagagggucuucaaggagaagguugauacgcgaacaccccggccgaaaagagguacugcccaaauuauggaagugacagcaaaguggcuauggggcuuucuuaguaggaauaaaaagccucgcauauguacccgugaggaguucacucggaaaguaagauccaacgccgcuaucggggcgguguuugucgacgagaaucaguggaacagcgccaaggaagcaguggaggaugagagguucugggaccugguucaucgcgaacgagagcuccacaagcagggaaaaugcgcuacaugcguguauaauaugaugggcaagcgggagaagaaacugggugaguuugggaaagccaagggaucuagagcaauuugguacaugugguugggcgccagguuccuggaguucgaggcucucggcuuuaugaacgaggaucauugguucucacgcgaaaauagucuuuccggggucgagggagaaggucugcacaaguuaggcuacauccugagagacauuagcaaaaucccagggggaaacauguaugccgaugacaccgcgggcugggauacacggauaacugaggacgauuugcagaaugaggcaaagaucaccgacauuauggaacccgagcacgcccuccuggcuacgucuaucuuuaaacuaaccuaccaaaacaaggugguaaggguucagcguccugccaaaucggguacagugauggaugucauuucacgacgcgaccagagagggagcggacaggugggcacuuauggccuuaacaccuucacaaauauggaagugcaacugauccggcagauggaguccgaagggauauuuaguccaucugagcucgagaacagcaaucuggcagaaagggucuuggacugguuagagaagcauggaguugaacgccugaaaagaauggcuauuuccggugaugacugugugguaaagcccacugaugaccgguucgccaccgcucucacggcccuuaacgauaugggcaaggugaggaaagacaucccgcagugggagccuucaaagggguggaaugauuggcagcaaguccccuuuugcagucaccauuuccaccagcugaucaugaaagacggacgagaaauugugguuccaugucguaaccaggaugagcuagugggcagagcacgcgucucucagggugcgggguggagccugcgggagacagccugccucggaaaguccuacgcucaaauguggcaguugauguauuuucacaggagagaccugcgccuugccgcaaaugcuauauguucagccgugccuguaaacuggguucccaccagccggacuacauggucuauccaugcacaccaucaguggaugaccacugaagauaugcuguccguguggaauagggucuggauugaggaaaacccauggauggaggacaaaacccacgugaguagcugggaagacguucccuaccucggcaagcgagaggaucaauggugcggcucguuaaucgggcugacagccagagcgacgugggcuaccaauauucagguggccaucaaccagguccggagguugauaggaaaugagaacuaucuggacuacaugacuuccaugaagcgcuucaaaaaugaaucugauccugagggugcacucugguga

SEQ ID NO: 14217 - RNA, 9879 nt, Artificial Sequence
  derived and/or modified CDS sequence (opt3) from DENV-1__KM403583__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagaccguagaagcguggcccuggcaccccaugucggcuugggucucgagacuaggaccgaaacauggauguccucugagggggccuggcggcagauccagcgcguggaaacuugggcucugagacacccuggauucaccguuauugcacuguuucucgcccaugcuaucggcacaucgauuacccagaagggcaucauauucaucuuacugaugcuugugacgccaucaauggccaugaggugcgucgggauuggaaaccgggauuuuguggaggguuugagcggcgcgacuuggguagacguugugcuggagcacgggaguugugucacaaccauggcaaaaaauaagcccacucuagauaucgaacuccugaagacagaggugaccaacccugccgugcuucgcaaacugugcauugaagcuaagaucuccaauacgaccacagacucucgauguccaacucaaggagaggccaccuuggucgaagagcaggaugcaaacuucguuugcagaaggacauuuguggaccggggcugggguaauggguguggacucuucggcaaaggcagccuguuaacuugcgcuaaguuuaaaugcguaaccaagcuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccacguacuggacuagauuucaacgaaaugguccugcucacaaugaaggagaaaagcuggcuggugcauaagcagugguuucuugaccugccguugcccuggacgucuggcgcauccaccucacaagagacuuggaaucgccaggaucuccugguaacauucaaaaccgcucacgccaagaaacaggaaguuguggucuuagguagccaagagggggcuaugcacacagcccugacuggcgcaaccgaaauccagacgaguggaaccacaacuauuuuugccggccaucuaaagugcagacucaagauggacaaacugacccuuaagggggugucuuaugucauguguacaggauccuucaaauuggagaaggaaguggcugagacucagcacgguaccguucuggugcagguaaaauacgagggcacggaugcgccuugcaagauaccaaucagcacacaagacgaaaagggggucacccagaacggaaggcucauuacugcaaaucccaucgugacagauaaagagaagccuguuaacauagaaaccgagccacccuucggcgagucguauauugugaucggugccggggaaaaagcucugaagcuuucuugguuuaaaaagggcuccucaaucggaaagauguucgaggccacugcacggggcgcccgacgcauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagcagaucaacaagucucuccaugaccuguauugcggugggcauggugacacuguaccuuggggucaugguucaggcugacagcggaugcgugaucaacuggaaaggcagggaauugaagugugguucugggaucuuugugacuaacgagguacacaccuggacggaacaauauaaauuccaggccgauucaccgaagcggcugagugcagccauuggaaaggcuugggaggagggcgucugcgguauacgcagcgccacaagacucgaaaauaucauguggaaacagauuuccaacgagcugaaucauaucuuacuggaaaacgacaugaaguuuaccgugguugugggcgacgcaaaugggauucuuacucagggaaaaaagaugaucaggccucaacccauggagcacaaauacucuuggaagucguggggcaaagcuaagauaaucggggccgauacccagaacacaacuuucauuaucgacggaccagauaccccugaaugucccgacgaucagcgugcguggaauauuugggaggucgaggacuauggcuuugguguguucacaacgaacaucugguugaagcuccgggauagcuacacccagaugugcgaccaccgacugauguccgccgcuauaaaagauucaaaggcaguucaugccgacaugggguauuggauugaaagugagaaaaaugaaacuuggaagcuagcuagagccucuuuuaucgaggugaaaacauguauuuggccaaggagccacacccugugguccaacggaguacucgaaucagagaugaucauacccaagaucuacggcgguccuauuagccaacauaauuaucgcccaggcuacuucacucagacagcagggccguggcaccugggaaagcuugaguuggauuucaaccugugcgaaggcaccacggucgugguggacgagcacugcgggaaucggggacccucuuuaagaacuaccacagucaccggcaaaaucauucaugaaugguguugcagguccuguacucucccuccacugcgcuuucgaggugaggaugggugcugguacggaauggagauccggcccguuaaggaaaaagaggaaaaccuugugcguaguaugguaagcgcgggcucuggugagguggacuccuucucacugggcuugcucugugucaguauaaugauugaagaggugaugagaagcagguggucgcgcaagaugcugaugacagggacccuagccaucuuuuuccugcucaucaugggacagcugacauggaaugaccuuauucgguugugcaucaugguuggcgcuaacguguccgauagaauggggaugggaacuaccuaucuggccuuaauggcaacguuuaaaaugaggccuauguucgcugucggccuccuguuucgacgccuuacaucucgggaggugcugcuacucaccauuggucugagcuugguugccucaguggaacugccaaacaguuuagaggaacucggggacggacuggcaaugggcauaaugaugcuuaagcuguugacugauuuccaaucccaccagcucuggaccacacugcuaucucugacuuuuaucaagaccacgcuuagccucgacuacgccuggaaaacaauggcuaugguccuguccauuguaucauuguucccccuguguuuaagcaccacuagucagaagacaaccuggcucccggugcugcuuggcucuuuugggugcaaaccucugacuauguucuugaucacagagaauaagauuuggggaagaaaauccuggccacucaacgaagguaucauggcgguuggcauagugagcauccugcuaucgucacugcuuaagaaugaugucccccucgccgggccucugauugcaggaggcauguugaucgcuuguuaugugauuucugguaguuccgccgacuuaagccuggagagggccgcugagguaucuugggaagaggaagcagagcauagcggggccucccacaacauccucguggaaguccaggaugacggaaccaugaagauaaaagaugaggagcgugacgauacgcugacuauucuucugaaggcgaccuugcuagcuguuucaggcguguaccccaugaguaucccagccacacuguuugugugguauuucuggcaaaaaaagaaacagcgcagcggcguccucugggacaccccuucucccccagaaguggagcgggcaguucuggaugacgggaucuacagaauucuucagaggggauuacugggucgaucccagguaggcgugggggucuuccaagacggaguguuucauacaauguggcacguuacucggggcgccgugcucauguaucaggguaagcgcuuggaaccgucaugggcuagugucaaaaaggaucugauaagcuacgggggaggcuggagauuccagggcuccuggaauaccggggaggaggugcagguaaucgcagucgaaccuggaaagaaccccaaaaaugugcaaacgacaccagguacuuuuaagacccccgagggcgaaguuggggccauugcgcucgacuucaaaccuggaacaucuggcucgccaaucgugaacagggaggguaagauugucgggcuguacggaaauggcgugguuaccacuagcggcaccuaugugucagcuaucgcccaggcaaaagccucccaggaagggccccuuccugagauagaggaugaagucuuuaagaagcggaaccugacaaucauggacuugcacccgggaagugguaaaacgcgaagauaccuaccagcuauugugcgcgaggccaucaagaggaaacugcguacucucauuuuagcacccacccggguaguggcuucugaaauggccgaggcgcugaagggcaugccuaucagauaucaaacaaccgccguuaaaagcgaacauacugggaaggagauagucgaucuuaugugccacgcaacauucaccaugaggcugcucuccccagugcgcgugcccaauuacaacaugauuaucauggacgaggcucauuuuacggauccugccucaaucgcugcacgaggauauauuucuacuagagucggcaugggugaagccgccgcuaucuucaugacagcgaccccgcccgggagcguagaggcauuuccacagaguaaugccgugauacaggacgaagagcgggauauuccugaaagguccuggaacagcggauacgacuggaucaccgauuuccccggcaagacuguuugguuugugccaucuauuaaaucaggcaaugacaucgcuaacuguuugcgcaagaacgggaaacgugucauacagcuguccagaaagacauucgacaccgaguaucaaaaaacaaagaauaacgauugggacuacgugguuacuacggauauuagugagaugggagccaauuuccgggcagacagggugaucgauccucgccgaugccucaagcccgucauccugaaagacgguccagaaagagugauucuugccggcccgaugccuguaaccgcugcgagcgccgcacagcggagggggcgcaucggaagaaaccagaauaaggagggcgaucaguacauuuauaugggucaaccccuaaacaaugacgaagaucacgcucauuggacagaggccaaaaugcuguuggacaacauaaauacuccagaggggaucauucccgcauuauuugaaccugagagggaaaagucggccgcuaucgauggcgaguaccggcugcguggagaagcccgcaaaaccuucguggagcucaugcgaagaggcgaccugccaguuuggcuuucuuauaaggucgcguccgagggguuucaguacagcgauaggcgguggugcuucgacggagaacgcaacaaucaggugcuggaggaaaacauggacguggagaucuggacaaaggaaggugagagaaaaaagcucaggccccggugguuggaugcacgaaccuauucagacccucuggcccuaagagaguuuaaagaauucgcugccggccgcaggagugucucuggggaucugauucucgagauaggaaagcuuccgcagcaccugacuuuacgggcucaaaaugcauuggacaaccugguuaugcuccacaauuccgaacagggcgguaaagccuaccgucaugcuauggaggaacugccagauacgaucgagacccuuaugcugcucgccuugauugcagugcugacagggggcguaacuuuauuuuuccuaagcggaaagggccuggggaaaaccucaaucggacuccuuugugugauggcgaguagcguccuguuguggauggccuccguggagccccacuggauugcugccucuaucauacuggaauuuuuccucaugguucugcuuaucccugagcccgacagacagaggacaccacaggauaaccaacucgcauauguggucauuggucuguuguuuaugauccugaccguagcugccaacgaaaugggcuuacuagagacuacaaagaaggaccuggggauuggacaugugguugcagagaaucaccaccaugccacgaugcucgauaucgaccuucacccugcuagcgcguggacccuguacgccguggcaacuacaauaauuacccccaugaugcgccauaccaucgaaaacacaacugcuaauauuuccuugacggccaucgccaaccaggcagcuauacugaugggccucgauaaagguuggccaaucucaaagauggacauuggggucccucugcuugccuuaggcugcuacucucaggugaauccgcugacccucacagcggcugucuugaugcugguggcccacuaugcaaucauuggacccggccuacaagccaaagcuacucgggaggcacagaagcgaaccgccgcggggaucaugaaaaacccaacaguugauggaauaguggcuauugaccuggacccuguaguguacgaugccaaguucgaaaagcagcucggccagaucaugcuucugaucuuguguaccagucaaauucugcucaugagaacuacgugggcacugugcgagucgaucacauuagccaccgguccccuuacuacccugugggaagggagcccaggaaaauuuuggaauacaacuauagcugucuccauggccaacauuuucaggggcucuuaucucgcaggugcuggccuagccuucucacugaugaagagcuuggggggaggccgccgggggaccggagcgcagggcgagacacugggugagaaauggaagagacagcucaaucagcuuuccaaaagugaauuuaacacguacaagcguucugggaucauggagguugacaggagcgaagccaaggagggacugaaacggggcgaaaccacuaagcaugcagugucacgcgguacagcuaaauugcgaugguucgucgagagaaaucuggugaagccugagggcaaaguaauugaucucggguguggaaggggcgggugguccuauuacugcgccggauuaaagaaggugaccgaaguuaaaggcuauacuaagggugggcccggacacgaggaaccgaucccaauggcaacauacggcuggaacauagugaaacugcacaguggccgggacgucuuuuucaccccucccgagaagugugauacgcuucugugcgacaucggggaaagcucuccaaaucccaccauugaggagggacgcacacuaagagugcucaaaauggucgaaccuuggcugagggguaaccaauuuuguaucaagauuuugaauccguacaugcccuccgugguugagacucuggaacagaugcagcgaaaacauggcgggaugcucguacggaacccacuuucacguaauagcacccacgagauguauugggugucgugcggaacaggcaacaucgucucugcugugaacaugacuaguagaaugcuguuaaaucgcuucaccauggcccauaggaagccuacauacgagcgggauguugaccugggugccgggaccagacacguggcggucgaacccgagauugcuaacuuggauaucauaggacagcgcauugaaaauaucaagaacgagcacaaauccacuuggcauuaugacgaagauaauccuuacaagacgugggcauaucacggcagcuacgaggugaaaccaucaggcuccgccucuagcaugguaaacggggugguuaggcuccugacaaagcccugggacgucaucccuauggugacccaaauugcuaugacugacaccacaccauuuggacagcagcgaguguucaaagagaaggucgauacgcggacccccagaccgaagagggguacugcccaaauaauggaaguuacagcaaaauggcuauggggcuuucuuagucgcaauaagaaaccucguaucuguacccgggaggaauucacuagaaaggugagguccaacgccgcuauuggggcgguauuuguggacgagaaucaguggaacagcgccaaagaagcagucgaggaugagcgcuucugggaccuggugcaucgagaacgggagcuccacaagcagggaaagugcgcuacaugcguuuauaauaugaugggcaaaagagaaaagaaacugggugaguuugggaaggccaaaggaucuagggcaaucugguacaugugguugggcgcccgcuuccuggaauucgaggcucucggcuuuaugaacgaggaucauugguucucaagagaaaauagucuuuccgggguggagggagaaggucugcacaaguuaggcuacauucugcgggacaucagcaagauaccagggggaaacauguaugccgaugacaccgcgggcugggauacaaggaucacugaggacgauuugcagaaugaggcaaaaauuaccgacaucauggaacccgagcacgcccuccuggcuacgucuauuuuuaagcuaaccuaccaaaacaaagucgugcguguacagcgaccugccaagucggguacaguuauggaugugaucucacgcagagaccagcgggggagcggacaggucggcacuuauggccuuaacaccuucacaaauauggaagugcaacugauaaggcagauggaguccgaagggauuuuuaguccaucugagcucgagaacagcaaucuggcagaacgcguguuggacugguuagagaaacauggagucgaaagacugaagcggauggcuaucuccggugaugacuguguugugaaacccacugaugacagguucgccaccgcucucacggcccuuaacgauaugggcaagguacgaaaggacaucccgcagugggagccuucaaaaggguggaaugauuggcagcaagugcccuuuugcagucaccauuuccaccagcugauuaugaaggacggacgugaaauagucgugccauguagaaaccaggaugagcuaguuggccgcgcacgggugucucagggugcgggguggagccugagggagacagccugccucggaaaauccuacgcucaaauguggcaguugauguauuuucacagacgcgaccugcggcuugccgcaaaugcuaucuguucagccgucccugugaacuggguacccaccagcaggacuacauggucuauucaugcacaccaucaguggaugaccacugaagauaugcuguccguuuggaaucgaguguggaucgaggaaaacccauggauggaggacaagacccacgucaguagcugggaagacgugcccuaccucggcaaaagagaggaucaauggugcggcucguuaauugggcugacagcccgggcgacgugggcuaccaauauccagguugccauaaaccaggugaggcgcuugaucggaaaugagaacuaucuggacuacaugacuuccaugaagcguuucaagaaugaaucugauccugagggugcacucugguga

SEQ ID NO: 14218 - RNA, 9879 nt, Artificial Sequence
  derived and/or modified CDS sequence (opt3) from DENV-1__KM403579__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauauucagaacaccacauucaucauugacggaccagauacuccugaaugucccgacgaucagagagcguggaauaucugggaggucgaggacuauggcuuugguguguucaccacaaacauaugguugaagcucagggauagcuacacgcagaugugcgaccaccgucugauguccgccgcuauuaaagauucaaaggcaguucaugccgacaugggguauuggaucgaaagugagaaaaaugaaaccuggaagcuagcucgggccucuuuuauugaggugaagacuuguaucuggccacgaagccacacacugugguccaacggaguacucgaaucagagaugauaauccccaaaauuuacggcgguccuaucagccaacauaauuauagaccaggcuacuucacccagacugcagggccguggcaccugggaaagcuugaguuggauuucaaccugugcgaaggcacaaccgucgugguggacgagcacugcgggaauaggggacccucuuuacgcacgacuaccgucacaggcaaaauuauccaugaaugguguugccgguccuguacccucccuccacugagauuuaggggugaggaugggugcugguacggaauggagauacgccccguuaaggaaaaagaggaaaaccuugugcgaaguaugguaagcgcgggcucuggugagguggacuccuucucacugggcuugcucugugucaguauuaugaucgaagaggugaugcggagccguuggucgagaaagaugcugaugacugggacacuagccguuuuuuuccugcucaucaugggacagcugaccuggaaugaccuuauuagguugugcaucauggugggcgcuaacgucuccgaucgcauggggaugggaacaacuuaucuggccuuaauggcaaccuuuaagaugcggccuauguucgcugugggccuccuguuuagaaggcuuacgucucgagagguucugcuacucacaauuggucugagcuugguggccucagucgaacugccaaacaguuuagaggaacucggggacggacuggcaaugggcauaaugaugcuuaaacuguugaccgauuuccaaucccaccagcucuggacuacccugcuaucucugacauuuaucaagacuacccuuagccucgacuacgccuggaaaacgauggcuaugguacuguccauugugucauuguucccccuguguuuaagcacaaccagucagaagacuacauggcucccgguucugcuuggcucuuuugggugcaaaccucugaccauguucuugaucacugagaauaagauuuggggacgcaaguccuggccacucaacgaagguaucauggcggugggcauagucagcauccugcuaucgucacugcuuaaaaaugaugugccccucgccgggccucugauugcaggaggcauguugaucgcuuguuauguaauuucugguaguuccgccgacuuaagccuggagcgggccgcugaggugucuugggaagaggaagcagagcauagcggggccucccacaacauccucgucgaaguucaggaugacggaacaaugaagauaaaagaugaggagagagacgauacccugacgauucuucugaaggcgacuuugcuagcugugucaggcguguaccccaugaguaucccagccacccuguuugucugguauuucuggcaaaaaaagaaacagaggagcggcgugcucugggacacaccuucucccccagaaguugagcgugcaguacuggaugacgggaucuaccgcauucuucagcggggauuacuggguagaucccaggugggcgucgggguguuccaagacggaguuuuucauaccauguggcacgugacaaggggcgccguccucauguaucaggguaagcgauuggaaccgucaugggcuagugugaagaaagaucugauaagcuacgggggaggcuggcgguuccagggcuccuggaauacuggggaggagguacaggucaucgcaguggaaccuggaaagaaccccaaaaauguucaaaccacgccagguacauuuaagacucccgagggcgaagugggggccauugcgcucgacuucaaaccuggaaccucuggcucgccaaucgucaaccgcgaggguaagauuguggggcuguacggaaauggcguugugacaaccagcggcacuuaugucucagcuaucgcccaggcaaaggccucccaggaagggccccuuccugagauagaggaugaaguguuuaaaaagagaaaccugaccaucauggacuugcacccgggaagugguaaaacaaggcgguaccuaccagcuauuguacgagaggccaucaagagaaaacugcgcacgcucauuuuagcacccacuagggugguugcuucugaaauggccgaggcgcugaagggcaugccuauccguuaucaaaccacagccgucaagagcgaacauaccgggaaagagauaguggaucuuaugugccacgcaacuuucacaaugcggcugcucuccccagugagaguccccaauuacaacaugauuaucauggacgaggcucauuuuaccgauccugccucaaucgcugcaaggggauauauuucuacgcgcguaggcaugggugaagccgccgcuaucuucaugacugcgacaccgcccgggagcguggaggcauuuccacagaguaaugccguuauacaggacgaagagcgagauauuccugaaagauccuggaacagcggauacgacuggaucaccgauuuccccggcaagaccgugugguuugucccaucuauuaaaucaggcaaugacaucgcuaacuguuugcggaagaacgggaaaagggugauacagcugucccgcaagacuuucgacacagaguaucaaaagaccaaaaauaacgauugggacuacguugugacaacugauauuagugagaugggagccaauuuccgugcagacagagucaucgauccucggaggugccucaagcccgugauccugaaagacgguccagaacgcguaauucuugccggcccgaugccugugacggcugcgagcgccgcacagcgaagagggcggaucggaaggaaccagaauaaggagggcgaucaguacauuuauaugggucaaccccuaaacaaugacgaagaucacgcucauuggaccgaggccaaaaugcuguuggacaacauaaauacaccagaggggaucauucccgcauuauuugaaccugagcgcgaaaagucggccgcuaucgauggcgaguacagacugaggggagaagcccggaagacuuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggaccaaggaaggugagcggaaaaagcuccgccccagaugguuggaugcaaggacauauucagacccucuggcccuacgggaguuuaaagaauucgcugccggccgaagaaguguuucuggggaucugauucucgagauaggaaagcuuccgcagcaccugaccuuacgcgcucaaaaugcauuggacaaccuggugaugcuccacaauuccgaacagggcgguaaagccuacaggcaugcuauggaggaacugccagauacuaucgagacgcuuaugcugcucgccuugauugcaguacugaccgggggcgugacauuauuuuuccuaagcggaaagggccuggggaagacuucaaucggacuccuuugugucauggcgaguagcgugcuguuguggauggccuccguugagccccacuggauugcugccucuaucauacuggaauuuuuccucauggugcugcuuaucccugagcccgaccggcagcguaccccacaggauaaccaacucgcauaugucguaauuggucuguuguuuaugauccugacaguggcugccaacgaaaugggcuuacuagagaccacuaaaaaggaccuggggauuggacauguuguggcagagaaucaccaccaugccacaaugcucgauaucgaccuucacccugcuagcgcguggacgcuguacgccgucgcaaccacuauaauuacacccaugaugagacauaccaucgaaaacaccacagcuaauauuuccuugacugccaucgccaaccaggcagcuauacugaugggccucgauaaagguuggccaaucucaaagauggacauuggggugccucugcuugccuuaggcugcuacucucaggucaauccgcugacgcucaccgcggcuguguugaugcugguugcccacuaugcaaucauuggacccggccuacaagccaaagcuacaagggaggcacagaagcgcacugccgcggggaucaugaagaacccaaccguggauggaauaguagcuauugaccuggacccuguggucuacgaugccaaauucgaaaagcagcucggccagaucaugcuucugaucuuguguacaagucaaauucugcucaugcggaccacuugggcacugugcgagucgaucacguuagccacagguccccuuaccacucugugggaagggagcccaggaaaauuuuggaauaccacaauagcuguuuccauggccaacauuuuccgaggcucuuaucucgcaggugcuggccuagccuucucacugaugaagagcuuggggggaggcagaagggggacuggagcgcagggcgagacccugggugagaaauggaagcgccagcucaaucagcuuuccaagagugaauuuaacacauacaaacggucugggaucauggagguggacagaagcgaagccaaggagggacugaaacguggcgaaacgaccaagcaugcagucucaagggguacugcuaaauugcggugguucguggagcgcaaucugguaaagccugagggcaaggugauugaucucggguguggacgaggcgggugguccuauuacugcgccggauuaaaaaagguuacagaagugaaaggcuauaccaagggugggcccggacacgaggaaccgaucccaauggcaacuuacggcuggaacauagucaaacugcacaguggcagagacguguuuuucacaccucccgagaagugugauacccuucugugcgacaucggggaaagcucuccaaaucccacgauugaggagggaaggacccuacggguccucaaaaugguggaaccuuggcugcgcgguaaccaauuuuguaucaagauuuugaauccguacaugcccuccguuguagagacacuggaacagaugcagagaaagcauggcgggaugcucgugaggaacccacuuucacgaaauagcacucacgagauguauugggucucgugcggaaccggcaacaucgugucugcuguuaacaugacaagucggaugcuguuaaaucguuucacuauggcccauagaaaaccuaccuacgagcgcgauguggaccugggugccgggacaaggcacgucgcgguggaacccgagauugcuaacuuggauaucauaggacagcggauugaaaauaucaagaacgagcacaaauccaccuggcauuaugacgaagauaauccuuacaagacuugggcauaucacggcagcuacgagguaaaaccaucaggcuccgccucuagcauggugaacgggguugucagacuccugacgaagcccugggacgugaucccuauggugacacaaauugcuaugaccgacacuaccccauuuggacagcagcgcgucuucaaggagaaaguugauacaaggacgccccgaccgaagcgggguaccgcccaaauaauggaagugacugcaaaauggcuauggggcuuucuuaguagaaauaagaaaccuaggaucuguacacgcgaggaauucacccguaagguacgguccaacgccgcuauuggggcgguguuugucgacgagaaucaguggaacagcgccaaggaagcaguggaggaugagagauucugggaccugguucauagggaacgcgagcuccacaaacagggaaagugcgcuacuugcguguauaauaugaugggcaaacgagaaaagaaacugggugaguuugggaaggccaagggaucucgggcaaucugguacaugugguugggcgccagauuccuggaauucgaggcucucggcuuuaugaacgaggaucauugguucucaagggaaaauagucuuuccggggucgagggagaaggucugcacaaauuaggcuacauucugcgcgacaucagcaagauaccagggggaaacauguaugccgaugacacagcgggcugggauaccagaaucacagaggacgauuugcagaaugaggcaaaaauuacugacaucauggaacccgagcacgcccuccuggcuaccucuauuuuuaagcuaacguaccaaaacaaagugguacggguucagaggccugccaagucggguaccgugauggaugucaucucacgucgagaccagcgcgggagcggacaggugggcacauauggccuuaacacuuucaccaauauggaagugcaacugauaagacagauggaguccgaagggauuuuuaguccaucugagcucggaaacagcaaucuggcagagcgggucuuggacugguuagaaaaacaugguguugagaggcugaagcgcauggcuaucuccggcgaugacugugugguaaagcccacagaugacagauucgccacugcucucaccgcccuuaacgauauggggaaagugcggaaggacaucccgcagugggaaccuucaaaaggauggaaugauuggcagcaaguccccuuuugcagucaccauuuccaccagcugauuaugaaggacggcagggagauagugguuccaugucgaaaccaggaugaacuagugggucgugcaagagucucucagggggcgggauggagccugcgcgagacggccugccucggcaaauccuacgcucaaauguggcaguugauguauuuucaccggagggaccugagacuugccgcaaaugcuaucuguucagccgugccuguaaacuggguucccacaagccgcaccacuuggucuauucaugcacaccaucaguggaugacaaccgaggauaugcuguccguguggaaucgggucuggaucgaagagaacccauggauggaagacaagacucacgugaguagcugggaggacguucccuaccucggcaagagggaagaucaauggugcgggucguuaauuggacugaccgcccgagcgacaugggcuacgaauauccagguggccauaaaccaggucagaaaauugaucgguaaugagaacuaucuggacuacaugaccuccaugaagcgguucaaaaaugagucugauccugaaggcgcacucugguga

SEQ ID NO: 14219 - RNA, 9879 nt, Artificial Sequence
  derived and/or modified CDS sequence (opt3) from DENV-1__HM469968__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaauaugugcacacuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcgcuuugcucacuuggcugggauuaaauucacgaaguacaucccugagcaugaccuguauugccgugggccuaguuacacucuaccugggggucauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaaguucaccgugguagucggcgauguggccgggauucuggcgcagggcaagaagaugauccgcccucaacccauggaguacaaauauucguggaaaagcuggggcaaggccaagauaaucggggcugacguucagaauacuaccuuuauuaucgauggaccaaacacaccugaaugucccgacgaucagagagcauggaauauuugggagguggaggacuacggcuucgguaucuuuacuaccaacauauggcuuaaguugagggauuccuauacacaggucugcgaccaccgucucaugucagccgcuauuaaagauaguaaggccgugcacgcagacaugggguacuggaucgaaucugagaaaaaugaaacguggaagcuggcgcgggccagcuucauugagguuaagaccuguaucuggccaaaaucccauacucuauggucaaacggagugcuggaaagcgagaugauaauccccaagauuuauggcgguccuaucucucaacacaauuaccgaccaggcuacuucacacagaccgcugggccguggcaucucggaaaacuggagcuugauuuugacuugugcgaaggcacuacaguagucguggaugagcacugcgggaacagaggacccucccugaggaccacgacugugaccggcaagauuauccacgaaugguguugccgcaguuguacauuaccuccacuccgguucagaggugaggacgggugcugguauggaauggagauaaggcccgucaaagaaaaggaggaaaaucugguuaagagcauggugucugccggcuccggugagguagacucauuuagucuuggccuguuguguauuagcaucaugaucgaagaggugaugcgcucgcgauggucccggaaaaugcucaugaccgggacucuggcagucuucuuucuacugauuaugggacagcucacauggaacgaucugauccgucuuugcauuauggugggcgcuaaugccucugacagaauggggaugggaaccacauacuuggcacugauggccacuuucaagaugaggccuauguuugcuguuggcuuacucuuccgccggcugaccagcagagaggugcuucugcuaacgauaggucucucacuggucgcgaguguggaauugccaaacucccuggaggaauuaggggauggacucgccaugggcaucaugauucugaaacuucugacagacuuucaaucucaucaguugugggcaacccuccugagccuaacuuucaucaagaccacauuuucccugcacuaugcuuggaaaacuauggccaugguucuuucaauugugagccucuucccccuguguuugaguaccacgucucagaagacaaccuggcugccggucuuacucggcucccuggggugcaagccucuuacuauguuucugaucgccgagaauaaaauauggggaagaaaguccuggccauugaacgaagguaucauggcuguaggcauugugucgauccuccugucaucucuacugaaaaacgauguuccccuugcagggccucucauugccggaggcaugcugaucgcguguuacgugauaagugguuccagcgcugacuugucuuuagagaaggccgcagaggucagcugggaagaggaagccgagcauuccggggcuucacacaauauucugguggaaguacaggaugacggaacaaugaaaaucaaggaugaggagcgagacgauacccucacuauccugcuuaaagcaacacuguuggccgugaguggcgucuauccccuaagcauuccagcgacccuguucguuugguacuucuggcaaaagaagaaacagcgcucuggcgugcucugggacacgccuucacccccagaaguggagcgggcuguccuggaugacgggauauauagaaucaugcagaggggacuuuuaggucguagccaggugggcguugggguauuucaagaaaacguguuccauacuauguggcacgucacccgcggagccgugcugauguaccagggcaagcggcucgagccgaguugggcaagcguuaaaaaggacuugauuuccuacggugggggauggagacugcagggcucuuggaauacaggcgaggaagugcaggucaucgccguggagccugggaaaaaccccaagaauguacaaaccgcuccaggaacauuuaagacucccgaaggugaggucggcgccauugcacucgauuucaaaccugggaccucgggaagcccaaucgugaacagggaaggcaagauaguuggucuguaugggaauggaguggucacgacaucaggcacuuacguguccgcuaucgcccaggcgaaagccagucaggagggcccccuuccugagauugaagacgagguuuuucgaaagcggaaccugaccaucauggauuugcacccggggucuggaaaaacacgcagauaucuaccagcaauugugagggaagcuaucaagcggaagcugcgaacccucauauuagcccccacuagagucguggcuagcgagauggcagaagcccugaaagguaugccuauucgcuaccaaaccacagccguaaaguccgagcauacgggcaaagagaucguggaccuuaugugccacgcuacuuucaccaugaggcugcucucaccaguucguguccccaauuauaacaugaucauuauggaugaagcgcauuuuacagacccuucuagcaucgcagcccggggguacauaaguaccagagugggaaugggcgaggcugccgcaauuuucaugacugccacaccgcccgguuccguggaggcuuuuccacagagcaaugcggucauccaggaugaggaaagggacauuccugagcgcucuuggaacucaggguaugaguggaucaccgauuuccccggaaagacgguaugguuugugccauccauaaaaaguggcaaugacauugccaacuguuugcgaaagaauggcaagagaguuauccagcugagccggaaaacuuucgauacagaauaccaaaagaccaaaaacaacgacugggacuacguggucaccacugauaucucggagaugggggcaaauuucagggcugaccgcgugauugauccucguagaugccucaagcccguuauccugaaagacggaccagaacgggugauucuugccgguccgaugccugucacaguggcaucugccgcucagaggcgcggccgaauagggagaaaccacaauaaggagggagaucaguauaucuacaugggccagccccuaaacaaugacgaggaucaugcccacuggaccgaagcgaagaugcuguuggacaacauuaauacaccagaggguaucauccccgcauuauuugaaccugagcgggaaaaauccgccgcuauugauggggaguauaggcugcgcggcgaggccagaaagacuuucguagaacucaugaggcggggagaccugccaguguggcuuagcuacaaaguugcuucagagggcuuucaauauagugaucgucgcuggugcuucgacggggaacgaaacaaucagguccuggaggaaaacauggauguggagauauggacgaaggagggagaaaggaaaaagcucaggccccggugguuggacgcacgcaccuacucugacccucuggcccuaagagaguuuaaagaguucgcugccgguaggcgguccgugagcggcgaucugauccucgagauugggaaacuuccgcagcaccugacacagcgagcacaaaaugcguuagacaacuuggucaugcugcauaauucagaacagggaggcagagccuaucgccacgcuauggaggagcucccagauacuaucgaaacccugaugcuucuggcccucauugcaguuuugacagguggggugacccuguuuuucuuaaguggcaggggacuaggcaagacuagcaucgggcugcucuguguaauggcuuccucugugcuucuguggauggccagcgucgagccccauuggauagcagccuccaucauuuuggaauuuuuccugauggugcuccugaucccugagcccgaccggcagcguacgccacaggauaaccaacuugcuuacguugugauuggacuccuguuuaugaucuugaccgucgcggccaaugagaugggucuguuagaaacaacuaaaaaggaccuaggcauagggcacguagcaguggagaaccaccaucacgcugccaugcuggauguugaccuccauccugccucagcauggacccuuuacgcuguggccacaaccauuaucacucccaugaugagacacacaauugaaaacacgaccgcgaauaucucucugacugcuauagccaaccaggcagccaucuugaugggacuggauaaaggcuggccaauuaguaagauggacaucggugucccucuccuggcucuugggugcuauagccaggugaauccguuaacacugaccgcagccguccucauguugguggcgcauuacgcuauuaucggccccggacugcaagccaaagcaaccagggaggcccagaagcgcacagcugccggcauaaugaagaacccaacuguugaugggauuguggcaaucgaccuagauccuguaguguaugacgcuaaauucgaaaagcagcugggacagaucaugcuccuuauucuguguacgagccaaaucuugcugaugcggaccacaugggcccucugcgaguccauaacucuggcgaccggccccuuaacaacccuuugggaggguucuccagggaaauuuuggaauacuacgauugccgucucaauggcaaacaucuuccgaggaagcuaccuggcuggcgccggucucgcauucucccuaaugaagagucugggcgggggaagaaggggcacaggggcucagggagaaaccuugggcgagaaauggaagcgccagcugaaucagcucucuaagagcgaauuuaacacuuauaaacggucagguauuauggagguugacagauccgaagccaaggaggggcuuaaacguggagagaccacaaagcacgccgugaguaggggcacugcgaaacugcggugguucgucgaacgcaauuuggugaagccugaggguaagguaaucgaucugggcugugggcgaggaggcuggagcuacuauugcgcugggcucaaaaaggugaccgaaguuaaaggauacacaaagggcggucccgggcacgaggaaccgauaccaauggcaacguacggauggaacuuagugaaacugcauucuggcaaggacgucuuuuucaucccucccgagaaaugugauacccuucugugcgacauuggcgaguccucaccaaaucccacuaucgaagaggggagaacacuaagggugcucaagauggucgaaccuuggcugcggggaaaccaauuuuguauuaagaucuugaauccguauaugcccagcgugguugagacccuggagcagaugcagcgcaaauacgguggcaugcucguaagaaacccacuuucgagaaauucuacucacgaaauguauugggugaguugcgggacaggaaacauugucuccgccgugaauaugaccagccgaaugcuguuaaaccgguucacgauggcucaucguaagccuaccuacgagagagauguugaccugggcgccgguacacgccacguggcagucgaacccgagguggccaacuuggauaucauagggcagaggauugaaaauaucaaacacgagcauaagucaacuuggcacuaugacgaggauaacccuuacaaaaccugggcuuaucauggauccuacgaaguaaagccaucuggcagcgcgaguuccauggugaauggcguugucaagcuccugacaaaacccugggacgugaucccuauggugacucaaauugccaugaccgauacaaccccauuugggcagcagcgggucuucaaggagaaaguugacacuagaacgcccaaggcaaaacgcggaacagcucaaauaauggaagugaccgccagguggcuaugggguuuucuuagccgaaacaagaagccgcggaucuguacuagagaggaguucaccaggaaaguacgcucuaaugcagccauuggcgcuguguuugucgacgagaaccaguggaacucagccaaggaggcgguggaagaugagcguuucugggaccugguucaccgggaaagagagcuccauaaacaggggaagugcgcaacaugcguguacaacaugaugggaaaaagggaaaagaagcugggcgaguuugguaaagccaaggggagucgcgcuaucugguauaugugguugggagcccgauuccuggaguucgaagcacucggcuuuaugaaugaggaucacugguucucccgggaaaacagccuuucuggcgucgagggggagggacugcacaaauuagguuacauucugagagacaucucgaagauaccuggcgggaauauguaugcugaugacacggccggaugggauaccaggaucacugaagacgauuugcagaacgaggcuaaaauuacagacaucauggaaccagagcaugcccuccuggcaaaggcgauuuuuaaacuaaccuaccaaaauaaggugguacgcguucagagacccgccaagaacggcacugugauggaugucaucucacggagggaccagcgugguagcggacaggugggaacauauggccuuaauaccuucacaaacauggaagcucaacugauacgacagauggaguccgagggcauuuuucucccuagugaacuggagacuccaaacuuggccgaacgcguguuagauuggcuggagaaauacggggucgaaagacucaagcggauggcaaucucuggagacgacuguguugugaaacccaucgaugacagguucgcuaccgcccuuacggcacugaaugauauggguaagguacgcaaagacauuccgcagugggagccuagcaagggcuggaacgauuggcagcaagugcccuuuugcucccaccauuuccaccagcuaauaaugaaggacgggagagagaucgucgugccaugucggaaucaggaugaacugguuggaagggcccgagugucacagggcgcggguuggagucuccgugagaccgcuugcuuggggaaaucuuaugcccaaauguggcagcugauguacuuucacagacgcgaccuucggcuggcagccaacgcuauuuguagcgccgucccuguggauuggguacccacauccaggacuaccuggucaauccaugcacaccaucaguggaugacaacugaagacaugcucagcguuuggaauagaguguggauugaggaaaacccauggauggaggauaagacccacaucucuuccugggaggacguccccuacuuaggaaaacgcgaagaccaauggugcggcagucugauaggcuugacggcucgggccacaugggcgaccaauauccagguggcuauuaaccagguuaggcgacugaucgggaaugagaacuaucucgauuacaugacuagcaugaagagauucaaaaaugaaucggacccugagggagcccuuugguga

SEQ ID NO: 14220 - RNA, 9879 nt, Artificial Sequence
  derived and/or modified CDS sequence (opt3) from DENV-1__KC172834__SS-prME
agcgugaccaugcugcucaugcuuaugcccaccgcccuggcuuuccacuugacuacgagaggaggggaaccucauaugaucgucuccaagcaggaaagagggaaaucuuuacuguuuaagaccucagccgguguuaauaugugcacacugauugccauggaccucggagaacugugugaagauacuaugaccuacaaaugcccacggauaacagaggcggaaccggacgauguggacuguuggugcaaugcuaccgauacuuggguaacauaugggaccuguagucaggccggagagcaccgccgagacaagcguagcguggcacuugcaccccaugucggccuggguuuggagacgagaacugaaaccuggauguccucugagggggcuuggaaacagauccagaggguggaaacaugggcacuccggcacccuggauucacuguuauugcccuguuucuggcucaugccaucggcaccucgauuacacagaagggcaucauauucauccucuuaaugcuggugaccccaucaauggcgaugcgcugcgucgggauuggaagcagagauuuuguggagggucuuaguggcgcaacguggguagacguuguguuggagcacggguccugugucacuacaauggccaaggauaaacccacccuggacaucgaacuacucaagacugaggugacaaacccugcugugcugaggaaacuuugcauugaagccaagaucucuaauaccacgaccgauagccgguguccaacacaaggagaggcaacucuggucgaagaacaggacgcuaacuucguuugccgccgaaccuuuguggauagaggcugggguaauggguguggauuguucggcaaaggcucccuccugacaugcgccaaguuuaagugcguaacuaaauuagaggggaagauagugcaguacgaaaaccugaaauauucagucauugugaccguucacacaggagaccagcaucaaguggguaaugagaguaccgaacacggcacuacggcgacaaucacaccccaggccccuacuaccgagauucagcucacagacuacggggcacuuacccuggauuguagcccaaggacuggauuggacuucaacgaaaugguccuacugacaaugaaggagaaaucuuggcucgugcauaagcagugguuucuggaucuuccgcugcccuggacguccggcgcuucaaccagccaagagacuuggaaucggcaggacuugcucguaacauucaaaaccgcccacgcuaagaagcaggaaguugugguccuggguagucaagagggggccaugcacacagcauuaacuggcgccaccgaaauccagacgucuggaaccacaacuaucuuugcuggccaucugaaaugccgucuaaagauggauaaacucacccugaaggggauguccuaugugauguguacaggcagcuucaaacuugagaaggaagucgcggagacucagcacgguaccguguugguucagauuaaguacgagggcacggacgcaccuugcaaaauaccauucucgacacaagaugaaaagggggugacccagaacggacgccugaucacugccaaucccauuguaacagacaaagagaagccugucaacaucgaagcugagccacccuuuggcgagucuuauauagugauuggugccggggaaaaagcacucaagcuguccugguucaagaaaggcucaaguaucggaaagauguuugaggccaccgcuagaggcgccaggcggauggcaauccuuggggauacugcgugggacuucggaagcauugguggcguuuuuaccuccguggggaaacugguccaucagaucuucggaacagcuuacggcguguuguuuucugguguaagcuggacgaugaagauugggauaggcgugcuccugaccugguuaggacuaaauucacgaaguacuucccuaagcaugacauguaucgccguuggccucgucacccuguaccuuggggugauggugcaggcagauucuggaugcgucauuaacuggaaaggccgcgaauugaagugugguucagggaucuucguuacaaaugaggugcacacuuggaccgaacaauauaaguuucaggccgacaguccgaaaagacugagcgcugccaucggaaaggcaugggaggagggcgugugcgguauuagguccgcuacgcggcucgaaaacauaauguggaaacagaucucuaacgagcugaaucauauuuuacuggaaaacgacaugaaguucacaguagucgugggcgauguugccgggauccuugcgcagggcaagaagaugauucgcccucaacccauggaguacaaauauucguggaaaagcuggggcaaggccaagaucauaggggcugacgugcaaaauuccaccuuuaucauugauggaccaaacacuccugaaugucccgacgaucagagagcauggaauaucugggaggucgaggacuacggcuucgguauuuuuaccacaaacaucugguugaagcucagggauucauauacucaggugugcgaccaccgucugaugagugccgcuauaaaagauucuaaggccguucacgcagacaugggguacuggauugaaagcgagaaaaaugaaaccuggaagcuagcgcgggccuccuucaucgaggugaagacauguauuuggccaaaaucacauacgcuguggagcaacggaguacucgaaucugagaugaucauacccaagaucuauggcgguccuauuucccaacacaauuaccgaccaggcuacuucacccagacugcugggccguggcaucugggaaaacuugaguuggauuuugaccugugcgaaggcacaaccgucgugguggaugagcacugcgggaacagaggacccaguuuaaggacuacaaccgucacgggcaagaucauucacgaaugguguugccgcagcuguacucucccuccacugcgguucagaggugaggacgggugcugguauggaauggagaucaggcccguuaaagaaaaggaggaaaaucuugugaagucuaugguauccgccggcucaggugagguggacaguuuuagccugggcuugcucuguauaucgauuaugaucgaagaggucaugcgcucccgauggucucggaaaaugcugaugaccgggacacuagcaguguucuuucugcucaucaugggacagcugaccuggaacgaucuuauucguuugugcaucaugguuggcgcuaaugccagcgacagaauggggaugggaacuacauaccuggcauuaauggccaccuucaagaugaggccuauguuugcugugggccuccuguuccgccggcuuacaucaagagagguccugcuacucacuauuggucugaguuugguggcguccguugaacugccaaacucuuuagaggaacucggggauggacuggccaugggcauaaugauccuuaaacuguugaccgacuuucaaagccaucagcucugggcaacgcugcuaucccugacauucauuaagaccacuuuuucacuucacuaugcuuggaaaaccauggccauggugcucagcaucgucagucuguuccccuugugucugucuacaacuucccagaagaccacgugguuaccgguacuccugggcagccuugggugcaagccucugacaauguuuuugauugccgagaauaaaaucuggggaaggaagucguggccacucaacgaagguauaauggcugugggcaucguuucaauucugcuaucuagucugcuuaaaaacgaugugccccucgcagggccucugaucgccggaggcauguugauugcguguuacgucaucuccgguagcucugcugacuuaagccuggagaaggccgcagagguguccugggaagaggaagccgagcauucaggggcuagucacaauauacucguagaagugcaggaugacggaaccaugaaaauuaaggaugaggagcgagacgauacucugacaauccuucugaaagcaaccuugcuagccgucagcggcguuuauccccugucuaucccagcgacucucuucgugugguacuucuggcaaaagaagaaacagcgcuccggcgugcugugggacacaccuucacccccagaagucgagcgggcugugcuugaugacgggauuuauagaauaaugcagaggggauuacugggucguagucagguuggcguagggguguuucaagaaaacgucuuccauaccauguggcacgugacgcgcggagccguucucauguaccagggcaagcgguuggagccgagcugggcauccgugaaaaaggaccugaucucuuacggugggggauggagauuucagggcucguggaauacuggcgaggaaguccaggugauugccguagagccugggaaaaaccccaagaauguccaaaccgcuccaggaacauucaagacccccgaaggugaggugggcgccaucgcacucgauuuuaaaccugggacaagcggaucaccaauuguuaacagggaaggcaagaucgugggucuguaugggaauggagucgugacuaccuccggcacguacguuagugcuauagcccaggcgaaagccucucaggagggcccccuuccugagaucgaagacgagguguuccgaaagcggaaccugacaauuauggauuugcacccggggagcggaaaaacucgcagauaucuaccagcaaucgucagggaagcuauuaagcggaagcugcgaacccucaucuuagcccccacaagagugguagcuuccgagauggcagaagcccugaaagguaugccuauacgcuaccaaaccacugccgugaagucagagcauaccggcaaagagauuguugaccuuaugugccacgcuacauuuacgaugaggcugcucucuccaguccgugugcccaauuauaacaugaucaucauggaugaagcgcauuucacugacccuagcaguauugcagcccggggguacaucuccaccagagugggaaugggcgaggcugccgcaauauuuaugacagccaccccgcccgguagcauggaggcuuucccacagucuaaugcggucauucaggaugaggaaagggacaucccugagcgcucauggaacuuggggcacgaguggauuacugauuuucccggaaagacaguaugguucgugccauccaucaaagccggcaaugacauagcaaacugucugcgaaagaauggcaagagaguuauucagcucagucggaaaaccuucgauacggaauaucaaaagacuaaaaacaacgacugggacuacguggucacaaccgauaucagcgagaugggggcuaauuuuagggccgaccgcgugaucgauccucguagaugccugaagcccguuauucuuaaagacggaccagaacgggugauccuagcagguccgaugccugucaccguggccucggcugcccagaggcgcggccgaauugggagaaaccauaauaaggagggagaucaguacauauauaugggccagccccugaacaaugacgaggaucacgcgcacuggacugaagcaaagauguuguuagacaacaucaauacaccagaggguauuauccccgcccuguucgaaccugagcgggaaaaaucugcugccaucgauggggaguacaggcuccgcggcgaggcuagaaagaccuuuguagaacugaugaggcggggagaccuuccaguguggcuguccuauaaaguugcaagcgagggcuuccaauacucagaucgucgcuggugcuuugacggggaacgaaacaaucagguccucgaggaaaacauggauguggagauuuggacaaaggagggagaaaggaagaaguugaggccccgguggcuggacgcccgcacuuauagugacccucuagcucugagagaguucaaagaauuugccgcagguaggcggucuguguccggcgaucucauacuugagaucgggaagcugccgcagcauuuaacgcagcgagcgcaaaaugccuuggacaaccuggucauucuccacaauagcgaacagggaggcagagcuuaccgccaugccauggaggagcugccagauaccaucgaaacacuuaugcugcucgcauugauugcuguucugacugguggggugaccuuauucuuucuaucaggcaagggacugggcaaaacaaguaucgggcuccuuuguguaauggccagcuccgugcuguuguggauggcaucugucgagccccacuggauagccgcuagcaucauucuggaguucuuucucauggugcugcuuaucccugagcccgacaggcagcggaccccacaggauaaccaacucgcguauguugugauuggacuguuguucaugauccugacugucgccgcaaaugagauggguuuacuagaaacgaccaagaaagaccugggcauagggcacguagcuguggagaaccaucaccaugccgccaugcucgauguugaccuucacccugcauccgcuuggacacuguacgccguggcgacuaccauuaucacacccaugaugcgucauaccauugaaaacacuacagcuaauaucucauugacggccauagcaaaccaggccgcuauccugaugggacucgauaagggcuggccaauuucuaaaauggacaucggugucccucugcuugcauuagggugcuacagucaggugaauccgcugacccucacugccgcggucuugaugcugguggcucacuaugccauuaucggccccggacuacaagcaaaggccacaagagaggcucagaagaggaccgccgcaggcauaaugaaaaacccaaccauugaugggaucguugcuaucgaccuggauccugugguauacgacgccaaguuugaaaaacagcucggacagauuaugcuucugaucuuguguacaucgcaaauacugcucaugcgcacuacgugggcgcugugcgagagcauuaccuuagccacaggcccccuuacuacccugugggaggguuccccagggaaguucuggaauacaaccaucgcagugucuauggcuaacauuuuccggggaucauaucucgccggcgcaggucuagcuuuuagccugaugaaauccuugggcgggggacgaagaggcacuggggcccagggagaaacgcugggcgagaaguggaagaggcagcucaaucagcuuaguaaaucugaguucaacacauacaagcgcagcgguaucauggaagucgaccggucagaagccaaagaggggcugaagagaggagagaccacuaaacacgcgguuucccguggcaccgcuaaguugaggugguuuguggaacggaaucuggucaagccugaggguaaagugauagaucucggcugugggcgcggaggcuggaguuauuacugcgcaggguuaaagaaaguaacagaagugaagggauauacuaaaggcggucccgggcaugaggaaccgaucccaauggccaccuacggauggaaccugguuaaacuucacagcggcaaagacguguucuuugucccucccgagaagugugauacacugcuaugcgacauuggcgagucuuccccaaaucccacgaucgaagaggggcgaacccucagagugcugaagauggucgaaccuugguugaggggaaaccaauucuguauuaaaauccugaauccguacaugcccucagugguugagacucucgagcagaugcagcggaagcaugguggcaugcuuguacgcaacccacugagcagaaauucgacacacgaaauguauugggugucuugcgggaccggaaacauugucagugcugugaauaugacuuccaggauguuacugaaccgauuuacaauggcccaccggaaaccuaccuacgagcgugauguugacuugggcgcagguacgagacauguggccgucgaacccgagguggcuaaccucgauaucauagggcagcgcauugaaaauaucaagcacgagcauaaaagcaccuggcacuaugacgaggauaacccuuacaagacaugggcguaucauggaucauacgaaguaaagccauccggcucugccagcaguauggugaauggcguugucaaacugcuaacuaagcccugggacgugaucccuauggugacccaaauugcaaugacagauacuaccccauucgggcagcagagggucuuuaaagagaagguugacacacggacccccaaagcuaagagaggaacugcccaaauaauggaagugacggcacgcuggcuuugggguuuccuguccaggaacaagaaaccgcgaaucuguacacgggaggaauuuaccagaaagguaaggagcaaugccgcuauuggcgccguguucgucgacgagaaccaguggaacucugcgaaagaggcaguggaagaugaccgcuuuugggaucucguucaccgugagcgggaacugcacaagcaggggaaaugcgccacuugcguguauaacaugaugggaaagagagagaagaaauugggcgaguucgguaaggcuaaagggucaagggccaucugguacauguggcugggagcacgcuuccucgaguuugaggcucuuggcuucaugaaugaagaccauugguuuagucgagagaacucccugagcggcgucgaaggggagggauuacacaagcuggguuacauuuugcgggauaucucuaaaauaccuggcgggaauauguaugccgacgauaccgcuggaugggacacaagaaucacggaggaugaccuccagaacgaagccaagauuaccgauaucauggagccagaacaugcacugcuagcgaaaucgauuuucaaacuuacuuaccaaaauaaggugguaaggguucagcgccccgccaaaaacggcacagugauggacgucaucucaagacgggaucagagggguagcggacaggugggaaccuauggccugaauacuuuuacaaacauggaggcucaacucauacgucagauggaauccgagggcauuuucaguccuaacgagcuggaaaccccaaauuuggccgagcgaguguuagacuggcuggaaaaguacggggucgagcgccucaaaagaauggcaaucucuggagacgauuguguugugaagcccaucgacgaucgguuugcuacagcccuuacugcacugaacgacauggguaaaguaaggaaggauauuccgcagugggaaccuagcaagggcuggaaugacuggcagcaagugcccuucugcucccaccacuuucaucagcuaauaaugaaagaugggcgcgagaucgucgugccauguagaaaccaggacgagcugguuggacgggccagggugucacagggcgcggguugggggcuccgagaaaccgcuugcuugggaaagaguuaugcccaaauguggcagcugauguacuuccaccguagagaucuucgccuggcagccaaugcuauuuguucugccgucccuguggacuggguacccacgagccggaccacaugguccauccaugcacaccaucaguggaugacuaccgaggauaugcucucaguuuggaacaggguguggauugaagagaauccauggauggaagacaaaacaagaaucagcucuugggaggacguccccuauuuaggcaagcgcgaggaucaauggugcggcucccugauaggguugacugcucgggccaccugggcgacgaacauccagguggcuauuaaucagguuaggcgacugaucggaaacgaaaauuacagugacuacaugacaagcaugaaaagauuuaagaacgagucggaaccugagggugcccucugguga

SEQ ID NO: 14221 - RNA, 9879 nt, Artificial Sequence
  derived and/or modified CDS sequence (opt3) from DENV-1__KJ933413__SS-prME
uccgugaccaugcugcucaugcuucugcccacagccuuggcuuuccacuuaacuacgaggggaggggaaccucauaugaucgucuccaagcaggaaaggggaaaaucucugcuauuuaagaccucaacagguguuaauaugugcacucucauugcaauggaccugggcgaacuuugugaagauaccaugacauacaaaugcccacggauaaccgaaacugaaccggacgauguggacuguuggugcaaugccacagagaccuggguaacguaugggacuuguagucaaaccggagagcaccgccgagauaagcguagcguggcgcuggcuccccaugucggcuugggucucgaaacaagaacugagaccuggauguccucugaaggggccuggaggcagauccagaaaguggagacaugggcacugcggcacccuggauucaccguuauugcccuguuucucgcucaugcaaucggcacgucgauuacucagaagggcaucauauucaucuuacugaugcuugugacaccaucaauggccaugcgcugcgucgggauuggaaaccgggacuuuguggaggguuugagcggcgcuaccuggguagauguugugcuggaacacgggaguugugucacuacaauggccaaggacaaacccacccuagauaucgagcuccugaagacggaagugaccaauccugcggugcuuaggaaacugugcauugaggcaaagaucuccaacacaacuaccgacucucgguguccaacacaaggagaagccacuuuggucgaggagcaggauaccaauuucguuugccgccgaacacucguggacagaggcugggguaacggguguggacuguuuggcaaaggcagcuuaauaaccugcgcuaaguucaagugcguaacuaaacuggaagggaagauugugcaguacgagaaucucaaauauuccgucaucgugacgguucacacaggagaucagcaucaaguggguaacgaaaccacugagcacggcaccacagccaccauuacuccccaggcaccuacaucagaaauccagcuuacggacuacggggcucugaccuuggacuguaguccaaggacuggacuagauuuuaaugagaugguccugcucacaaugaaggagaaaagcuggcuggugcauaagcagugguuccuugaccugccguugcccuggaccucuggcgccuccacaucacaagaaacuuggaaccggcaggaucuccugguaaccuuuaaaacggcgcacgccaagaagcaggagguuguggucuuagguagccaagaaggggcaaugcacaccgcucugacaggcgccacugagauccagaccaguggaacaacuaccauuuucgcuggccaucuaaaaugccgucucaagauggacaaacugacgcuuaagggggugucuuaugucauguguacaggauccuuuaaauuggaaaaggagguggccgagacccagcacgguacuguucuggugcagguaaaguacgaaggcacagaugcaccuugcaaaauaccauucaccagccaagacgagaagggggucacucagaauggacgccucaucaccgccaaccccauugugacagauaaagaaaagccuguuaauaucgaggcugagccacccuucggcgaaucguaucugguggucggugcgggggagaaagcacuuaagcugucuugguuuaagaaaggcuccucaauaggaaagauguucgaagccacggcuagaggcgccaggcggauggcaauuuugggggacaccgccugggauuuuggaaguaucgguggcguguucacuagcguagggaaacucauccaucagauuuuuggaacagcuuacggcgugcuguucuccgguguuucuuggaccaugaagaucgggauuggcauauuacugacauggcuaggacucaacagccgaucaacaagucuguccaugaccuguaucgccgucggcauggugacgcuuuacuugggggugaugguccaggcagacagcggaugcguuauuaauuggaaaggccgcgagcugaagugugguucugggaucuuugugacaaacgaagugcacaccuggacugagcaauauaaguuccaggcggauucaccgaaaagacucagugcugccaucggaaaggcaugggaggaaggcguaugcgguauuaggagcgucacccggcuggagaacauaauguggaaacagaucuccaaugaauuaaaccauauucugcuugagaaugacaugaaguuuacagugguugugggcgacgucaacgggaucuuggcccagggcaagaagaugauucgcccucaacccauggaacacaaauacucuuggaagucguggggcaaggcuaaagugaucggggccgauguucagaauagcacuuucauaaucgacggaccaaacaccccugagugucccgaugaccagagagcauggaauauuugggagguggaagauuauggcuuugguaucuucacaacgaacauuuggcucaagcugagggacuccuacacccagguaugcgaucaccgucuaaugucagcugccaucaaagacaguaaggcgguccaugccgauaugggguauuggauagagucugagaaaaaugagacuuggaagcugacacgggcuagcuuuauugaagugaagaccuguguguggccaaaaucccacacucucuggucaaacggaguccuggagagcgagaugaucauucccaagaucuacggcgguccuauaucucaacauaauuaucgaccaggcuacuucacacagaccgcagggccguggcaccuuggaaaauuggaacuggacuucggcuuaugcgaggggacgacuguugugguagaugaacacugcggaaacagaggccccucccucaggaccacaaccgugacugguaagaucauucaugagugguguugccgcaguuguacacugccuccacuucgguuuaaaggggaggacggaugcugguacggcauggaaaucagacccgucaaggagaaggaagagaaucuggugaaaagcaugguuucugccgguuccggcgaaguggauucauucaguuuggggcuccuguguauuagcaucaugauagaggaggucaugaggucgcgcuggucccgaaagaugcuaaugaccggaacacuggcuguguuucuccugcuuauuaugggccaguugacuuggaacgaccugauccgguuaugcaucaugguuggggccaaugcaucugacaaaaugggaaugggcaccacguaucucgcgcugauggccacauuccguaugagaccuauguuugcugugggucuucuguucaggcgccuaaccagccgggaaguccuccuguugacuguagggcugucauuaguggccaguguugagcucccaaacucccuggaagaacuuggagauggccuggcaaugggcauuaugauguugaagcuccugaccgacuuucaaucucaccagcuaugggcugcccugcuuagccucacauucgugaaaacuaccuuuucccugcauuacgcauggaagacgauggccaugaucuugucaauugucagccuguuccccuuaugucucaguacaaccucucagaagacuacauggcugccggugcuucugggguccuugggaugcaaaccucucaccauguuucugauaacugaaaacagaaucugggguaggaaaagcuggccacuaaaugagggcauuauggcuguagggaucgugucgauucugcuuucaucucuccugaaaaacgauguccccuuggcgggaccuuuaaucgccggcgguaugcugauagcauguuauguuaucaguggguccagcgcugaccucucucuggagaaggccgccgaagugagcugggaggaagaggcugaacacuccggagcaucacauaauauucuuguggagguccaggaugacggcacaaugaaaaucaaggaugaggaacgagacgauacccugacgauuuugcuaaaagccacucugcucgcgaucaguggcguguaccccaugagcauaccagcuacccuguucguuugguauuuuuggcaaaagaagaaacagcgcucugggguacuuugggacacaccuucacccccagagguggaacgggccgucuuagaugacggaauuuacagaauccugcagaggggucucuugggcaagagccagguggggguuggaguguuccaagagggcgucuuccacaccauguggcacgugacacguggugcaguacugauguaucaggggaaacgccucgagccgaguugggccagcgucaagaaagaucugaucuccuacggaggcggcuggcgguuucaggggucuuggaacacuggagaagaggugcagguuauugcuguggaaccugguaagaaucccaagaacguccaaaccgcaccaggcacguucaaaacacccgagggggaagugggagccauagcgcuugacuuuaagccuggcacuucggguagcccaaucguuaauagagaggggaaaauugugggacuguacggcaacggcgucgugaccacaucagggaccuauguauccgcuaucgcccaggcaaaggccagucaggagggacccuugccugaaauugaggacgaaguguucaggaaacgaaaucuaacuaucauggaucugcauccggguucuggcaagacccggcgcuaccucccagcuauaguuagagaggccaucaagaggaaauuacggacacugguccuugcacccacgcgagugguggcuagcgaaauggccgaggcgcugaaggggaugccuauuagauaucaaacuaccgccgucaaauccgagcacacaggaaaggaaaucguagaccucaugugccaugcaaccuuuacuaugcgcuugcugucaccagugaggguucccaacuacaauaugauuaucauggaugaggcucacuucacagacccugccucuauagcugcacguggcuauauuagcacccggguggguaugggggaagccgccgcuaucuuuaugacggcgacuccgcccggaaguauggaggcauucccacaguccaacgccgcuauccaggaugaagagagagacauuccugagaggagcuggaacucuggcuacgauuggaucacagacuuucccggcaaaaccgucugguucgugccaucaauaaaguccgggaacgauauugccaauugucuccgcaagaacggaaaacgaguugugcagcugaguagaaagaccuuugacacugaauaucaaaagacuaagaacaaugauugggacuacgucgugaccacagacaucagcgagaugggugcaaacuuccgggccgauaggguaauugacccucgccguugccuuaaacccgugauccuaaaggauggcccagaaagaguuauacuggcugggccgaugccugucacuguggcgucggccgcacagcggaggggacgcauuggccgaaaucagaacaaggagggugaccaguacaucuauauggggcaacccuugaauaacgaugaggaccaugcucacuggacggaagccaaaauguuacuggauaauaucaacaccccagagggcauuauccccgcacucuucgaaccugagagagaaaagucugccgcuauugacggagaguaccggcugaggggcgaggcccgcaaaacauuuguggaacuuaugagaagaggggaucugccagucuggcucuccuauaagguugcgagcgagggauuccaguacucagaccggcguuggugcuuugauggugaacgcaauaaccagguguuggaggaaaauauggacguagagauauggacuaaagagggcgaacgaaagaaacugagacccagguggcuagaugcacggaccuauagugacccucuggcccuccgcgaguucaaggaauuugcugccgggagaaggucuguguccggagaccuuauccuggagauuggcaaguuaccgcagcacuugacacaacgggcucagaacgcacuggauaaucucgucaugcugcauaacagcgaacagggugggaaagccuaccgacacgcuauggaggagcuuccagacaccaucgaaacucugaugcucuuggcccugaucgcaguguuaacgggcggaguuacccuauucuuucugucaggcagagggcucggaaagacaaguauuggucuucugugugugauggcgagcuccgccuugcuguggauggcuucugucgagccccauuggauagccgcaagcaucauucucgaguucuuucugaugguacuucucaucccugagcccgaucgccagaggacuccacaagacaaucagcuggcuuaugugguuauuggcuugcuguucaugaucuuaaccguggccgcaaacgagauggggcuacuggaaacaaccaaaaaggaucucggaauaggccacgucgccgcugagucccaccaucacgcggccaugcuugacguggaucugcauccugcaucagcuuggacuuuguacgccgucgccacaacggugaucacccccaugaugcggcacacuauugaaaacacaaccgcaaauaucucucugaccgcuauugccaaccaggcggcuauccucaugggucuggacaaaggguggccaauaaguaagauggauauuggcguuccucuuuuagcccugggaugcuacucgcaagugaauccgcucacauugacugcagccguacugaugcuaguggcucauuaugcaaucauuggccccgggcugcaggccaaggcgacgcgugaggcucagaaaagaaccgccgcaggaaucaugaagaacccaacagucgacggcauaguugccaucgaucucgacccuguggucuacgaugcuaaauuugaaaagcagcuuggucaaauuaugcuguugauccuguguacuagccagauucuccugaugaggaccacaugggccuuaugcgaguccaucacccuugcaacugggccccugacgacacucugggagggaucuccaggcaaauucuggaauaccacuauagcugugucaauggccaacauuuuucgcgguagcuaucuagcgggcgccgggcuggcauucuccuugaugaagagucugggaggcgggcggcgaggaaccggcgcucagggugaaacacucggggagaaguggaaaagacagcuuaaucaacugucuaagagcgaguucaacacuuacaaaaggucaggaaucaucgagguagaccgcuccgaagccaaggagggcuugaaacggggugagaccacaaagcacgcagugaguagaggcacggcuaagcugcguugguuuguugaaaggaaucucgugaaaccugaggggaaggucauugacuuaggauguggcagagggggauggagcuauuacugcgccggccugaaaaaggugaccgaagucaaagguuauacuaaagggggacccggccacgaggaaccgaucccaauggccacauacggcuggaaccuugugaaacugcauucugggaaggauguuuucuuuaccccucccgagaagugugacacucuacucugcgauauaggagaguccucaccaaaucccacaauugaagagggucgcacccugcgaguauugaaaaugguggaaccuuggcugagaggcaaccaguucuguaucaagguccucaauccguacaugcccagcgugguugagacgcuugagcagaugcagaggaaacacgggggaaugcuggugcggaacccauuaucgcgcaauucuacccaugaaauguauugggucaguugcggcacagguaacauuguguccgcgguaaauaugacuagcagaaugcuguugaacagguuuaccauggcucaccgaaagccuacauacgagcgggacguggaucucggggcaggaacucgucacguugccgucgaacccgagguggcuaaccuggacaucauaggccaaagaaucgaaaauauuaaaaacgagcauaagucaaccuggcacuaugaugaggacaauccuuacaagacaugggccuaucauggcuccuacgaagugaaaccaucugggagcgcaaguuccauggucaacggaguugugcgccuacuuaccaagcccugggauguaaucccuauggugacucagauugccaugacggacacaaccccauucggucagcaaagggucuuuaaagagaagguggauacucggacccccaaagcuaagagaggcacagcgcagaucauggaaguuacggcccgcuggcuguggggguuccucagcaggaauaagaaaccgcgaauuuguacccgggaggaauuuacuaagaaagugagaucuaacgcagcuaucggagccgucuucguggacgagaaucaguggaacucagcaaaggaggccguagaagacgagagguuuugggaucugguucaccgcgaacgugaguugcauaaacagggcaagugcgcuacaugcguguauaauaugauggguaagcgggagaaaaagcugggggaguucggaaaagccaagggcaguagagcgauaugguacauguggcucggcgcaagguuucuugaguucgaagcccugggguucaugaacgaggaccacugguuuucccgcgaaaauagcuuaucuggagucgagggugagggccugcacaaauugggguacauucuccgagauaucucgaagaucccuggaggcaacauguaugcugacgauaccgccgguugggacacucggauuacagaagaugaccugcaaaaugaggcaaaaauaaccgauaucauggaaccagagcaugcucuacuugccacaucaauuuucaagcugacuuaccagaacaagguggugagaguccagaggcccgcuaaaaaugggaccguuauggacgugaucagccgcagagaucagcggggauccggccaaguaggcacguaugggcucaacaccuuuacaaacauggaagcccagcugauuaggcagauggagagugagggaaucuucuugccuucugaauuagagacuccaaaucuggcagaacgugugcucgacuggcuugagaaguacgguauagaacgacugaaacgcauggcgaucagcggcgaugacugugucgugaagcccauugacgauagauuugccaccgcucuaacagcccugaacgacauggggaaaguucggaaggauaucccgcagugggagccuuccaagggauggaaugacuggcaacaggugcccuucugcucacaccauuuucaccagcucauuaugaaagauggcagggagaucgucgugccaugucgcaaccaggacgaauugguagguagagcacggguuagucaaggggcuggauggucucugagggagacugccugccuuggcaagagcuaugcacagauguggcagcugauguacuuccaccgacgugaucucagauuagccgcgaaugcuauauguuccgccgugccugucgacugggugcccaccucacgcacgacauggagcauucaugcacaccaucaauggaugaccacugaagauaugcugucuguuuggaaccggguguggaucgaggaaaauccauggauggaggacaaaacacacgucuccaguugggaggaugugcccuauuugggcaagagggaagaccaguggugcgggagccugaucggacucaccgccagagcuacuugggccaccaacauucagguagcaauaaaucaggugcgccggcuuaucgguaacgagaauuaccuggacuacaugacaucgaugaaaagguuuaagaacgaauccgauccugagggcgcucuaugguga

SEQ ID NO: 14222 - RNA, 9879 nt, Artificial Sequence
  derived and/or modified CDS sequence (opt3) from DENV-1__KU666942__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccauucugaggaaacuuugcaucgaagcuaagauaucuaauacgaccacagauagccgguguccaacucaaggagaggccacccugguggaagaacaggacgcaaacuucgucugccgccgaacauuuguugauagaggcugggguaauggguguggauuguucggcaaaggcucccucauuacuugcgcuaaguuuaagugcgugaccaaacuggaggggaagaucguacaguacgaaaacuuaaaauauucagugauugucacagugcacaccggagaccagcaucaaguugguaaugagaguacugaacacggcacgacagccaccaucacuccccaggcgccuaccacagagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauucagaccucuggaacaacuaccauauuugccggccauuuaaaaugccgucugaagauggauaaacuaacacucaaggggauguccuaugucauguguacugguucguucaaacuggagaaggaaguggcugagacccagcacgguacgguccuugugcagaucaaguacgagggcacagacgcgccuugcaaaauuccauucucgacccaagaugaaaaggggguuacucagaacggacgcuugaucacagcaaaucccauagugaccgacaaagagaagccuguaaacauugaagccgagccacccuuuggcgagucuuauaucgucaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcguguuuacauccguugggaaacuugugcaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcacagccauaggaaaggcuugggaggagggcgugugcgguaucagguccgccacccggcuggaaaacauuauguggaaacagaucucuaacgagcucaaucauauucuguuagaaaacggcaugaaguucacugugguagucggggacguggcaggaauccuggcucagggcaaaaagaugauacgcccucaacccauggagcacaaauacucguggaaaagcugggggaaggccaagaucauuggagcggauguucagaauaccacauuuaucauugacggcccaaacacuccugaaugucccgaugaccagagagccuggaauaucugggagguggaggauuaugguuucgggauauuuaccacaaacauuuggcuuaaguugagggacuccuacacgcaggucugcgaucaccgucucaugucagcugcaaucaaagacaguaaggccgugcaugcugauaugggauauuggauugaaucugagaaaaaugaaaccuggaagcuggcccgggcauccuucaucgagguuaagacuuguauauggccaaaaucccacacacuauggucaaacggcgugcuggaaagcgagaugaucauucccaagaucuacgguggcccuauuucucaacauaauuaucgaccaggguacuucacccagacugcgggaccguggcaccucggcaaacuggagcuugacuuugauuugugcgaagggacaaccguagucguggacgagcacugcggaaacagaggccccucccugaggacgacuaccgugacagguaagaucauacaugaaugguguugccgcaguuguaccuuaccuccacuccgguacagaggggaggauggaugcugguauggcauggagauuaggcccgucaaagaaaaggaggaaaaucugguuaagagcauggugucugccgguuccggcgagguagacucauucagucuugggcuguuguguaucagcaucaugauugaagaggugaugcgcucgcgauggucccggaaaaugcucaugacuggaacacuggcugucuuuuuccuacugaucaugggccagcucaccuggaacgaccugauucgucuuugcauaauggugggggccaaugcaucugauagaaugggaaugggcacaacuuacuuggcucugauggccaccuuuaagaugaggccuauguucgcaguugguuuacucuuucgccggcugacgagcagagaggugcuucugcuaacaaucgggcucucacuggucgccaguauggaauugccaaacucccuggaggaauuaggagacggccucgcuaugggcauuaugauccugaaacuucugaccgauuuccaaucucaccaguugugggcgacucuccugagccuaaccuuuauuaagacaacuuucucccugcauuaugccuggaaaaccaucgcaauggugcuuucaauaguuagccucuuuccccuguguuugaguacgacaucucagaagaccacuuggcugccgguguuacucgggucccugggaugcaagccucuuacaauguuccugaucgcugagaauaaaauuugggguagaaagagcuggccauugaacgaaggcaucauggccgucgggauuguaucgauccuccugucaucucuacugaaaaacgacgugccccuugccggaccucucauagcuggcgguaugcugauugcauguuacguuaucaguggguccagcgccgauuugucuuuagagaaggcggcugaggugagcugggaagaggaagccgagcacuccggagcaucacauaauauccuggucgaagugcaggacgauggcaccaugaaaauuaaggacgaggagcgagaugacacucucacaauacugcuuaaagccacccuguuggcuguaaguggcguguauccccuaagcaucccagcaacgcuguuugucugguacuucuggcaaaagaagaaacagcgcucugggguucucugggauacuccuucacccccagaaguggagcgggccgugcuggacgauggaauuuauagaaucaugcagaggggucuuuuaggccguagccaggucggggugggaguuuuccaagaaaacguauuucacaccauguggcacgugacacgcggcgcgguccugauguaccaggguaagcggcucgagccgaguugggcuagcgugaaaaaggacuugauuuccuacgggggaggcuggagacugcagggcucuuggaauaccggggaggaaguucaggugaucgccgucgagccuggcaagaaucccaagaaugugcaaacagcaccagguacuuucaagacccccgaaggcgagguaggggccauagcucucgacuuuaaaccuggaacgucgggcagcccaaucgucaacagggaagguaagauuguggggcuguauggaaauggcguugugacaacuucaggcaccuacgucuccgccaucgcacaggcuaaagccagucaggaggggccccuuccugagauugaagaugagguguuccgaaagcggaaccugacaaucauggacuugcauccgggaucugguaaaacccgcagauaucuaccagcgauaguuagggaagccauuaagcggaagcugcgaacucucaucuuagcacccaccagaguggucgcuagcgagauggccgaagcucugaaaggcaugccuauccgcuaccaaacaacggcagugaaguccgagcacacugggaaagagauuguagaucuuaugugccaugccaccuuuacaaugaggcugcucucaccagugcguguucccaauuauaacaugaucauaauggacgaagcccacuucaccgauccuucuagcauugcugcgcggggauacaucaguacuagagucggcaugggugaggcagccgcuauuuuuaugacagccaccccgcccggguccguggaagcauucccacagagcaaugccgugauccaggacgaggaaagggauauaccugagcgcucuuggaacucaggauaugaguggauuacggacuuucccggcaagacugucugguucguaccauccaucaaaaguggcaaugauaucgcuaacuguuugcgaaagaaugggaagagagugauucagcugagccggaaaacauuugacaccgaauaccaaaagaccaaaaacaacgauugggacuacguugugacuacagacaucucggagaugggagcgaauuucagggccgaucgcgucauugacccucguagaugccucaagcccgugauacugaaagaugguccagaacggguuauccuugcaggcccgaugccugugaccgucgcuucugccgcacagaggcgcgggcgaauuggaagaaaccauaauaaggagggcgaccaguauaucuacaugggucagccccuaaacaaugaugaggaccacgcccacuggacagaagcuaagaugcuguuggauaacaucaauacuccagaggggauuauacccgccuuauucgaaccugagcgggaaaaauccgcggcaaucgacggcgaguauaggcugcgcggagaggccagaaagacguuuguggaacucaugaggcggggcgaucugccaguauggcuuagcuacaaaguggcuucagagggguuccaauauagugaccgucgcuggugcuuugauggagaacgaaacaaucagguucuggaggaaaacauggacgucgagauuuggaccaaggagggugaaaggaaaaagcucaggccccggugguuggaugcccgcacauacucugacccucuggcucuaagagaguucaaagaauuugcagccggcaggcgguccgugagcggggaccugauccucgagauuggaaaacuuccgcagcaucugacucagcgagcucaaaaugccuuagauaacuuggugaugcugcacaauucagaacagggcgguagagcauaucgccaugcgauggaggagcucccagacaccaucgaaacacugaugcuucuggcccucauagcugucuugaccgggggcguuacucuguucuuuuuaaguggaaagggccuagggaaaacgagcaucggacugcucugugugauggccuccucugcacuucuguggauggcuagcguagagccccacuggauugccgcauccaucauuuuggaguucuuucugauggugcuccugaucccugagcccgauaggcagcggaccccacaggacaaccaacuugccuacgucgugauaggucuccuguucaugauuuugacaguugcugcgaaugagaugggccuguuagaaacuaccaagaaagaucuagggaucggacacguggccgucgagaaccaucaccaugcagcuaugcuggacguagaucuccacccugccucagccuggacacuuuacgcaguggcuaccacuauuaucacacccaugaugcgucauacgauagaaaacaccacugccaauaucucucugacagcgauugcuaaccaggccgcaaucuugaugggccuggacaaggguuggccaauuaguaaaauggauaucgggguuccucuccuggcccuuggcugcuauagccaggugaauccguuaacccugaccgcugcaguccucauguugguggcccacuacgcgauaauuggacccggccugcaagcuaaggccacaagagaggcacagaagaggacugccgcugggaucaugaaaaacccaacggucgacggaaucguggccauugaucuagacccuguuguguaugaugcaaaguuugaaaaacagcugggccagaucaugcuccuuauacuguguaccagccaaauuuugcugaugcgcacaacuugggcucucugcgaguccaucacccuggccacaggucccuuaaccacucuuugggaggggucuccaggaaaguucuggaauacgacaauugcgguaucaauggccaacaucuuucggggcagcuaccuggcaggagcuggccucgccuucucccuaaugaaaagucuagggggaggccgaagagggaccggagcacagggcgaaacuuugggugagaaguggaagaggcagcugaaucagcucucuaaaagcgaguucaacaccuauaagcgcucagggauaauggagguggaccgguccgaagcuaaagagggacuuaagagaggcgagacaacuaaacacgccgucagucgugguaccgccaagcugaggugguuuguugaacggaauuuggugaagccugagggcaaagucaucgaccugggguguggacgcggcggguggagcuacuauugcgcgggacucaagaaagugacagaaguaaagggcuacacgaaaggugggcccggacaugaggaaccggugccaauggcuaccuacggcuggaacuuaguuaagcugcacucuggcaaagauguguucuuuauuccucccgagaagugugacacucuucugugcgauaucggggaguccucaccaaaucccacaauugaagagggacgaacccuaagaguccucaagaugguggaaccuuggcugagggguaaccaauucuguaucaaaauuuugaauccguauaugcccagcgucguggagacucuggagcagaugcagcggaagcauggcgggaugcucguucgcaacccacuuucgagaaauucuacacacgaaauguacuggguaaguugcggaaccggcaacaucguguccgcaauaaauaugacgagcaggaugcuguuaaaccgauuuaccauggcccaccggaaaccuacauaugagcgugacgucgaucugggugcugggacuagacauguggccguugaacccgagguggcaaacuuggacauuaucggacagcgcaucgaaaauauuaagugugagcacaaaucaaccuggcauuacgaugaggacaacccuuauaagacaugggccuaccacggcuccuaugaagucaagccaucuggcagcgcuaguuccauggugaaugggguagugaaacuccugacuaagcccugggauguuauaccuauggucacccaaaucgcgaugacagacaccacuccauucggacagcagaggguguuuaaagagaagguggauacgcggacacccaaagccaagagagguaccgcacaaauuauggaagucacugcucgcuggcuauggggcuuccuuagcaggaacaagaaaccgcgaaucugcacccgggaggaauuuacaagaaagguuaggucuaaugccgcaauuggggccguguucguagacgagaaccaguggaacucagcuaaagaggccguggaagacgagcgcuuuugggaucugguccaucgugaacgggagcuccacaagcagggaaaaugcgcgacguguguguacaacaugaugggcaagagagaaaagaaacugggugaguucgggaaggcaaaaggaaguagggccaucugguacaugugguugggcgcucgcuuucuggaguucgaagcccucggcuucaugaaugaggaccacugguuuucccgagaaaacagccuuucugggguugagggagagggucugcauaaguuaggcuauauacugcgggauaucucgaaaauuucagggggaaauauguacgcagacgauaccgcuggcugggacacuagaaucacagaagaugacuugcagaacgaggccaagauuaccgaaaucauggagccugaacacgcucaacucgccaaagcaauauucaagcugacuuaucagaauaagguggucagggugcagcgcccagcgaaaaacgguacaguaauggauguuauuagcagacgggaccagaggggguccggacaagugggcaccuacggccuaaauacauuuacuaacauggaggcccagcuuauccgucagauggagagugaagggaucuucucucccagcgagcuggaaaccccuaaccucgcugagcgaguccuggauugguuggaaaaguauggaguggagcgcuuaaaaagaauggccauuuccggugacgauugcguggucaagccaauagacgaccgguuugcaacggcucugaccgcccucaaugauaugggcaaaguuaggaaggacaucccccagugggagccgucaaagggguggaacgauuggcaacaggugccuuucuguagucaucacuuucaccagcuuauuaugaaagacggacgcgaaaucguagugcccugcagaaaucaggaugagcuggucggccgggcaagggugucucaaggugccggguggagccuacgagaaacagcgugucugggaaaguccuacgcucagauguggcagcucauguauuuccaucguagagacuugcgccuggccgcaaacgccauuugcucagcuguuccaguggauugggucccuacuagccggaccacauggucuauccacgcccaucaccaauggaugacuaccgaggacaugcuuuccguguggaauaggguauggauagaagagaaccccuggaugaaagauaagacgcauaucaguagcugggaggacguuccauaccugggcaaaagagaagaucagugguguggcucgcucauuggguuaacagcacgcgcuaccugggccacuaauauccagguggcgauuaaccagguccggaggcugaucggaaaugagaacuacuuggacuauaugacauccaugaagcgauuuaagaaugaaucugaccccgagggugcucugugguga

SEQ ID NO: 14223 - RNA, 9879 nt, Artificial Sequence
  derived and/or modified CDS sequence (opt3) from DENV-1__KU666939__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuuggguucuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaacuacucaagacagaggugaccaacccugcaguccugaggaaacuuugcauugaagccaagaucucuaauacgaccacagauagccgguguccaacucaaggagaggcuacccugguugaagagcaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccacagagauccagcugaccgacuacggggcgcucacucuugauugucugccaaggacaggauuggacuucaacgaaauggugcuacugacgaugaaggagaaaagcuggcucguacauaagcagugguuucuggaucuuccgcugcccuggaccucuggcgccuccacuucacaagagacauggaaucggcaggacuugcucguuaccuucaaaacagcacacgcuaagaagcaggaaguggucgugcuggguagccaagagggggccaugcacacugcuuuaaccggcgccacggaaauccagaccaguggaacaacuaccauuuuugcaggccaucugaaaugccgucuaaagauggauaaacucacacugaaggggaugucuuaugucauguguacuggauccuucaaacuugagaaggaaguggccgagacccagcacgguacgguuuuggugcagauaaaguacgagggcacagacgcuccuugcaaaaucccauucagcacccaagaugaaaaggggguaacucagaacggacgccugauuacagcgaaucccaucgucaccgacaaagagaagccugugaacauagaagcagagccacccuuuggcgagucguauauuguuaucggugccggggaaaaagcucucaagcugucuugguucaagaaaggcuccucaaucggaaagauguuugaggccacugcaagaggcgccaggcggauggcuauucuuggggauaccgccugggacuucggaaguaucgguggcguguuuacaagcgucgggaaacuggugcaucagauuuucggaacggcauacggcguauuguuuuccggugugucuuggaccaugaagauagggaucggcguucuccugacuugguuaggacugaauagccgaucaacaagucuauccaugaccuguauugcggucggccucgugacacuguaccuuggggugaugguccaggcugauagcggaugcguuaucaacuggaaaggccgcgaauugaagugugguucugggaucuucgugacuaaugaggugcacaccuggacggaacaauauaaguuucaggccgacucaccgaaaagacugagugcagccauuggaaaggcuugggaggagggcguaugcgguauaaggagcgccacacggcucgaaaacaucauguggaaacagauuuccaacgagcugaaucauaucuuacuggaaaacgacaugaaguucaccgucgugguuggcgauguggcagggauucuugcucagggaaaaaagaugauccgcccucaacccauggagcacaaauacucuuggaagucguggggcaaggccaaaauaaucggggcggacguccagaauacuaccuuuauuaucgauggaccaaacacaccugaaugucccgacgaucagagagccuggaauauuugggagguggaggacuauggcuucgguaucuuuacuaccaacauaugguugaagcucagggauagcuacacacagguuugcgaccaccgucugauguccgcugcaauuaaagauucaaaggccgugcaugcugacaugggguauuggaucgaaagugagaaaaaugaaacguggaagcuagcccgggcaucuuucauugagguaaagaccuguaucuggccaaaaagccacacucugugguccaacggaguccucgaaucagagaugauaauccccaagauuuacggcgguccuaucagccaacauaauuaucgaccaggcuacuucacacagaccgcggggccguggcaccugggaaaacuugaguuggauuuugaccugugcgaaggcacuacagugguggucgaugagcacugcgggaacagaggacccucuuuaaggaccacgacuguuaccggcaagauuauccaugaaugguguugccgcuccuguacacucccuccacugcgguucagaggugaggacgggugcugguacggaauggagauaaggcccgugaaagaaaaggaggaaaaucuuguaaagaguauggugagcgccggcucuggugaggucgacuccuuuucacugggcuugcucuguauuaguaucaugaucgaagaggugaugcgcagccgauggucgcggaaaaugcugaugaccgggacucuagcuguuuucuuucugcucauuaugggacagcugacauggaacgaucuuauccguuugugcauuauggugggcgccaaugcauccgacagaauggggaugggaaccacauaucuggcuuuaauggccacuuucaagaugaggccuauguuugcagucggccuccuguuccgccggcuuaccucuagagaggugcugcuacucacgauaggucugagcuugguugccucaguggaacugccaaacaguuuagaggaacucggggauggacuggcuaugggcaucaugauucuuaaacuguugacagacuuucaaucccaccagcucugggcgacccugcuaucucugacuuucaucaagaccacauuuagccuucauuacgccuggaaaacuauggcaaugguccucuccauuguaucacugauccccuugugucugagcaccacgagucagaagacaaccugguuaccggugcuccugggcucucuugggugcaagccucugacuauguucuugauagcugagaauaaaaucuggggaaggaaguccuggccacucaacgaagguauuauggccguuggcaucgugagcauucugcuaucgucacugcuuaaaaacgaugucccccucgccgggccucugaucgcuggaggcauguugauagcauguuaugugauuucugguaguuccgccgacuuacugcucgagaaggcggcugagguaagcugggaagaggaagccgagcacucuggggcaagccauaauauccugguggaaguccaggaugacggaacaaugaaaaucaaggaugaggagcgagacgauacccuuacuauucuguugaaagccacacuacuggcuauauccggcguuuacccccucucaaucccagcaacccuguuugugugguauuucuggcaaaagaagaaacagcgcaguggcgugcuuugggacacgccuagccccccagaagucgagcgggccguguuagaugacgggauuuacagaaucaugcagaggggacugcucggucguucucagguuggcguagggguguuccaagaaaacgucuuucacacuauguggcacgugacccgcggagcgguuuugauguaucagggcaagcggcuggagccguccugggcuucagugaaaaaggaccucauuaguuacggugggggauggagacugcagggcagcuggaauacaggcgaggaaguccaggugaucgccguagagccugggaaaaaccccaagaauguccaaaccgcaccaggaacauucaagacucccgaaggugaggugggcgccauagcucuugauuuuaaaccugggaccuccggaucuccaaucguuaacagggaaggcaagauugugggucuguacgggaauggagucgugacgacaucgggcacuuauguuagcgccaucgcacaggcuaaagccucacaggagggccccuugccugagauugaagacgagguguuccgaaagcggaaccuaaccaucauggaucugcauccgggguccggaaaaacacgcagauaccucccagcgauagucagggaagccauuaagcggaaguuacgaacccugauccuugcacccacuagagugguagcuagugagauggccgaagcucugaaagguaugccuauccgcuaucaaaccacagcagugaagucugagcacacgggcaaagagauuguugaccucaugugccaugccacuuuuaccaugagguugcugagcccaguccgugugcccaauuacaacaugaucauaauggaugaagcccacuucacagacccuuccucaauugcugcgcggggguauaucucuaccagagugggaaugggcgaggcagccgcuauuuuuaugacugccacaccgcccgguagcgucgaagcauucccacagaguaaugccguaauccaggaugaggaaagggacauaccugagcgcuccuggaacagcggguacgaguggauuaccgauuuucccggaaagacggugugguucguuccaucuaucaaaucaggcaaugacaucgcuaacugucuccgaaagaauggcaagagagugauucagcugucccggaaaacuuuugauacagaauaucaaaagaccaaaaacaacgacugggacuacgucgugaccacugauaucagugagaugggggcgaauuucagggccgaccgcguuauugauccucguagaugccuuaagcccgugauacuaaaagacggaccagaacgggucauccuggcagguccgaugccugugacaguagcuagcgccgcacagaggcgcggccgaauugggagaaaccauaauaaggagggagaucaguacaucuauaugggccagcccuugaacaaugacgaggaucacgcccacuggaccgaagcuaagauguuacuggacaacaucaauacaccagaggguauuauacccgcccucuucgaaccugagcgggaaaaaucggcggcaaucgauggggaguacaggcugcgcggcgaggccagaaagacuuuuguggaacuuaugaggcggggagaccugccaguuuggcucucuuauaaagucgcuuccgagggcuuccaauacagcgaucgucgcuggugcuuugacggggaacgaaacaaucagguguuggaggaaaacauggauguggagauuuggacgaaggagggagaaagaaaaaagcugaggccccgguggcuagacgcccgcaccuauucagacccucuggcucucagagaguucaaagaauuugcagccgguaggcggagugucucuggcgaucuuauccuggagauugggaaguuaccgcagcauuugacacagcgagcucaaaaugcccuggacaaccucguuaugcugcacaauuccgaacagggaggcagagcauaccgccaugcgauggaggagcuuccagauacuaucgaaacccugaugcucuuggcccugauagcuguguuaacaggugggguaacccuauucuuucugagcggcaggggacucggcaagacuucaaucgggcuucugugugugauggccaguagcgucuugcuguggauggcauccguggagccccacuggauugcugccucuaucauucucgaauucuuucugaugguucuucucaucccugagcccgaccggcagcguacgccacaggauaaccaacuggcauauguggucauaggauugcuguucaugauuuuaaccguagccgcuaaugagaugggucuacuggaaacaacuaaaaaggaccucggcaucgggcacguggcgguugagaaccaucaccaugccaccaugcuugauguggaccugcacccugcaagcgcuuggacauuguacgccgucgccaccacuauuaucacacccaugaugagacauacgauagaaaacaccacugcaaauaucucccugacagcuauugccaaccaggcggcuauccucaugggacuggauaaaggcuggccaauuucaaagauggacaucggugugccucuuuuagcccuggggugcuacucucaggucaauccgcucaccuugaccgcagccgugcugaugcuaguugcucacuaugcaauaauuggccccggacugcaagccaaagcgacaagggaggcucagaagcgcacugccgcaggcaucaugaagaacccaacgguggaugggaucguagccauugaccucgauccuguggucuacgacgcuaaauuugaaaagcagcuuggacagaucaugcuguugauacuguguaccagucaaauucuccugaugcggacaacuugggccuuaugcgagucgaucacccuugcaacaggcccccugaccacucucugggaggguagcccagggaaauucuggaauacgacaauugcuguuuccauggccaacaucuuucgaggaucuuaucuagcgggcgccggucuggcauucucauugaugaagagccugggcgggggaagaaggggcaccggggcucagggagaaacucucggcgagaaauggaagcgccagcuuaaucagcuguccaagagugaauucaacaccuacaaacggucugguauaauggagguggacagaagcgaagccaaggagggguugaaacguggagagacaacuaagcacgcagucucaaggggcaccgcuaaacugcggugguuuguggaacgcaaucucguaaagccugaggguaaggugaucgauuuaggcugugggcgaggaggcugguccuauuacugcgccgggcugaaaaagguuacagaagugaaaggauauacgaagggcggucccgggcaugaggaaccgauuccaauggccaccuacggauggaaccuugucaaacuguacaguggcaaggacguguucuuuaucccucccgagaaaugugauacucuacucugcgacauuggcgagagcucuccaaaucccacaaucgaagaggggagaacccugagggucuugaagaugguggaaccuuggcugcggggaaaccaauucuguauuaagauccucaauccguauaugcccuccguuguagagacucuugagcagaugcagcgcaaacacgguggcaugcuggugagaaacccauuaucaaggaauagcacacaugaaauguacugggucucgugcgggaccggaaacauagugucugcgguuaauaugacgagucgaaugcuguugaaccgguuuaccauggcucaccguaagccuacauaugagagagauguggaccucggcgcagguacucgccacgucgccguggaacccgagguagcuaaccuggauauuaucgggcagaggaucgaaaauauuaaacaugagcacaaguccaccuggcauuacgacgaggauaacccuuauaaaacaugggccuaccacggaagcuaugaagugaagccaucaggcuccgcaucuagcaugguuaauggcgucgugaagcuacuuacuaaacccugggacgugauaccuauggucacccaaaucgccaugacagauaccacuccauucgggcagcagcggguuuuuaaggagaaaguggacacgagaacacccaaggcuaaacgcggaaccgcgcaaauuauggaaguaacugccagguggcugugggguuuccucagucgaaacaagaagccgcggaucuguaccagagaggaauuuacaaggaaagugcgcuccaaugcagcuauuggcgccgucuucaucgacgagaaccaguggaauagcgcaaaggaggccguggaagaugagcguuuuugggaccugguucaucgggaaagagaguugcacaaacaggggaagugcgcuacgugcguguacaacaugaugggaaaaagggaaaagaagcugggcgaguucgguaaagccaaggggucucgcgcgauaugguacauguggcucggagcacgauuucuugaguucgaagcccugggcuucaugaaugaggaucacugguuuucacgggaaaacaguuuauccggcgucgagggggagggacugcauaaauuggguuauauccucagagacauuagcaagaucccuggcgggaauauguacgcugaugacaccgccggaugggauacuaggauuacagaagacgaucugcagaacgaggcaaaaaucaccgacauaauggaaccagagcacgcucuacuugccaaggcuauuuucaaacugacuuaucaaaauaaggugguacgcguucagagacccgccaagaacggcacagugauggaugucaucucucggagggaccagcgugguucggggcaggugggaaccuacggccucaauacauuuacuaacauggaagcacaacugauccgacagauggagucagagggcauuuucagcccuuccgaauuggagaccccaaacuuagcggaacgcgugcuggauuggcucgggaaauauggagucgagagacuuaagcggauggccauaaguggugacgacuguguugugaaacccaucgaugacagguuugcuacggcccugaccgcacuaaaugauaugggcaagguacgcaaagacauuccgcagugggaaccuucuaagggguggaacgauuggcagcaagugcccuucugcagccaucacuuucaccagcugaucaugaaggacggaagagagauugucgugccaugucggaaucaggaugagcucguuggcagggcucgagugucccagggugccggguggucauugcgugaaacagcaugccugggaaaaaguuacgcccaaauguggcagcuuauguauuuccauagacgcgaccugcggcucgcggcuaacgccaucuguucugcagucccuguggauuggguacccacuagcaggaccacaugguccauacacgcccaucaccaguggaugacuaccgaggacauguuaucaguuuggaauagaguguggaucgaagagaacccauggauggaagauaagacgcauauuagcucuugggaggacguccccuaccugggcaaacgcgaggaccaauggugcggcuccuugaucgggcugacagcucgggccaccugggcaacuaauauucagguggcuaucaaccagguuaggcgacucauuggaaaugaaaacuaccuugauuauaugacaaguaugaagagauuuaaaaaugagagcgacccugaaggugcccugugguga

SEQ ID NO: 14224 - RNA, 9879 nt, Artificial Sequence
  derived and/or modified CDS sequence (opt3) from DENV-1__KU666940__SS-prME
agcgugaccaugcugcucaugcuuacccccacugcacuggcuuuccacuugacgaccagaggaggggaaccucauaugaucgucuccaagcaggaaaggggaaaaucuuuacuguuuaagacgucagccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguagucaaacuggagagcaccgccgagacaagcguagcguggcccuugcaccccaugucggccuggguuuggagaccagaacagaaacuuggauguccucugagggggccuggaaacagauccagaggguggaaaccugggcucuccggcacccuggauucacaguuauugcacuguuucuggcccaugcuaucggcaccucgauuacgcagaagggcaucauauucauccucuuaaugcuggugacuccaucaauggccaugcgcugcgucgggauuggaagcagagauuuuguggagggucuuaguggcgcgacauggguagacguuguguuggagcacggguccugugucaccacuauggcaaaggauaaacccacacuggacaucgaacuacucaagaccgaggugacgaacccugccgugcugaggaaacuuugcauugaagcuaagaucucuaauaccacaacugauagccgguguccaacccaaggagaggccacacuggucgaagaacaggacgcaaacuucguuugccgccgaacuuuuguggauagaggcugggguaauggguguggauuguucggcaaaggcucccucauaaccugcgcuaaguuuaagugcguaacaaaacuggaggggaagauugugcaguacgaaaacuuaaaauauucagucaucgugaccguucacacuggagaccagcaucaaguggguaaugagaguacggaacacggcacaaccgccacuauuacaccccaggcgccuacaaccgagauccagcugacugacuacggggcccucacacuugauuguagcccaaggacgggacuggacuucaacgaaauggucuugcuaaccaugaaggagaaaucuuggcuggugcauaagcagugguuucucgaucugccgcuucccuggacuuccggcgcaucaacaagccaagagaccuggaaucggcaggaccuguugguaacauucaaaacugcucacgccaagaagcaggaaguugugguccucgguagucaagagggggcuaugcacaccgcccugacgggcgcaaccgaaauccagacaucuggaacuaccacaauuuuugccggccauuuaaaaugccgucugaagauggauaaacuaacucucaaggggauguccuaugugauguguaccgguagcuucaaacuggagaaggaagucgcugagacgcagcacggaacagugcuuguucagauaaaguacgagggcaccgacgcgccuugcaaaaucccauucucgacucaagaugaaaagggggugacacagaacggacgcuugauuaccgcaaaucccaucguaacugacaaagagaagccugucaacauagaagccgagccacccuuuggcgagucuuauauugugaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcguuuuuacguccguggggaaacuuguccaucagauuuucggaaccgcguacggcgugcuguuuucugguguaagcuggacuaugaagauagggaucggcguguugcucacauggcugggauuaaauucacgaaguaccucccugagcaugacauguauugcuguuggccuagucacucucuaccugggggugauggugcaggccgauucuggaugcgucaucaacuggaaaggccgcgaacuuaagugugguucagggaucuucguuaccaaugaggugcacacguggacagaacaauauaaguuucaggcagacaguccgaaaagauugagcgccgcuauuggaaaggccugggaggagggcgugugcgguauaagguccgcaacccggcuggaaaacaucauguggaaacagauuucuaacgagcucaaucauauccuguuagaaaacgacaugaaguucacuguagucgugggcgauguugcugggauucuggcccagggcaagaagaugauccgcccucaacccauggagcacaaauacucguggaaaagcuggggcaaggcgaagauaaucggggccgacgugcagaauaccacauuuauuaucgauggaccaaacacuccugaaugucccgacgaucagagagcuuggaauauuugggaggucgaggacuauggcuucgguaucuuuaccacaaacauauggcuuaaguugagggauuccuacacacaggugugcgaccaccgucucaugucagcagccauuaaagauaguaaggcuguucaugccgacaugggguauuggaucgaaucugagaaaaaugaaaccuggaagcuggcacgggcgagcuucauugaggugaagacuuguaucuggccaaaaucccacacacuauggucaaacggaguacuggaaagcgagaugauaauccccaagauuuacggcgguccuaucucucaacauaauuaucgaccaggcuacuucacccagacugccgggccguggcaccucggaaaacuggagcuugauuuugacuugugcgaaggcacaaccgucgugguggaugagcacugcgggaacagaggacccucccugaggacgacuaccgucacaggcaagauuauccaugaaugguguugccgcaguuguaccuuaccuccacuccgguacagaggugaggacgggugcugguauggaauggagauaaggcccguuaaagaaaaggaggaaaaucuggugaaguccaugguaucugcuggcuccggugagguggacucauucagucuuggccuguuguguauuagcaucaugaucgaagaggucaugcgcucgcgauggucccggaaaaugcucaugacugggacacuggccguguuuuuccuacugauuaugggacagcucaccuggaacgaucugauccgucuuugcauuaugguuggcgcaaaugcuucugacagaauggggaugggaacaacuuacuuggcccugauggcaaccuuuaagaugaggccuauguucgccgugggcuuacucuuucgccggcugacgagcagagagguccuucugcuaacaauaggucucucacugguggcuaguguugaauugccaaacucccuggaggaauuaggggauggacucgcgaugggcaucaugauucugaaacuucugaccgacuuccaaucucaccaguugugggccacucuccugagccuaaccuuuaucaagacaacuuucucccugcauuaugcauggaaaaccauugcuauggugcuuucaaucgucagccucuuuccccuguguuugaguacgacaucucagaagaccacuuggcugccgguauuacucggcucccuggggugcaagccucuuacaauguuccugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcacuccggggccucacauaauauccugguagaagugcaggaugacggaaccaugaaaaucaaggaugaggagcgagacgauacucucacaauucugcuuaaagcuacccuguuggcagucaguggcguuuauccccuaagcauaccagccacgcuguuugugugguacuucuggcaaaagaagaaacagcgcucuggcgugcucugggacacuccuucacccccagaagucgagcgggcggugcuggaugacgggaucuauagaauuaugcagaggggacuuuuaggucguagccagguuggcguagggguguuccaagaaaacgucuuucacaccauguggcacgugacacgcggagcuguucugauguaccagggcaagcggcucgagccgaguugggccagcgugaaaaaggacuugaucuccuacggugggggauggagacugcagggcucuuggaauaccggcgaggaaguccaggugauugcaguagagccugggaaaaaccccaagaauguccaaacagccccaggaacuuucaagacccccgaaggugaggugggcgcuaucgcccucgauuuuaaaccugggacgucgggaagcccaauaguuaacagggaaggcaagaucgugggucuguaugggaauggagucgugacaacuucaggcaccuacguuuccgcaauugcucaggccaaagcgagucaggagggcccccuuccugagaucgaagacgagguguuccgaaagcggaaccugacaauuauggauuugcauccggggucuggaaaaacccgcagauaucuaccagccaucgucagggaagcaauaaagcggaagcugcgaacucucauuuuagcucccaccagagugguagccagcgagauggcugaagcacugaaagguaugccuauccgcuaccaaacaacggccgugaaguccgagcacacuggcaaagagaucguugaccuuaugugccaugccaccuuuacaaugaggcugcucucaccaguccgugugcccaauuauaacaugauuaucauggaugaagcucacuucaccgacccuucuagcauagcggcacggggguacauuaguacuagagugggaaugggcgaggccgcugccaucuuuaugacagcaaccccgcccgguuccgucgaagccuucccacagagcaaugcuguaauucaggaugaggaaagggacaucccugagcgcucuuggaacucaggguaugaguggauaacggauuuucccggaaagacugugugguucguuccauccauuaaaaguggcaaugacaucgcgaacuguuugcgaaagaauggcaagagagugauccagcugagccggaaaacauuugauaccgaauaccaaaagaccaaaaacaacgacugggacuacgucgugacuacagauauuucggagaugggggccaauuucagggcagaccgcguuaucgauccucguagaugccucaagcccgugauucugaaagacggaccagaacgggucauacuugcugguccgaugccugugaccguagccucugcagcccagaggcgcggccgaaucgggagaaaccauaauaaggagggagaucaguauauuuacaugggccagccccuaaacaaugacgaggaucacgcucacuggacagaagccaagaugcuguuggacaacaucaauacuccagaggguaucauucccgcguuauucgaaccugagcgggaaaaauccgcagccauagauggggaguauaggcugcgcggcgaggcuagaaagacguuuguggaacucaugaggcggggagaccugccaguuuggcuuagcuacaaagucgccucagagggcuuccaauauagugaucgucgcuggugcuuugacggggaacgaaacaaucaggugcuggaggaaaacauggauguggagaucuggaccaaggagggagaaaggaaaaagcucaggccccggugguuggacgcucgcacauacucugacccucuggcacuaagagaguucaaagaauuugccgcugguaggcgguccgucagcggcgaucugauucucgagaucgggaaacuuccgcagcaucugacucagcgagcccaaaaugcauuagacaacuugguuaugcugcacaauucagaacagggaggcagagcguaucgccaugccauggaggagcucccagauaccauugaaacacugaugcuucuggcucucaucgccguguugaccggugggguaacucuguucuuuuuaaguggcaagggacuaggcaaaacgagcauagggcugcucugugugauggcauccucuguccuucuguggauggcuagcguggagccccacuggaucgccgcauccauuaucuuggaguucuuucugaugguucuccugauuccugagcccgacaggcagcggaccccacaggauaaccaacuugccuacguggucaucggacuccuguucaugauauugacaguagcugcgaaugagaugggucuguuagaaacuaccaagaaagaccuaggcauugggcacguggccguugagaaccaucaccaugcagcuaugcuggauguggaccuccacccugccucagccuggacacuuuacgcagucgcuaccacuaucauuacacccaugaugcgucauacgaucgaaaacaccacugccaauauaucucugacagcgaucgcuaaccaggccgcaauuuugaugggacuggauaagggcuggccaaucaguaaaauggacauuggugugccucuccuggcccuugggugcuauucgcaggucaauccguuaacccugaccgcugcagugcucauguugguugcccacuacgcgaucauaggccccggacugcaagcuaaggccacaagagaggcacagaagaggacugccgcuggcauuaugaaaaacccaacgguggaugggaucguagccaucgaccuagauccuguggucuaugacgcaaaguuugaaaaacagcugggacagauuaugcuccuuauccuguguaccagccaaauauugcugaugcgcacaacuugggcucucugcgaguccauuacccuggccacaggccccuuaaccacucuuugggaggguucuccagggaaguucuggaauacgacaaucgcgguuucaauggccaacauuuuucggggaagcuaccuggcaggcgcuggucucgccuucucccuaaugaaaagucugggcgggggacgaagaggcaccggggcacagggagaaacuuugggcgagaaguggaagaggcagcugaaucagcucucuaaaagcgaguucaacaccuauaagcgcucagguaucauggagguggaccgguccgaagcuaaagaggggcuuaagagaggagagacaacuaaacacgccgucagucguggcaccgccaagcugaggugguuuguggaacggaauuugguaaagccugaggguaaagugauagaucugggcugugggcgcggaggcuggagcuacuauugcgcggggcucaagaaaguuacagaagugaagggauacacgaaaggcggucccgggcaugaggaaccggucccaauggcuaccuacggauggaacuuagugaagcugcacucuggcaaagacgucuucuuuaucccucccgagaagugugauacucuucugugcgacauuggcgaguccucaccaaaucccacaaucgaagaggggcgaacccuaagagugcucaagaugguugaaccuuggcugaggggaaaccaauucuguauuaaaaucuugaauccguauaugcccagcguaguggagacucuggagcagaugcagcggaagcaugguggcaugcucguccgcaacccacuuucgagaaauucuacacacgaaauguacugggugaguugcgggaccggaaacauuguuuccgcaaucaauaugacgagcaggaugcuguuaaaccgauuuaccauggcccaccggaaaccuacauaugagcgugauguggaccugggcgcugguacuagacaugucgccguggaacccgagguagcaaacuuggauauaauugggcagcgcaucgaaaauaucaagugugagcacaaaucaaccuggcauuacgacgaggauaacccuuauaagacaugggccuaccacggauccuaugaagugaagccaucuggcagcgcuaguuccaugguuaauggcgucgugaaacuccugacuaagcccugggacgugauuccuauggucacccaaauagcgaugacagauaccacuccauucgggcagcagaggguuuuuaaagagaagguggacacgcggacacccaaagccaagagaggaaccgcacaaaucauggaaguaacugcucgcuggcuaugggguuuccuuagcaggaacaagaaaccgcgaauuugcacccgggaggaauuuacaagaaaggugaggucuaaugccgcaaucggcgccgucuucguggacgagaaccaguggaacucagcuaaagaggccguugaagaugagcgcuuuugggaccuggugcaucgugaacgggagcuccacaagcaggggaaaugcgcgacgugugucuacaacaugaugggaaagagagaaaagaaacugggcgaguucgguaaggcaaaagggaguagggccauuugguacaugugguugggagcucgcuuucuggaguucgaagcccucggcuucaugaaugaggaucacugguuuucccgagaaaacagccuuucuggcguggagggggagggacugcauaaguuagguuauauccugcgggacauaucgaaaaucucaggcgggaauauguacgcagaugacaccgcuggaugggauacuagaauuacagaagacgauuugcagaacgaggccaagaucaccgaaauuauggagccugaacacgcucaacucgccaaagcaaucuucaagcugacuuaucagaauaagguaguuagggugcagcgcccagcgaaaaacggcacagucauggacgugauaagcagacgggaucagagggguuccgggcaagugggaaccuacggccuaaauacauuuacuaacauggaggcccagcuuauucgucagauggagagugaaggcaucuucucucccagcgagcuggaaaccccuaaccucgcugagcgaguccuggacugguuggaaaaguaugggguugagcgcuuaaaaagaauggccaucuccggagaugacugcgugguaaagccaauugacgaucgguuugcaacggcucugaccgcccucaaugacauggguaaagugaggaaggauauaccccagugggagccgucaaagggcuggaacgacuggcaacaggucccuuucuguagucaucacuuucaccagcuuaucaugaaagaugggcgcgaaauugugguucccugcagaaaucaggacgagcuggugggacgggcaagggucucucaaggcgccgguuggagccuacgagaaacagcgugucuggggaaguccuacgcucagauguggcagcucauguauuuccaucguagagauuugcgccuggccgcaaacgccaucugcucagcugugccaguagacuggguuccuacuagccggaccacauggucuauucacgcccaucaccaauggaugacuaccgaggauaugcuuuccguguggaauagggucuggaucgaagagaaccccuggaugaaagacaagacgcauauaaguagcugggaggaugugccauaccugggaaaaagagaagaccagugguguggcucgcucaucggcuuaacagcacgcgcuaccugggccacuaauauucagguugcgaucaaccaggugcggaggcugauugggaaugagaacuacuuggacuauaugacauccaugaagcgauuuaagaaugaaucugaucccgagggagcucugugguga

SEQ ID NO: 14225 - RNA, 9879 nt, Artificial Sequence
  derived and/or modified CDS sequence (opt3) from DENV-1__KU666941__SS-prME
agcgugaccaugcugcucaugcuuaugcccacagcacuggcuuuccacuugacuacgagaggaggggagccucauaugaucgucuccaagcaggaaaggggaaaaucuuuacuguuuaagaccucagccgguguuaacaugugcacacugauugccauggaccucggagagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauuggagcuaagaucucuaauacgaccacagauagccgguguccaacucaaggcgaagccacccuggucgaggaacaggacgcaaacuucguuugccgccgaacauuuguggauagagguugggggaauggauguggcuuguucggcaaagggucccucauaacuugcgcuaaguuuaagugcguaaccaaacuggagggaaagauugugcaguacgagaacuuaaaauauucagucaucgugacaguucacaccggugaccagcaucaagugggcaaugaaaguacugagcacgggacgacagccaccauuacuccccaggcgccuaccacagaaauccagcugaccgacuacggagcccucacucuugauuguagcccaaggacaggccuggacuucaacgagauggucuugcuaacgaugaaggaaaaaucuuggcuggugcauaagcagugguuucucgaucugccgcuucccuggaccuccggugcaucaacuagccaagagacauggaaucggcaggaccuguugguaaccuucaaaacagcucacgccaagaagcaggagguugugguccucgggagucaagaaggcgcuaugcacacugcccugaccggagcaacggagauccagaccucuggcacaacuaccauuuuugccgggcauuuaaaaugccgucugaagauggauaaacuaacacucaagggaauguccuaugugauguguacugguagcuucaaacuggaaaaggaggucgcugaaacccagcacggcacggugcuuguucagauaaaguacgaggggacagacgcgccuugcaaaaucccauucucgacccaagaugagaagggagugacucagaacggccgcuugauuacagcaaaucccaucguaaccgacaaagaaaagccugucaacauagaggccgaaccacccuuuggugagucuuauauugugaucggggcuggcgagaaagcccugaagcucuccugguucaagaaaggaucaaguaucggcaagauguuugaagcaacugccagaggggcuaggcggauggccauucugggagauaccgcaugggacuucgguagcaucggcgggguuuuuacauccgugggaaaacuuguccaucagauuuucggcacggcguacggugugcuguuuucugggguaagcuggaccaugaagauaggcaucggaguguugcucacuuggcugggcuuaaauucacgaaguacaucccugagcaugaccuguauugcuguugggcuagucacacucuaccugggagugauggugcaggccgauucuggcugcgucaucaacuggaaaggucgcgagcuuaagugugggucaggaaucuucguuacuaaugaagugcacaccuggacggagcaauauaaguuucaggcagacaguccgaaaagauugagcgccgcuauuggcaaggccugggaagagggugugugcggcauaagguccgcaacacggcuggagaacaucauguggaaacagauuucuaacgaacucaaucauauccuguuagagaacgacaugaaguucaccguagucgugggggauguugcuggcauucuggcccagggcaaaaagaugauccgcccucaacccauggaacacaaauacucguggaaaagcugggggaaggcgaagauaaucggagccgacgugcagaauacuaccuuuauuaucgauggcccaaacacaccugagugucccgacgaucagagagcuuggaauauuugggaagucgaggacuaugguuucgggaucuuuacuaccaacauauggcuuaaguugagggauuccuacacacaggugugcgaccaccgucucaugucagcagccauuaaagauaguaaggcuguucaugccgacaugggauauuggaucgagucugagaagaaugagacguggaagcuggcacgggcgagcuucauugaagugaagaccuguaucuggccaaaaucccacacucuauggucaaacggcguacuggagagcgaaaugauaauccccaagauuuacgguggcccuaucucucaacauaauuaucgaccaggguacuucacacagaccgccggaccguggcaccucggcaaacuggagcuugauuuugacuugugcgaggggacuacagucgugguggaugaacacugcggaaacagaggccccucccugaggaccacgacugucaccgguaagauuauccaugagugguguugccgcaguuguacauuaccuccacuccgguacagaggggaagacggaugcugguauggcauggagauaaggcccguuaaagagaaggaagagaaucuggugaaguccaugguaucugcugguuccggcgaaguggacucauucagucuugggcuguuguguauuagcaucaugaucgaggaagucaugcgcucgcgauggucccggaaaaugcucaugaccggaacucuggccguguuuuuccuacugauuaugggccagcucacauggaacgaucugauccgucuuugcauuaugguuggggcaaaugcuucugacagaaugggaaugggcaccacauacuuggcccugauggcaacuuuuaagaugaggccuauguucgccguggguuuacucuuucgccggcugaccagcagagagguccuucugcuaacgauagggcucucacugguggcuaguguugaguugccaaacucccuggaagaguuaggagauggccucgcgaugggcaucaugauucugaaacuucugacagacuuccaaucucaccaguugugggccacccuccugagccuaacuuuuaucaagaccacauucucccugcauuaugcauggaaaacuauugcuauggugcuuucaaucgucagccucuuuccccuguguuugaguaccacgucucagaagacaaccuggcugccgguauuacucgggucccugggaugcaagccucuuacuauguuccugauagccgaaaauaaaaucugggguagaaagagcuggccauugaacgagggcauuauggccguggggaucguuucgauucuccugucaucucuacugaaaaacgaugugccccuugcuggaccucucaucgcaggcgguaugcugauagccuguuacgucauuaguggguccagcgcggacuugucuuuagaaaaggcugccgaggugagcugggaggaagaggcagaacacuccggagccucacauaauauccugguagaggugcaggaugacggcacaaugaaaaucaaggaugaagaacgagacgauacccucacuauucugcuuaaagcuacacuguuggcagucaguggcguuuauccccuaagcauaccagccacccuguuugugugguacuucuggcaaaagaagaaacagcgcucuggggugcucugggacacgccuucacccccagaggucgaacgggcggugcuggaugacggaaucuauagaauuaugcagaggggucuuuuaggccguagccagguugggguaggaguguuccaagagaacgucuuucacacuauguggcacgugacccgcggcgcuguucugauguaccaggguaagcggcucgaaccgaguugggccagcgugaaaaaggacuugaucuccuacgggggaggcuggagacugcagggcucuuggaauacaggggaggagguccaggugauugcaguagaaccuggcaaaaaucccaagaauguccaaaccgccccagguacauucaagacucccgagggcgaagugggggcuaucgcccucgauuuuaaaccuggaaccucgggcagcccaauaguuaacagggaggguaagaucguggggcuguauggaaauggcgucgugacgacaucaggcacuuacguuuccgcaauugcucaggccaaagcgagucaggaagggccccuuccugagaucgaggacgaaguguuccgaaagcggaaccugaccauuauggauuugcauccgggaucugguaaaacacgcagauaucuaccagccaucgucagggaggcaauaaagcggaagcugcgaacccucauuuuagcucccacuagagugguagccagcgaaauggcugaggcacugaaaggcaugccuauccgcuaccaaaccacagccgugaaguccgaacacacggggaaagagaucguugaccuuaugugccaugccacuuuuaccaugaggcugcucucaccaguccgugugcccaauuauaacaugauuaucauggaugaggcucacuucacagacccuucuagcauagcggcacggggauacauuaguaccagagugggcaugggugaagccgcugccaucuuuaugacugcaacaccgcccggguccgucgaggccuucccacagagcaaugcuguaauucaggaugaagagagggacaucccugaacgcucuuggaacucaggauaugaguggauaaccgauuuucccggcaagacggugugguucguuccauccauuaaaaguggcaaugacaucgcgaacuguuugcgaaagaaugggaagagagugauccagcugagccggaaaacuuuugauacagaguaccaaaagaccaaaaacaacgacugggacuacgucgugaccacugauauuucggaaaugggagccaauuucagggcagaccgcguuaucgauccucguagaugccucaagcccgugauucugaaagacgguccagagcgggucauacuugcuggcccgaugccugugacaguagccucugcagcccagaggcgcgggcgaaucggaagaaaccauaauaaggaaggcgaucaguauauuuacaugggucagccccuaaacaaugacgaggaucacgcucacuggaccgaggccaagaugcuguuggacaacaucaauacaccagaagggaucauucccgcguuauucgagccugaacgggagaaauccgcagccauagauggcgaauauaggcugcgcggagaggcuagaaagacuuuuguggagcucaugaggcggggcgaccugccaguuuggcuuagcuacaaagucgccucagaaggguuccaauauagugaucgucgcuggugcuuugacggagagcgaaacaaucaggugcuggaagagaacauggauguggaaaucuggacgaaggagggugagaggaaaaagcucaggccccggugguuggacgcucgcaccuacucugacccucuggcacuaagagaguucaaagaguuugccgcuggcaggcgguccgucagcggggaucugauucucgaaaucggaaaacuuccgcagcaucugacacagcgagcccaaaaugcauuagacaacuugguuaugcugcacaauucagagcagggcgguagagcguaucgccaugccauggaagaacucccagauacuauugagacccugaugcuucuggcucucaucgccguguugacagggggcguaacccuguucuuuuuaaguggaaagggccuagggaaaacuagcauaggacugcucugugugauggcauccucuguccuucuguggauggcuagcguggaaccccacuggaucgccgcauccauuaucuuggaguucuuucugaugguucuccugauuccugaacccgacaggcagcggacgccacaggauaaccaacuugccuacguggucaucggucuccuguucaugauauugaccguagcugcgaaugagaugggccuguuagagacaacuaagaaagaccuagggauuggacacguggccguugaaaaccaucaccaugcagcuaugcuggauguggaccuccacccugccucagccuggacccuuuacgcagucgcuacaaccaucauuacucccaugaugcgucauacaaucgagaacacgaccgccaauauaucucugacugcgaucgcuaaccaggccgcaauuuugaugggccuggauaaggguuggccaaucaguaaaauggacauuggggugccucuccuggcccuuggcugcuauucgcaggucaauccguuaacacugaccgcugcagugcucauguugguugcccacuacgcgaucauaggacccggccugcaagcuaaggccaccagagaagcacagaagaggacagccgcugggauuaugaaaaacccaacuguggauggaaucguagccaucgaccuagauccuguggucuaugacgcaaaguuugagaaacagcugggccagauuaugcuccuuauccuguguacgagccaaauauugcugaugcgcaccacaugggcucucugcgaauccauuacucuggccaccggucccuuaacaacccuuugggaggggucuccaggaaaguucuggaauacuacgaucgcgguuucaauggccaacauuuuucggggcagcuaccuggcaggagcuggccucgccuucucccuaaugaaaagucuaggggguggccgaagagggacaggagcacagggcgagaccuugggugaaaaguggaagaggcagcugaaucagcucucuaaaagcgaguucaacacuuauaagcgcucagggaucauggaaguggaccgguccgaggcuaaagaaggacuuaagagaggcgagaccacaaaacacgccgucagucgugguacugccaagcugaggugguuuguggagcggaauuugguaaagccugaaggcaaagugauagaucugggguguggacgcggcggguggagcuacuauugcgcgggacucaagaaaguuaccgaggugaagggcuacacaaaaggugggcccggacaugaagaaccggucccaauggcuacguacggcuggaacuuagugaagcugcacucuggcaaagacgucuucuuuaucccucccgaaaagugugauacccuucugugcgacauuggggaguccucaccaaaucccacuaucgaggaaggacgaacacuaagagugcucaagaugguugagccuuggcugagggguaaccaauucuguauuaaaaucuugaauccguauaugcccagcguaguggaaacccuggagcagaugcagcggaagcauggcgggaugcucguccgcaacccacuuucgagaaauucuacucacgagauguacugggugaguugcggaacaggcaacauuguuuccgcaaucaauaugaccagcaggaugcuguuaaaccgauuuacgauggcccaccggaaaccuaccuaugaacgugauguggaccugggugcugggacaagacaugucgccguggagcccgaaguagcaaacuuggauauaauuggacagcgcaucgagaauaucaagugugaacacaaaucaacuuggcauuacgacgaggauaacccuuauaagaccugggccuaccacggcuccuaugaggugaagccaucuggcagcgcuaguuccaugguuaauggggucgugaaacuccugacaaagcccugggacgugauuccuauggucacucaaauagcgaugaccgauacaaccccauucggacagcagaggguuuuuaaagaaaagguggacacucggacgcccaaagccaagagagguacagcacaaaucauggagguaaccgcucgcuggcuauggggcuuccuuagcaggaacaagaaaccgcgaauuugcacucgggaagaguuuaccagaaaggugaggucuaaugccgcaaucggggccgucuucguggacgaaaaccaguggaacucagcuaaagaggccguugaggaugaacgcuuuugggaccuggugcaucgugagcgggaacuccacaagcagggaaaaugcgcgacaugugucuacaacaugaugggcaagagagagaagaaacugggugaguucgggaaggcaaaaggaaguagggccauuugguacaugugguugggcgcucgcuuucuggaguucgaggcccucggcuucaugaaugaagaucacugguuuucccgagagaacagccuuucugggguggaaggagagggucugcauaaguuaggcuauauccugcgggacauaucgaaaaucucagggggaaauauguacgcagaugacacggcuggcugggauaccagaauuacugaggacgauuugcagaacgaagccaagaucacagagauuauggaaccugagcacgcucaacucgccaaagcaaucuucaagcugaccuaucagaauaagguaguuagggugcagcgcccagcgaaaaacgguacugucauggacgugauaagcagacgggaucagaggggguccggacaagugggcacauacggccuaaauaccuuuacaaacauggaagcccagcuuauucgucagauggagagugaggggaucuucucucccagcgaacuggagacuccuaaccucgcugaacgaguccuggacugguuggagaaguauggaguugaacgcuuaaaaagaauggccaucuccggugaugacugcgugguaaagccaauugacgaucgguuugcaaccgcucugacggcccucaaugacaugggcaaagugaggaaggauauaccccagugggagccgucaaagggguggaacgacuggcaacaggucccuuucuguagucaucacuuucaccagcuuaucaugaaagauggacgcgagauugugguucccugcagaaaucaggacgaacuggugggccgggcaagggucucucaaggugccggguggagccuacgagagaccgcgugucugggaaaguccuacgcucagauguggcagcucauguauuuccaucguagagauuugcgccuggccgcaaacgccaucugcucagcugugccaguagacuggguuccuacaagccggacuaccuggucuauucacgcccaucaccaauggaugacaacugaagauaugcuuuccguguggaauagggucuggaucgaggaaaaccccuggaugaaagacaagacccauauaaguagcugggaggaugugccauaccugggcaaaagagaggaccagugguguggcucgcucaucggguuaacggcacgcgcuacaugggccaccaauauucagguugcgaucaaccaggugcggaggcugauuggaaaugaaaacuacuuggacuauaugacuuccaugaagcgauuuaagaaugagucugaucccgaaggugcucugugguga

SEQ ID NO: 14226 - RNA, 9879 nt, Artificial Sequence
  derived and/or modified CDS sequence (opt3) from DENV-1__KC172835__SS-prME
agcgugaccaugcugcucaugcuuaugcccacagcccuggcuuuccacuugacuacgaggggaggggaaccucauaugaucgucuccaagcaggaaagggggaaaucuuuacuguuuaagaccucagccgguguuaauaugugcacacuaauugccauggaccucggagaacugugugaagauacuaugaccuacaaaugcccacggaucacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucguuaacuggaaaggccgcgaacuuaagugugguucagggaucuucgugacuaaugaggugcacaccuggacggaacaauauaaguuucaggcagacaguccgaaaagauugagcgccgcuaucggaaaggccugggaggagggcguaugcgguauuagguccgcaacacggcuggaaaacgucauguggaaacagauaucuaacgagcucaaucauauccuguuagaaaacgacaugaaguucaccgugguugugggcgaugucgcugggauucuggcccagggcaagaagaugauccgcccucaacccauggaguacaaauauucguggaaaagcuggggcaaggcgaagauuaucggggccgacgugcagaauacuaccuuuauaaucgauggaccaaacacaccugaaugucccgacgaucagagagcuuggaauauuugggagguugaggacuacggcuucgguaucuuuacuaccaacauuuggcuuagguugcgugauuccuauacacaggugugcgaccaccggcucaugucagcagccaucaaggauaguaaagcuguacacgccgacaugggguacuggauagaaucugagaagaaugaaacguggaaacuggcacgagcgagcuucauugaggucaagaccuguaucuggccaaagucccauacucuauggucaaacggagugcuggaaagcgagaugauuauccccaaaauauauggcgguccuaucucucaacacaauuacagaccaggcuacuucacacagaccgccgggccguggcaucucggaaagcuggagcuugauuuugacuugugcgaaggcacuacaguggucguugaugagcacugcgggaacaggggacccucccugcgcaccacgacugugaccggcaaaacaauucacgaaugguguugccggaguuguaccuuaccuccacucagauucaggggugaggacgggugcugguauggaauggagauccgccccguaaaggaaaaagaggaaaaucugguaaagagcauggucucugcuggcuccggugagguggacucauuuagucuuggccuguuguguauuagcaucaugauagaagagguuaugcgaucgcgguggucccguaagaugcucaugacugggacacuggccguguucuuucuacugauuaucggacagcucaccuggaacgaucugaucagacuuucuauuauggucggcgcaaaugcuagcgacaaaauggggaugggaacaacuuacuuggcccugauggcaaccuucaagaugaggccuauguuugccgugggcuuacucuuccgccggcugacgucaagagagguucuucugcuaacaaucggucucagucugguggcuuccgucgaauugccaaacucucuggaggaauuaggggauggacucgcgaugggcauuaugauacugaaacuucugaccgacuuucaaccccaucaguugugggccacucuccugagccuaaccuucaucaagacaacuuuuucccugcacuaugcauggaaaaccauggcuaugguacuuucaauugugagccucuucccgcugugcuugaguacgacaucucagaagaccacuuggcugccuguuuuacucggcucccugggguguaagccacuuacaauguuucugaucaccgagaauaaaauuuggggaagaaagagcuggcccuugaacgaagguaucauggccgugggcauagucucgauccuccugucaucucuacugaaaaacgaugugccucuugccgggccccucauugcuggaggcaugcugaucgcaugcuacguaauuagugguuccagcgccgacuugucuuuagagaaggcggcugaggugagcugggaagaggaagccgagcauuccggggcaucacacaauauccuggucgaaguucaggaugacggaacuaugaaaauaaaggaugaggagcgagacgauacacucaccauucugcuuaaagccacgcuguuggcugugaguggcguguauccacuaagcaucccugcaacucuguucgucugguacuucuggcaaaagaagaaacagcgcucuggcgugcucugggacacccccuccccaccggaaguugagcgggccgcgcuggaugacgggaucuauagaauuaugcagaggggacuuuuaggucguucacagguaggcgugggggucuuucaagaaaacguguuccauacaauguggcacguuacccgcggagcugugcugauguaccagggcaagcggcucgagccuaguugggccagcgucaaaaaggacuugauauccuacggugggggauggagacugcagggcucuuggaauacaggcgaggaagugcagguaaucgcagucgagcccgggaaaaacccaaagaaugugcaaacugcccccggaaccuuuaagacgccugaaggugagguuggcgcuauugcccucgauuucaaaccagggacaucgggaagccccaucgugaacagggaaggcaagauugucggucuguaugggaauggagugguuacuaccucaggcacauacguguccgcaaucgcucaggccaaagcgagucaggagggcccucuuccggagauagaagacgaggucuuucgaaagcggaaccugaccaucauggauuugcacccagggucuggaaaaacucgcagauaucuacccgccauugugagggaagcaaucaagcggaagcugcgaacccucauuuuagcuccuacaagaguaguggccagcgagauggcugaagcacugaaagguaugccaauccgcuaccaaacgacugccguuaaguccgagcauaccggcaaagagauagucgaccuuaugugucacgccacauucaccaugaggcugcucucacccgugcgugugccuaauuauaacaugauuaucauggaugaagcucauuuuacugacccgucuagcaucgcggcacggggguacauuaguacaagagucggaaugggcgaggccgcugccaucuucaugaccgcaacgcccccagguuccguagaagccuuuccucagagcaaugcugugauacaggaugaggaaagggacauucccgagcgcucuuggaacucaggguaugaguggaucacugauuucccaggaaagacaguuugguuugugccuuccauuaaaaguggcaaugacaucgcgaacugcuugcgaaagaauggcaagagagucauacagcugagccggaaaaccuucgauaccgaauaccaaaagacuaaaaacaacgacugggacuacgugguuacaaccgauauuucggagaugggggccaauuucagggcagaccgcgugaucgauccccguagaugucucaagccagucauccugaaagacggaccggaacgggugauucuugcugguccuaugcccguaacaguggccucugcagcccagaggcgcggccgaaucgggagaaaccacaauaaggagggagaucaguauauuuacaugggccagccacuaaacaaugacgaggaucaugcucacuggacugaagccaagaugcuguuggacaacauaaauacgcccgaggguaucauuccugcguuauuugaaccagagcgggaaaaauccgcagccaucgauggggaguauaggcugcgcggcgaggcuagaaagaccuucguugaacucaugaggcggggagaccugcccgucuggcuuagcuacaaaguggccucagagggcuuucaauauagugaucgucgcuggugcuucgacggggaacgaaacaaucaggugcuggaggaaaacauggaugucgagaucuggacaaaggagggagaaaggaaaaagcucaggccucggugguuggacgcucgcacuuacucugacccgcuggcacuaagagaguuuaaagaguucgccgcugguaggcgguccguuagcggcgaucugauucucgagauagggaaacuuccacagcaccugacccagcgagcccaaaaugcauuagacaacuuggugaugcugcauaauucagaacagggaggcagagcguaucgccacgccauggaggagcuccccgauacaaucgaaacccugaugcuucuggcucucauugccguauugacugguggggugacgcuguuuuucuuaaguggcaggggacuaggcaagaccagcaucgggcugcucugcgucauggcauccucugugcuucuguggauggcuagcguugagccucauuggauugccgcauccaucauauuggaauuuuuccugauggugcuccugauccccgagccagaccggcagcguacaccucaggauaaccaacuugccuacgucguaauuggacuccuguuuaugaucuugacuguggcugcgaaugagaugggucuguuagaaaccaccaaaaaggaccuaggcauugggcacguugccgaugagaaccaccaucacgcagcuaugcuggacguggaucuccaucccgccucagccuggacccuuuacgcagucgcuacuacaaucauaacgccaaugaugagacacaccauugaaaacacuacagccaauaucucucugaccgcgauugcuaaccaggccgcaaucuugaugggacuggacaaaggcuggccuauaaguaagauggauaucggugugccgcuccuggcccuuggguguuauucgcaggucaaucccuuaacccugacagcugcagugcucauguugguugcccauuacgcgauuaucggcccaggacugcaagcuaaagccacuagggaggcacagaagcgcacggccgcuggcauuaugaagaacccuaccguggacgggaucguagccauagaucuagaccccguggucuaugacgcaaaauucgaaaagcagcugggacagauuaugcuccuuauccugugcacaagccaaaucuugcugaugcggacuaccugggcucucugugaguccauuacacuggccaccggcccauuaacuacgcuuugggaggguucuccugggaaauuuuggaauacaaccaucgcgguuucaauggccaacauauuccgaggaagcuaccuggcaggcgcuggucucgccuucucccuaaugaagagucugggcgggggaagaaggggcacuggggcacagggagaaaccuugggcgagaaauggaagcgccagcugaaucagcucucuaagagcgaauuuaacacauauaaacggucagguauuauggagguggauagauccgaagcuaaggaggggcuuaaacguggagagacuaccaagcacgccgucaguaggggcacagccaaacugcggugguucguggaacgcaauuugguaaagcccgaggguaaggugaucgaccugggcugcgggcgaggaggcuggagcuacuauugugcggggcucaaaaagguuacggaagugaaaggauacaccaagggcgguccggggcacgaggaaccaauuccuauggcuacuuacggauggaacuuagucaaacugcauucuggcaaggauguguuuuucauacccccagagaaaugcgacacacuucugugugauauaggcgaguccucacccaauccuaccaucgaagaggggagaacucuaaggguccucaagaugguggaaccguggcugcggggaaaccaauuuugcauuaagaucuugaaucccuauaugccaagcguuguagagacacuggagcagaugcagcgcaaacacgguggcaugcucgugagaaacccucuuucgagaaauucuacccaugaaauguacugggucaguugugggacgggaaacauuguguccgcaguuaauaugaccagccgaaugcuguuaaaccgguucacaauggugcaccguaagcccacuuaugagagagacgucgaucugggcgccgguacccgccacguggcuguagaaccugagguggccaacuuggacaucauugggcagaggaucgaaaauauaaaacaugagcacaagucaacauggcauuacgaugaggacaacccauauaaaacuugggcauaccacggauccuaugaaguuaagcccucuggcagcgccaguuccauggucaauggcguggugaagcuccugaccaaaccuugggaugucauuccaaugguuacacaaaucgcuaugaccgacacuacgcccuuugggcagcagcggguguucaaggagaaaguagacacaagaaccccgaaggcgaaacgcggaacugcccaaaucauggaagugaccgcaagguggcuaugggguuuucuuagccgaaacaagaagccucggauuugcacaagagaggaguucacgaggaaaguccgcucuaaugcugccauaggcgcaguguuuaucgaugagaaccaguggaacucagccaaggaggcuguugaagacgagcguuucugggaucuggugcaucgggaaagagagcuccacaaacaggggaagugugcaacaugcgucuacaacaugaugggaaaaagggaaaagaagcugggcgaguuugguaaagcgaaggggagucgcgcaauuugguacaugugguugggagcccgauuccuggaguucgaagcucucggcuuuaugaaugaggaccacugguucucccgggaaaacagccuuucuggcguggagggggagggacugcauaaauuagguuauauccugagagauauuucgaagaucccaggcgggaauauguacgccgacgauacugcaggaugggacacaaggauaaccgaagaugacuugcagaacgaggcuaaaaucacugauauuauggaaucagagcacgcccuccuggcuaagagcaucuuuaaacuaacauaucaaaauaagguaguucgcgugcagagacccgccaagaacggcaccgucauggacgugauuucccggagggaucagcgugguaguggacaggugggaacauacggccuuaauacuuucaccaacauggaagcacaacugauccgacagauggagucugagggcauauuuagcccuuccgaacucgagacgccaaaccuggcggaacgcgccuuggacugguuagagaaacauggggucgaaagacugaagcggauggcuauuucaggagacgauugcguugugaaacccaucgacgauagguucgccaccgcacucacagcucuuaaugacauggguaagguacgcaaagauaucccgcagugggagccuaguaagggcuggaacgacuggcagcaagugcccuuuuguucucaccacuuccaucagcugauuaugaaggaugggagagagauagucgugccaugccggaaucaggacgagcuaguuggaagggcccgagugagccagggcgcagguuggucccugcgugagacugccugucucgggaaaucauaugcgcaaauguggcaguugauguacuuucacagacgcgaucugcggcuugcugccaacgcaaucugcagcgccgucccuguggacuggguacccaccucuaggacaacuugguccauucaugcucaccaucaguggaugaccacggaagauaugcugaguguuuggaauagaguguggaucgaggaaaacccauggauggaggacaagacacacauuagcucgugggaggacguccccuaucucggaaaacgcgaagaucaaugguguggcuccuuaaucggccugaccgcccgggcaacuugggcuacaaauauacagguggccaucucucagguuaggcgauugauugggaacgagaauuaccuggacuacaugaccucaaugaagagauucaaaaacgaaagcgauccugagggagcgcucugguga

SEQ ID NO: 14227 - RNA, 9879 nt, Artificial Sequence
  derived and/or modified CDS sequence (opt3) from DENV-1__EU848545__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacaauuauagccauggaccucggcgagcugugugaagauacuaugaccuacaaaugcccacggaucacaaaggcggagccggacgauguggacuguuggugcaaugcuaccgauacuuggguaacauaugggaccuguagucgcacgggagaacaccgacgugacaaaagaagcguggcccuugcaccccaugucggccuggguuuggagacuagggccgagaccuggauguccucugaaggggcuuggaagcaaauucagaagguggagacaugggcacuccggcacccuggauucacuguuaucgcccuguuucuggcucaugccauuggcaccucgaucacacagaaaggcauaaucuucauucucuuaaugcuggugaccccaucaauggcgaugcgcugcgucgggaucggaaacagagauuuuguggaaggucuuagcggcgcaacguggguagacguuguguuggagcacgggaguugugucacuacaauggccaaggauaaacccacccuggacauugagcuacucaagacugaagugacaaaaccugcugugcugaggaagcuuugcaucgaggccaagauauccaauaccacgaccgauucucgguguccaacacagggagaagcaacucuggucgaggaacaagacgcuaacuucguuugccgccgaaccuuuguggauagaggcugggguaauggguguggauuguucggcaaaggcagccucauuacaugcgccaaguuuaaaugcguaacuaagcuggaggggaaaaucgugcaguacgagaacuuaaaguauuccgucauugugaccguucacacaggagaccagcaucagguggguaaugaaaccacugagcacggcacgaucgcgacaaucaccccccaagccccuacuucagaaauucagcugaccgacuacggggcacucacacuugauuguaguccaaggaccggacuggacuucaacgagauggucuugcuaacuaugaaagaaaagagcuggcuggugcauaagcagugguuucucgaucugccgcuucccuggacaucuggcgcuuccacgccucaggagaccuggaaucgggaggaccuguugguaacuuucaaaacagcccacgcuaagaaacaagaaguugugguccucgguucacaggagggggccaugcacaccgcacugacaggcgccacugaaauacagaccagcggaacgaccaagaucuuugcuggccauuuaaaaugccgucugaagaugaacaagcuaacacucaaagggaugaguuaugugauguguacuggaucuuucaagcuggagaaagaagucgcggagacccaacacgguacagugcuuguucaggugaaguacgagggcacugaugcaccaugcaaaauucccuucuccacccaggacgaaaaggggguaacgcagaauggacgcuugaucacagccaacccuauagucaccgauaaggagaaaccagugaauauugaagcugagcccccguuuggcgagagcuauaucguugugggugccggggaaaaggcacugaaacucucgugguucaagaaaggcucuuccaucggaaagaugcuggaggccacugcuagaggcgccaggcggauggcaauucuuggggacacagcgugggauuuuggaucaaucgguggcgucuucaccaguguggggaagcugguacaucaaauuuuuggaacugcuuacggcguguuguucagcgguguuuccuggaccaugaaaauagggaucggcauucuccugacaugguuaggacugaacucucgaagcgccucacuaaguaugacguguaucgcagucggcauggugacccucuaccugggggugaugguccaggccgacuccggaugcguuaucaauuggaagggccgcgaacuuaaaugugguagcgggauuuuugugacuaacgaggugcacacauggaccgaacaguauaaguuccaggcugauucuccuaaaagauugucagccgcaauaggaaaggcuugggaggagggcguaugcgguaucaggagugccacacggcuggaaaacauuauguggaaacaaaucagcaaugagcucaaccauauucuguuagaaaaugacaugaaguuuacugucgugguuggcgacguguccgggauccugacccagggacgcaagaugauaggcccccagccaauggagcacaaauacucuuggaagucgugggggaaagcgaagaucauuggagccgauguccagaacacgacauucaucauugacggcccuaauacccccgaauguccagaugaccaaagagcuuggaacaucugggagguggaggauuaugguuuugggauauucacuaccaauauuuggcuuaaauugagggacagcuacacacagguuugcgauccccgucucauguccgcagccaucaaggacucaaaggcugugcacgccgauaugggauauuggauugaaagugagaaaaacgaaacuuggaagcuggcacgggcgucuuuuaucgagguaaaaaccugugucuggccuaagagccauacacuaugguccaauggcgugcuggaaucagagaugauaaucccaaaaauuuacgguggcccgaucagccagcacaacuaucgacccggguacucuacgcagaccgccggaccuuggcaucucggcaagcuggagcuugacuucgauuugugcgaagggacuacaguggucguugacgagcacugcggaaauagaggcccaucccugaggaccacuacagugaccgguaagauuauccacgaaugguguugccgcaguuguacguuacccccucuccgguucaaaggggaggauggaugcugguacggcauggagauaagaccaguaaaggacaaagaagagaaccuggugaagagccuugucucugcugguuccggcgaaguggacucauuuagucugggguugcucuguauuagcaucaugaucgaggaaguuaugaggucgcgcuggucccgaaaaaugcugaugacuggaacccuagccguguuccugcuccugauuaugggccaacuuacauggaaugauuugauccggcugugcauuauggucggggcaaacgcuucugaccguaugggaaugggcaccacuuauuuagcccucauggcaacauuuaagaugagacccauguucgccgugggucugcuuuuuaggcgccugaccagccgggagguucuacuccugacaauaggguugucacugguggcuagugucgaguuaccgaauucccucgaagagcugggagauggccuugcgaugggcaucaugauucugaaguugcucacugacuuccagucucaucagcugugggccgcacuacugagccuuaccuuuaucaaaacgacauucucccuccacuacgcuuggaagaccguagccauggugcugucaauuguuagcuuguuuccucuguguuuaaguacuaccucucaaaaaacaacuuggcucccagugcugcuugggucccugggaugcaagcccuugaccauguuccucaucgccgaaaacaaaauaugggguagaaagagcuggccucugaacgagggcaucauggcugucgggauugugucgauccuacugucaucucuucucaaaaaugauguaccccuggcaggaccauugauugccggcgguauguuaaucgcguguuaugugauaaguggguccagcgcugaccugucucucgaaaaggccgcagagauuagcugggaggaagaggccgaacauuccggagcuucacacaacauccuggucgagguucaggaugacggcacgaugaagaucaaagaugaagagagggacgauacacuuaccauucuguugaaggcaacucuacuggccgugaguggcguguacccuauaagcauccccgcgacacucuuugucugguauuucuggcagaaaaagaaacagcgaucuggggugcugugggacaccccauccccgccugagguugaacgcgcuguacuugaugacggaauuuaccggaucuuacaaagaggucugcucggcaggucacaggugggggucggaguguuucaggagggcguuuuccauacuauguggcacgugacacguggugccgucuugauguaucaggggaagcgccuggaacccaguugggcaagcgugaagaaagaccucauuuccuacggaggcggcuggcgguuccaagggucuuggaauaccggagaggagguacaggucaucgccguggaaccagguaagaaccccaaaaauguucagacggcuccuggcacuuuuaagaccccagagggggaagugggagccauagcacuggauuucaaacccggcacaucggguagcccuaucgucaacagagaggggaagauugugggacuuuacggcaauggcguugugaccacaucagggacuuaugucuccgcuaucgcccaggcgaaggccagucaagaaggaccgcugccagagauugaggacgaaguguuuaggaaacgaaacuugaccaucauggaucuacaccccgguucuggcaagacgcggcgcuaccugccugcaauaguaagagaggcuauuaaaaggaagcuccggacauuaauccuggccccaacucgagugguugcuagcgaaauggcagaggcccuuaaagggaugcccaucagauaucagaccacagccgucaaguccgaacauaccggacgcgagauuguggaccugaugugccacgcuacuuucaccaugaggcucuugucaccugugcgugucccgaauuacaacaugaucauaauggaugaggcgcauuuuacagaccccgcaucuauugccgcucggggcuauaucagcacgagaguagguaugggggaagccgcagccauuuucaugacugcuaccccaccuggaaguguggaggcguuuccccaguccaaugccguuauccaagaugaagagagggacauaccagaacgcagcuggaacucuggcuacgauuggauuacagacuucccuggcaagaccgugugguuuguccccucaaucaaauccgggaaugauaucgcaaacugucugcgaaagaauggaaaaagagugauucagcucagucggaagacuuucgacacagaguaucagaaaaccaagaacaacgacugggauuacguugugacgacugacaucagcgagaugggugcuaauuuuagggccgaucgcgucauugacccacguagaugccugaagccggugauacuuaaagauggcccugaacggguaauccuagcagggcccaugccagugacaguugccucggcugcccagaggcgcggacgaauuggcagaaaccaaaauaaggagggugaccaguacaucuauauggggcagccccugaacaaugaugaagaccacgcgcauuggaccgaggcaaaaauguuguuagauaacaucaauaccccugagggcauuauaccagcccuguucgaacccgagcggggaaagucugcugccaucgacggcgaauacaggcuccgcggggaggcuagaaaaacuuucgucgaacugaugaggcggggagaucuuccuguguggcuguccuauaagguggcaagcgaggguuuucaguacucagaccguaaauggugcuucgauggcgagcgcaacaaucaaguccucgaagagaacauggacguugaaauuuggacaaaggagggggaacgaaagaaauugagaccgagguggcuggacgcccggaccuauagugauccacaggcucuacgcgaguuuaaggaguucgccgcaggaagaaggucuguguccggcgaccugauccucgaaauugguaaacuuccccagcaccugacacagcgggcgcaaaaugccuuagauaacuugguaaugcugcacaauagcgagcaggggggcaaggcuuaccgacaugccauggaagagcucccugacacuaucgaaacgcugaugcuucuggcacucauagcuguguugaccggaggcgucacacuguuuuucuuaucagggagaggacuagguaaaacuaguaucggccugcucugugugauggccagcuccguucuucuguggguggcaucugucgagccccacuggauugccgcuagcaucauuuuggaguuuuuccugaugguacuccugaucccagaaccugaucgccagaggaccccccaggacaaccaacuugcguaugugguuauagggcuccuguuuaugauuuugacaguggccgcaaaugagaugggacuguuagaaaccacuaagaaggaucuaggcaucggucaugucgcuguggagaaccaccaccaugccacgaugcuggacgucgaucuccggccagccuccgcauggacccuuuacgcuguggccacaacuauuaucaccccuaugaugcgucacacaauagagaacaccacugcgaauaucucacugacagcuauugccaaccaggcagccaucuugauggggcuggacaaaggcuggccgauuucuaagauggauaucggaguuccccuccuggcucuuggcugcuacagucaggugaauccauuaacgcugauagcagccguacucauguugguggcgcauuaugcuauuaucgggccuggacugcaagccaaagcaaccagagaagcccagaagaggacugcugccggcaucaugaaaaaccccacagucgacgguauuguugcaaucgaucuagacccaguggucuacgacgcuaaguucgagaagcagcuggggcagauaaugcuccuuauucuguguaccucgcaaaucuugcugaugcgcaccacaugggcccucugcgaaagcauuacucuggcgacgggaccuuuaaccacacuuugggagggcucccccgguaaauuuuggaauacuaccaucgccgugucuauggcaaacauauuccggggcucauaucuggcuggggccggacucgcauuuagccuaaugaagucccugggcgggggacgaagaggcacaggugcucagggggaaaccuugggagagaaauggaagaggcagcugaaucagcucaguaaaucugaguucaacacuuacaagcgcagcggcaucauggaaguagaucggucagaggccaaggaaggucuuaaaagaggcgagacgacaaagcacgccgugucccgugggaccgcgaaacugaggugguucguugaacggaauuuggugaagccggagggaaaagucauugaccugggcugugggcgcggaggcuggaguuauuacugcgcuggucucaagaaagugacugaggucaagggguauaccaagggaggcccaggccaugaagagccuauccccauggcaacauacggguggaacuuagugaaacugcacagcggaaaggauguuuuuuucacuccacccgaaaaaugugacacccuucugugcgauauuggugagucuuccccuaauccgacaaucgaagagggccgaacgcuaagaguacucaagaugguggagcccuggcugagggggaaccaauuuuguauuaaaaucuugaauccauacaugccuucagucguggaaacccuggagcagaugcagcggaagcacggaggcaugcucguucgcaacccccuuagcagaaauucgacucaugaaauguauugggugucuugcgguacagggaacauagucagugccgugaauaugaccuccaggaugcuguuaaaccgauucacuauggcucaccggaagccuacauacgagcgugacguagaucugggagccggcaccagacauguggcaguugagccagaagucgccaacuuggacauuaucggccagcgcaucgagaauauuaaaaacgaacacaagagcacguggcacuaugaugaggacaaucccuacaaaaccugggcuuaucaugggucauacgaagugaagccuuccggaucugcgagcaguauggugaacggugucguuaggcuccugacaaaaccaugggaugugauacccaugguaacucaaaucgccaugaccgacacaacuccguuuggccagcagcggguguucaaggagaaggucgacaccagaacaccuaaagcaaagcgcgggaccgcucaaauuauggaggugacugccagguggcuauggggauuucuuucccgaaauaaaaagccacggaucuguacgagagaagaguucacaaggaaaguucgcagcaacgcagccauuggcgcuguguuugucgaugaaaaucaguggaacucugccaaggaggcgguggaagacgagcguuucugggaucugguacaccgggagagagaacuccauaagcaggguaaaugcgcaaccugcguuuauaauaugauggggaagagggagaaaaagcugggagaauuuggcaaagccaagggcucacgcgcuaucugguacaugugguugggggcccgauuccuggaguuugaagcacucggauucaugaacgaggaccacugguucagucgggagaauucccuuagcgguguggaaggcgaggggcugcauaaauuaggauacauacugagagauaucucuaagauucccggcgguaacauguaugcugacgauacugccgggugggacaccaggaucacagaagaugacuugcagaaugaggcuaagauuacggauaucauggagccugaacacgcccuccuggcaaccucgauauuuaaacuaacuuaccaaaacaaggucgugcgcgugcagagaccagcgaaaaauggaacagucauggacguuauuucacggagggaucagcguggcagcggccagguggggaccuauggacuuaacacuuucacaaacauggagguacaacugauccgacagauggaauccgaggguaucuuuagucccucugaacucgagaccccgaaucuggccgagcgcguguuggacugguuagaaaagcacggcgucgagagacugaaacggauggcuauuagcggggacgauugugugguuaagccuacagacgauagguucgccacugcacucaccgcucuuaacgacaugggaaaggugcgcaaagauauaccccagugggaaccauccaagggcuggaaugacuggcagcaagucccuuuuugcucacaucacuuccaucagcugaucaugaaagaugguagagagauugugguacccugucggaaccaggacgaacuaguugggagggcccgagugagucagggagcaggcuggucucugcgugagacggccugccucggcaagagcuacgcgcaaauguggcaguugauguauuuucacagacgcgaucugcggcuugcugccaaugcaaucuguuccgccgucccaauugacugggugcccaccucaaggacaacuuggagcauccacgcucaucaccaguggaugaccacagaggauaugcugucuguuuggaacagaguguggauagaagagaauccuuggauggaagacaaaacucaugucuccaguugggaggacgugccauaccucgggaagcgcgaagaucaauggugcggaagcuuaaucggucugaccgcccgggcaacgugggcuacaaacauucagguagccaucaaucaggugaggcgauugauuggcaacgagaauuaucuggacuacaugaccucgaugaagagauucaaaaacgaguccgaucucgaaggggcgcuuugguga

SEQ ID NO: 14228 - RNA, 9879 nt, Artificial Sequence
  derived and/or modified CDS sequence (opt3) from DENV-1__KR024708__SS-prME
agcgugaccaugcugcucaugcuucugcccacagcauuggcuuuccacuuaacuacgagaggaggggaaccucauaugaucgucuccaagcaggaaaggggaaaaucucuguuguuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagagaaaagcuggcuggugcauaaacagugguuucuugaccugccguugcccuggacgucuggcgcauccaccucacaagaaacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaaggggugucuuaugucauguguacaggauccuucaaguuggagaaggaaguggcugagacucagcacgguaccguucuggugcagguaaaauacgagggcacggaugcgccuugcaagauaccaaucagcacacaagacgaaaaaggggucacccagaacggacgucucauuacugcaaaucccaucgugacagauaaggagaaaccuguuaacauagaaaccgagccacccuucggcgagucguauauugugaucggugccggggaaaaggcucugaaacuuucuugguuuaaaaagggcuccucaaucggaaaaauguucgaggccacugcacgcggcgccagaaggauggcuauucugggggacaccgccugggauuuuggaaguaucgguggcgucuucacaagcguggggaaguugguacaucagguguuuggaacggcauacggcguucucuucuccggugucucuuggaccaugaaaauugggauaggcauccuguuaacuuggcugggacuaaauagccggucaacaagucucuccaugaccuguauugcggugggcauggugacacuguaccuuggggucaugguucaggcugacagcggaugcgugaucaacuggaagggccgagaauugaagugugguucugggaucuuugugacuaacgagguacacaccuggacggaacaauauaaauuccaggccgauucaccgaagcgccugagugcagccauuggaaaggcuugggaggagggcgucugcgguauaagaagcgccacaaggcucgaaaauaucauguggaagcagauuuccaacgagcugaaucauaucuuacuggaaaacgacaugaaauuuaccgugguugugggcgacgcaaaugggauucuuacucagggaaagaaaaugauccggccucaacccauggagcacaaguacucuuggaagucguggggcaaagcuaagauaaucggggccgauacccagaacacaacuuucauuaucgacggaccagauaccccugaaugucccgacgaucagcgcgcguggaauauuugggaggucgaggacuauggcuuugguguguucacaacgaacaucugguugaaacucagagauagcuacacccagaugugcgaccacaggcugauguccgccgcuauaaaggauucaaaagcaguucaugccgacaugggguauuggauugaaagugagaagaaugaaacuuggaagcuagcucgugccucuuuuaucgaggugaaaacauguauuuggccacggagccacacccugugguccaacggaguacucgaaucagagaugaucauacccaagaucuacggcgguccuauuagccaacauaauuaucgaccaggcuacuucacucagacagcagggccguggcaccugggaaaacuugaguuggauuucaaccugugcgaaggcaccacggucgugguggacgagcacugcgggaauagaggacccucuuuaaggacuaccacagucaccggcaagaucauucaugaaugguguugccgcuccuguacucucccuccacugcgguuuagaggugaggaugggugcugguacggaauggagaucaggcccguuaaagaaaaggaggaaaaccuugugcgcaguaugguaagcgcgggcucuggugagguggacuccuucucacugggcuugcucugugucaguauaaugauugaagaggugaugcgaagccgguggucgcguaagaugcugaugacagggacccuagccguauuuuuccugcucaucaugggacagcugacauggaaugaccuuaucagauugugcauuauggugggcgcuaacgucuccgauaggauggggaugggaacuaccuaucuggccuuaauggcaacguuuaaaaugcgcccuauguucgcugugggccuccuguuucggagacuuacaucuagggagguucugcuacucaccaucggucugagcuugguggccucagucgaacugccaaacaguuuagaggaacucggggacggacuggcaaugggcauuaugaugcuuaagcuguugacugauuuccaaucccaccagcucuggaccacacugcuaucucugacuuuuauaaaaaccacgcuuagccucgacuacgccuggaagacaauggcuaugguacuguccaucgugucauuguucccccuguguuuaagcaccacaagucagaaaacaaccuggcucccgguucugcuuggcucuuuugggugcaagccucugacuauguucuugauuacagagaauaagaucuggggacgaaaauccuggccacucaacgaagguauuauggcggugggcaucgucagcauacugcuaucgucacugcuuaagaaugaugugccccucgccgggccucugaucgcaggaggcauguugauugcuuguuauguaaucucugguaguuccgccgacuuaagccuggagcgcgccgcugaggugucuugggaagaggaagcagagcauagcggggccucccacaacauucucgucgaaguucaggaugacggaaccaugaaaaucaaggaugaggagcgggacgauacgcugacuauacuucugaaagcgaccuugcuagcugugucaggcguguaccccaugaguauuccagccacacuguuugucugguauuucuggcaaaagaaaaagcagagaagcggcgugcucugggacaccccuucucccccagaaguugagagggcaguacuggaugacgggaucuaccguauccuucagcgcggauuacugggucggucccaggugggcgucgggguguuccaagacggaguuuuucauacaauguggcacgugacuagaggcgccguccucauguaucaggguaagagguuggaaccgucaugggcuagugugaaaaaggaucugauuagcuacgggggaggcuggcgauuccagggcuccuggaauaccggggaggagguacaggucauagcaguggaaccuggcaaaaaccccaagaauguucaaacgacaccagguacuuuuaaaacccccgagggcgaagugggggccaucgcgcucgacuucaagccuggaacaucuggcucgccaauugucaaccgggaggguaagaucguggggcuguacggaaauggcguugugaccacuagcggcaccuaugucucagcuauugcccaggcaaaagccucccaggaagggccccuuccugagaucgaggaugaaguguuuaagaaacgcaaccugacaauaauggacuugcacccgggaagugguaagacgagaagguaccuaccagcuaucguacgggaggccauuaaacgaaagcugagaacucucaucuuagcacccacccgcgugguugcuucugaaauggccgaggcgcugaagggcaugccuauuagguaucaaacaaccgccgucaaaagcgaacauacugggaaggagaucguggaucuuaugugccacgcaacauucaccaugcgucugcucuccccagugcggguccccaauuacaacaugauaauuauggacgaggcucauuuuacggauccugccucaaucgcugcaagaggauauaucucuacuaggguaggcaugggugaagccgccgcuauuuucaugacagcgaccccgcccgggagcguggagaguuuuccacaguccaaugcaguuauccaggacgaagaacgcgauauaccugaacgaagcuggaacucuggauacgacuggauuaccgauuuccccggcaaaacugugugguuugucccaucaaucaaguccggcaaugacauugccaacuguuugaggaaaaacgggaagcgggugauccagcugaguaggaagacauucgacaccgaguaucagaaaacuaagaauaacgauugggacuacguugugacuacggauauaagcgagaugggagcuaauuuccgcgccgaccgugucauugauccuagacggugccucaaacccgugauccugaaggacgguccagaaaggguaauccuugcaggcccgaugccugugaccgccgcuucggcggcccaacgccgagggagaauuggacggaaccagaauaaagagggcgaucaguacaucuauaugggucaaccccuaaacaaugacgaagaucacgcacauuggacagaggcuaagaugcuguuggacaacauuaauacuccagaggggauaauccccgccuuauuugaaccugagagggaaaagucugcagccauugauggcgaguaccgccugagaggagaagcuaggaaaaccuucguugagcucaugcggcguggcgaccugccagucuggcuuuccuauaagguggccagcgagggguuucaguacucagaucgccgauggugcuucgacggagaaagaaacaaucaggugcuggaggaaaacauggacgucgagaucuggacaaaagaaggugagaggaagaaacuccggccccgcugguuggaugcgagaaccuauagugacccucuggcacuaagggaguuuaaggaguucgccgcuggccggcgaucuguuuccggggaucugauccucgagauuggaaaacuuccgcagcaccugacuuuaagagcccaaaaugcuuuggacaaccuggugaugcuccacaauagcgaacagggcgguaaggcauaccgccaugccauggaggaacugccagauacgauagagacccuuaugcugcucgcuuugaucgccguacugacagggggcgugacuuuauuuuuccuaucaggaaagggccuggggaaaaccaguauuggacuccuuugugucauggcaagcuccgugcuguuguggauggcgucuguugagccccacuggaucgccgcuagcauuauccuggaauuuuuccucauggugcugcuuauaccugagcccgacaggcagcggacaccacaggauaaccaacucgccuaugucguaaucggucuguuguuuaugauucugaccguggcagcuaacgaaaugggcuuacuagagacuacaaagaaagaccuggggaucggacauguuguggccgagaaucaccaccaugcaacgaugcucgauauugaccuucacccugccuccgcuuggacccuguacgcggucgccacuacaaucauaacccccaugaugcgucauaccauugaaaacacaacugcaaauaucucauugacggcuauugccaaccaggccgcaauccugaugggccucgauaaggguuggccaauaucuaaaauggacaucggggugccucugcuugcuuuaggcugcuacagucaggucaauccgcugacccucacagccgcgguguugaugcugguugcucacuaugccauuaucggacccggccuacaagcaaaggccacuagagaggcucagaagaggaccgcagccgggauuaugaaaaacccaacaguggauggaaucguagcgauagaccuggacccuguggucuacgaugcuaaguucgaaaaacagcucggccagauuaugcuucugaucuuguguaccucgcaaauccugcucaugcgcacuacgugggcccugugcgagagcauuacauuagcaaccgguccccuuacuacccugugggaaggguccccaggaaaguuuuggaauacaacuaucgccguuucuauggcuaacauauuccggggcucauaucucgccggugcaggccuagcuuucagccugaugaaaucccuagggggaggccgaagagggaccggagcccagggcgagacacugggugagaaguggaagaggcagcucaaucagcuuaguaaaucugaauuuaacacguacaagcgcagcgggauuauggagguggaccggucagaagcgaaagagggacugaagagaggcgaaaccacuaaacaugccgucucccgugguacagcaaaguugaggugguucguggagcggaaucugguaaagccugagggcaaagugaucgaucucggguguggacgcggcggguggaguuauuacugcgcuggauuaaagaaaguuaccgaagugaagggcuauacuaaaggugggcccggacacgaggaaccgauuccaauggccacauacggcuggaacaucgucaagcugcacagcggccgagacguguuuuucaccccucccgagaaaugugauacgcuucugugcgacauaggggaaucuuccccaaaucccaccaucgaggagggaagaacacuaaggguccucaagaugguggaaccuuggcugcgggguaaccaauuuuguauuaagaucuugaauccguacaugcccucaguuguagagacucuggaacagaugcagcgcaaacauggcgggaugcucgugagaaacccacuuagcagaaauucgacccacgagauguauugggucucuugcggaacaggcaacauugugagugcaguuaacaugacuucccgaaugcuguuaaaucgguucaccauggcucaucguaagccuacauacgagagagauguggaccugggugccgggacccgccacgucgccguggaacccgagaucgcgaacuuggauauuaucggacagaggauagaaaauauuaaaaacgagcacaagagcacuuggcauuaugacgaagauaauccuuacaaaacgugggcuuaucacggcucauacgagguaaagccauccggcucugcaagcaguauggugaacgggguuguccggcuccugacaaagcccugggacgugaucccuauggugacccaaaucgccaugacugacaccacaccauuuggacagcagagagucuucaaagagaagguugauacgcgcacccccaggccgaaacgagguacugcucaaauuauggaagugacagccaaguggcuauggggcuuucuuucccggaauaaaaagccuagaauauguaccagggaggaguucacucgcaagguacguagcaacgcagccaucggggcuguguuugucgacgagaaucaguggaacucugcgaaagaagccguggaggaugagcgguucugggaccugguucauagagaaagggagcuccacaagcagggaaaaugcgcaacaugcguguauaauaugaugggcaagcgcgagaaaaagcugggugaguuugggaaggcuaaaggaucacgagccauuugguacaugugguugggcgcacgguuccuggaguucgaggcccucggcuuuaugaacgaggaucauugguucaguagagaaaauucccuuagcggggucgagggagaaggucugcacaaguuaggcuacauccugagggacauuucuaaaaucccagggggaaacauguaugcugaugacaccgccggcugggauacacgcauaacugaggacgauuugcagaaugaggcgaagaucaccgacauuauggaacccgagcacgcacuccuggccacgucgaucuuuaaacuaaccuaccaaaacaaggugguaagaguucagcggccugcuaaaucagguacagugauggaugucauuagcaggcgugaccagcgaggguccggacaggugggcacuuauggccuuaacaccuucacaaauauggaagugcaacugauccgccagauggagagugaagggauauuuucuccaagcgagcucgagaacuccaaucuggccgaaagagucuuggacugguuagagaagcauggaguugaacggcugaagaggauggcaauuucaggugaugacugugugguaaaacccacugaugaccgcuucgcuaccgcccucacggcucuuaacgauaugggcaaggugagaaaagacaucccgcagugggagccuaguaagggguggaaugauuggcagcaaguccccuuuugcucucaccauuuccaccagcugaucaugaaagacggacgggaaauugugguuccauguaggaaccaggaugagcuagugggccgagcccgugucagccagggugcaggguggucccugagagagacagcgugccucggaaagucauacgcccaaauguggcaguugauguauuuucaccgccgggaccugaggcuugcugccaaugcaauauguagcgcugugccuguaaacuggguucccaccucuagaacuacaugguccauccaugcccaccaucaguggaugaccacugaagauaugcugaguguguggaaucgcgucuggauugaggaaaacccauggauggaggacaagacccacgugagcucgugggaagacguucccuaccucggcaaacgggaggaucaauggugcggcuccuuaaucgggcugacagcaagggccacgugggcgaccaauauucagguggcuaucaaccagguccgaagauugauaggaaaugagaacuaucuggacuacaugacuucuaugaagcgguucaaaaaugaaucagauccugagggugcccucugguga

SEQ ID NO: 14229 - RNA, 9879 nt, Artificial Sequence
  derived and/or modified CDS sequence (opt3) from DENV-1__KR024705__SS-prME
agcgugaccaugcugcucaugcuucugcccacugcauuggcuuuccacuuaacuacgagaggaggggaaccucauaugaucgucuccaagcaggaaagaggaaaaucucuguuguuuaagaccucagccgguguuaacaugugcacccucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggccaagaauaagcccacucuagauaucgaacuccugaaaacagaggugaccaacccugccgugcuuagaaagcugugcauugaagcuaaaaucuccaaugccacgaccgacucuagguguccaacacaaggagaggcaacuuuggucgaagaacaagaugcuaacuucguuugccggcgcaccuuuguggaccgaggcugggguaauggguguggacucuucggcaagggcagccuguuaacaugcgccaaguuuaaaugcguaacuaagcuggaggggaaaauagugcaguacgaaaaccucaaguauuccgucauugugaccguucacacaggagaucagcaucaaguggguaaugagaccacugaacacggcacgaucgcgacaauuacaccccaggccccuacuucagagauccagcuuaccgacuacggggcacugacauuggacuguaguccaagaaccggacuagauuucaacgaaaugguccugcucacuaugaaagagaaaagcuggcuggugcauaaacagugguuucuugaccugccguugcccuggacaucuggcgcuuccacgucacaagaaaccuggaauaggcaggaucuccugguaacuuucaagacagcccacgcuaagaaacaggaaguuguggucuuagguagccaagagggggccaugcacaccgcacugacaggcgccacugaaauccagaccaguggaacgaccacaauuuuugcuggccaucuaaagugccggcucaaaauggacaagcugacucuuaaaggggugucuuaugucauguguaccggauccuucaaguuggagaaggaaguggcggagacacagcacgguacuguucuggugcagguaaaauacgagggcaccgaugcaccuugcaagauaccaaucagcacgcaagacgaaaaaggggucacacagaacggacgucucauuaccgccaaucccaucgugacugauaaggagaaaccuguuaacauagaaacagagccacccuucggcgagucguauauugugaucggugcuggggaaaaggcccugaaacuuucuugguuuaaaaagggcuccucaaucggaaaaauguucgaggcaaccgcccgcggcgcuagaaggauggccauucugggggacacugcaugggauuuuggaaguaucgguggcgucuucaccagcguggggaaguugguacaucagguguuuggaacagcguacggcguucucuucuccggugucucuuggacgaugaaaauugggauaggcauccuguuaaccuggcugggacuaaauagccggucaacaagucucuccaugacauguauugcugugggcauggugacccuguaccuuggggucaugguucaggccgacagcggaugcgugaucaacuggaagggccgagaauugaagugugguucugggaucuuugugacaaacgagguacacacuuggaccgaacaauauaaauuccaggcagauucaccgaagcgccugagugccgcuauuggaaaagccugggaggagggcgucugcgguauaagaagcgcaacgaggcucgaaaauaucauguggaagcagauuuccaacgagcugaaucauaucuuacuggaaaacgacaugaaauuuacagugguugugggcgacgcuaaugggauucuuacccagggaaagaaaaugauccggccucaacccauggagcacaaguacucuuggaagucguggggcaaagccaagauaaucggggcggauacucagaacaccacauucauuaucgacggaccagauacuccugaaugucccgacgaucagcgcgccuggaauauuugggaggucgaggacuauggcuuugguguguucaccacaaacaucugguugaaacucagagauagcuacacgcagaugugcgaccacaggcugauguccgcugcaauaaaggauucaaaagccguucaugcugacaugggguauuggauugaaagugagaagaaugaaaccuggaagcuagcccgugcaucuuuuaucgaggugaaaacuuguauuuggccacggagccacacacugugguccaacggaguacucgaaucagagaugaucauacccaagaucuacggcgguccuauuagccaacauaauuaucgaccaggcuacuucacccagacugcggggccguggcaccugggaaaacuugaguuggauuucaaccugugcgaaggcacaaccgucgugguggacgagcacugcgggaauagaggacccucuuuaaggacgacuaccgucacaggcaagaucauucaugaaugguguugccgcuccuguacccucccuccacugcgguuuagaggugaggaugggugcugguacggaauggagaucaggcccguuaaagaaaaggaggaaaaccuugugcgcaguaugguaagcgccggcucuggugagguggacuccuucucacugggcuugcucugugucaguauaaugauugaagaggugaugcgaagccgguggucgcguaagaugcugaugacugggacacuagcuguauuuuuccugcucaucaugggacagcugaccuggaaugaccuuaucagauugugcauuauggugggcgccaacgucuccgauaggauggggaugggaacaacuuaucuggcauuaauggcuaccuuuaaaaugcgcccuauguucgccgugggccuccuguuucggagacuuacgucuagggagguucugcuacucacaaucggucugagcuugguggcaucagucgaacugccaaacaguuuagaggaacucggggacggacuggccaugggcauuaugaugcuuaagcuguugaccgauuuccaaucccaccagcucuggacuacccugcuaucucugacauuuauaaaaacuacccuuagccucgacuacgcuuggaagacgauggcgaugguacuguccaucgugucauuguucccccuguguuuaagcacaaccagucagaaaacuacauggcucccgguucugcuuggcucuuuugggugcaagccucugaccauguucuugauuacugagaauaagaucuggggacgaaaauccuggccacucaacgaagguauuauggccgugggcaucgucagcauacugcuaucgucacugcuuaagaaugaugugccccucgcagggccucugaucgcuggaggcauguugauugccuguuauguaaucucugguaguuccgccgacuuaagccuggagcgcgcugcagaggugucuugggaagaggaagccgagcauagcggggcgucccacaacauucucgucgaaguucaggaugacggaacaaugaaaaucaaggaugaggagcgggacgauacccugacgauacuucugaaagcuacuuugcuagccgugucaggcguguaccccaugaguauuccagcaacccuguuugucugguauuucuggcaaaagaaaaagcagagaagcggcgugcucugggacacaccuucucccccagaaguugagagggccguacuggaugacgggaucuaccguauccuucagcgcggauuacugggucggucccaggugggcgucgggguguuccaagacggaguuuuucauaccauguggcacgugacaagaggcgcuguccucauguaucaggguaagagguuggaaccgucaugggcaagugugaaaaaggaucugauuagcuacgggggaggcuggcgauuccagggcuccuggaauacuggggaggagguacaggucauagccguggaaccuggcaaaaaccccaagaauguucaaaccacgccagguacauuuaaaacucccgagggcgaagugggggcgaucgcucucgacuucaagccuggaaccucuggcucgccaauugucaaccgggaggguaagaucguggggcuguacggaaauggcguugugacaaccagcggcacuuaugucucagccauugcacaggccaaggcuucccaggaagggccccuuccugagaucgaggaugaaguguuuaagaaacgcaaccugaccauaauggacuugcacccgggaagugguaagacaagaagguaccuaccagccaucguacgggaggcaauuaaacgaaagcugagaacgcucaucuuagcucccacucgcgugguugccucugaaauggcggaggcccugaagggcaugccuauuagguaucaaaccacagcagucaaaagcgaacauaccgggaaggagaucguggaucuuaugugccacgcuacuuucacaaugcgucugcucuccccagugcggguccccaauuacaacaugauaauuauggacgaggcccauuuuaccgauccugcuucaaucgcagccagaggauauaucucuacgaggguaggcaugggugaagccgcugcgauuuucaugacugcaacaccgcccgggagcguggaggccuuuccacagaguaaugcuguuauccaggacgaagaacgcgauauaccugaacgauccuggaacagcggauacgacuggauuaccgauuuccccggcaaaaccgugugguuugucccaucuaucaagucaggcaaugacauugccaacuguuugaggaaaaacgggaagcgggugauccagcuguccaggaagacuuucgacacagaguaucagaaaaccaagaauaacgauugggacuacguugugacaacugauauaagugagaugggagcaaauuuccgcgccgaccgugucauugauccuagacggugccucaaacccgugauccugaaggacgguccagaaaggguaauccuugcuggcccgaugccugugacggcggccagcgcagcucagcgccgagggagaauuggacggaaccagaauaaagagggcgaucaguacaucuauaugggucaaccccuaaacaaugacgaagaucacgcccauuggaccgaggcaaagaugcuguuggacaacauuaauacaccagaggggauaauccccgccuuauuugaaccugagagggaaaagucggcugccauugauggcgaguaccgccugagaggagaagcgaggaaaacuuucguugagcucaugcggcguggcgaccugccagucuggcuuucuuauaagguggcauccgagggguuucaguacagcgaucgccgauggugcuucgacggagaaagaaacaaucaggugcuggaggaaaacauggacgucgagaucuggaccaaagaaggugagaggaagaaacuccggccccgcugguuggaugccagaacauauucagacccucuggcucuaagggaguuuaaggaguucgccgcuggccggcgaaguguuucuggggaucugauccucgagauuggaaaacuuccgcagcaccugaccuuaagagcacaaaaugccuuggacaaccuggugaugcuccacaauuccgaacagggcgguaaggcuuaccgccaugccauggaggaacugccagauacuauagagacgcuuaugcugcucgcauugaucgcgguacugaccgggggcgugacauuauuuuuccuaagcggaaagggccuggggaaaacuucaauuggacuccuuugugucauggccaguagcgugcuguuguggauggcuuccguugagccccacuggaucgccgcaucuauuauccuggaauuuuuccucauggugcugcuuauaccugagcccgacaggcagcggaccccacaggauaaccaacucgcuuaugucguaaucggucuguuguuuaugauucugacaguggccgcaaacgaaaugggcuuacuagagaccacuaagaaagaccuggggaucggacauguuguggccgagaaucaccaccaugcuacaaugcucgauauugaccuucacccugcgagcgccuggacgcuguacgcagucgcuaccacuaucauaacacccaugaugcgucauaccauugaaaacaccacagccaauaucuccuugacugccauugcaaaccaggcugccauccugaugggccucgauaaggguuggccaauaucaaaaauggacaucggggugccucugcuugcguuaggcugcuacucucaggucaauccgcugacgcucaccgcugccguguugaugcugguugcacacuaugccauuaucggacccggccuacaagcuaaggcaacaagagaggcccagaagaggacugcggcugggauuaugaaaaacccaaccguggauggaaucguagccauagaccuggacccuguggucuacgaugcaaaguucgaaaaacagcucggccagauuaugcuucugaucuuguguacaagucaaauccugcucaugcgcaccacuugggcccugugcgagucgauuacguuagcuacagguccccuuaccacucugugggaagggagcccaggaaaguuuuggaauaccacaaucgccguuuccauggcaaacauauuccggggcucuuaucucgcuggugccggccuagcguucucacugaugaaaagccuagggggaggccgaagagggacuggagcccagggcgagacccugggugagaaguggaagaggcagcucaaucagcuuuccaaaagugaauuuaacacauacaagcgcucugggauuauggagguggaccggagcgaagcaaaagagggacugaagagaggcgaaacgaccaaacaugcugucucacgugguacugccaaguugaggugguucguggagcggaaucugguaaagccugagggcaaagugaucgaucucggguguggacgcggcgggugguccuauuacugcgcaggauuaaagaaaguuacagaagugaagggcuauaccaaaggugggcccggacacgaggaaccgauuccaauggcuacuuacggcuggaacaucgucaagcugcacaguggccgagacguguuuuucacaccucccgagaaaugugauacccuucugugcgacauaggggaaagcucuccaaaucccacgaucgaggagggaagaacccuaaggguccucaagaugguggaaccuuggcugcgggguaaccaauuuuguauuaagaucuugaauccguacaugcccuccguuguagagacacuggaacagaugcagcgcaaacauggcgggaugcucgugagaaacccacuuucaaggaauagcacucacgagauguauugggucucgugcggaaccggcaacauugugucugccguuaacaugacaagucgaaugcuguuaaaucgguucacuauggcccaucguaagccuaccuacgagagagauguggaccugggugcggggacacgccacgucgcuguggaacccgagaucgcaaacuuggauauuaucggacagaggauagaaaauauuaaaaacgagcacaaguccaccuggcauuaugacgaagauaauccuuacaaaacuugggccuaucacggcagcuacgagguaaagccaucaggcuccgcuucuagcauggugaacgggguuguccggcuccugacgaagcccugggacgugaucccuauggugacacaaaucgccaugaccgacacuaccccauuuggacagcagagagucuucaaagagaagguugauacacgcacgcccaggccgaaacgagguaccgcacaaauuauggaagugacugccaaguggcuauggggcuuucuuagucggaauaaaaagccuagaauauguacaagggaggaguucacccgcaagguacguuccaacgcugcgaucggggccguguuugucgacgagaaucaguggaacagcgcaaaagaagcuguggaggaugagcgguucugggaccugguucauagagaaagggagcuccacaagcagggaaaaugcgccacuugcguguauaauaugaugggcaagcgcgagaagaaacugggugaguuugggaaggcaaaaggaucucgagccauuugguacaugugguugggcgcucgguuccuggaguucgaggcccucggcuuuaugaacgaggaucauugguucucaagagaaaauagucuuuccggggucgagggagaaggucugcacaaguuaggcuacauccugagggacauuagcaaaaucccagggggaaacauguaugcggaugacacagcaggcugggauacccgcauaacagaggacgauuugcagaaugaggccaagaucacugacauuauggaacccgagcacgcucuccuggccaccucuaucuuuaaacuaacguaccaaaacaaggugguaagaguucagcggccugcaaaaucggguaccgugauggaugucauuucaaggcgugaccagcgagggagcggacaggugggcacauauggccuuaacacuuucaccaauauggaagugcaacugauccgccagauggaguccgaagggauauuuaguccaucugagcucgagaacagcaaucuggcugaaagagucuuggacugguuagagaagcauggaguugaacggcugaagaggauggccauuuccggugaugacugugugguaaaacccacagaugaccgcuucgcuacugcccucaccgcacuuaacgauaugggcaaggugagaaaagacaucccgcagugggagccuucaaagggguggaaugauuggcagcaaguccccuuuugcagucaccauuuccaccagcugaucaugaaagacggacgggaaauugugguuccauguaggaaccaggaugagcuagugggccgagcgcgugucucucagggugccggguggagccugagagagacggcuugccucggaaaguccuacgcccaaauguggcaguugauguauuuucaccgccgggaccugaggcuugcagcuaaugccauauguucagcagugccuguaaacuggguucccacaagcagaaccacuuggucuauccaugcccaccaucaguggaugacaaccgaagauaugcuguccguguggaaucgcgucuggauugaggaaaacccauggauggaggacaagacucacgugaguagcugggaagacguucccuaccucggcaaacgggaggaucaauggugcggcucguuaaucgggcugaccgcgagggcuacaugggccacgaauauucagguggcaaucaaccagguccgaagauugauaggaaaugagaacuaucuggacuacaugaccuccaugaagcgguucaaaaaugaaucugauccugagggugcccucugguga

SEQ ID NO: 14230 - RNA, 9879 nt, Artificial Sequence
  derived and/or modified CDS sequence (opt3) from DENV-1__KR024706__SS-prME
agcgugaccaugcugcucaugcuucugcccacugcauuggcuuuccacuuaacuacgaggggcggggaaccucauaugaucgucuccaagcaagaaaggggaaaaucucugcuauuuaagaccucagccgguguuaacaugugcacccucauugccauggaccugggcgagcuuugugaagauacuaugaccuacaaaugcccacggauaacaggggcggagccggacgauguggacuguuggugcaaugcuaccgauacuuggguaacauauggaaccuguagucaaacgggcgaacaccgccgagacaagcguagcguggcccuggcaccccaugucgguuuggggcucgagacuagaaccgagacauggauguccucugaaggagccuggaggcagauccagaaaguggagacuugggcucugcggcacccuggcuucaccguuauugcauuuuuccuggcccaugcuaucggcacaucgauuacccagaaggggaucauauuuauccucuuaaugcuggugacgccaucaauggccaugcgcugcgucggaauugguaacagagauuucguggaaggccuuagcggggcgacuuggguugacguuguguuggagcacggaaguugugucacaaccauggcaaagaauaaacccacucuggauaucgagcuacucaagacagaagugaccaacccugccgugcugaggaaacuuugcauugaggcuaagaucuccaauacgaccacagacucucgguguccaacucaaggcgaagccacccuggucgaggaacaggaugcaaacuuuguuugccgccgaacauugguggacagagguugggggaauggauguggccucuucggcaaagggagccuguuaacuugcgcuaaguuuaagugcguaaccaaacuggagggaaagauagugcaguacgagaaccucaaauauuccgucauugugacaguucacaccggugaucagcaucaagugggcaaugaaacuacggagcacgggacaaucgccaccauuacuccccaggcgccuaccucagaaauccagcuuacagacuacggagcccugaccuuggacuguaguccaaggacuggccuagauuucaacgagaugguccugcucacaaugaaggagaaaagcuggcuggugcauaagcagugguuucuugaccugccguugcccuggacgucuggugcauccaccucacaagagacuuggaaucggcaggaucuccugguaacauucaaaaccgcucacgccaagaagcaggagguuguggucuuagggagccaagaaggcgcuaugcacacagcccugacuggagcaaccgagauccagacgaguggcaccacaacuauuuuugccgggcaucuaaaaugccgucucaagauggacaaacugacccuuaagggagugucuuaugucauguguacagguuccuucaaauuggaaaaggagguggcugaaacucagcacggcaccguucuggugcagguaaaguacgaggggacggaugcgccuugcaaaauaccaaucagcacacaagacgagaagggagucacccagaacggccgccucauuacugcaaaucccaucgugacagauaaagaaaagccuguuaacauagagaccgaaccacccuucggugagucguauauugugaucggggccggcgagaaagcucugaaacuuucuugguuuaagaaaggauccucaaucggcaagauguucgaagccacugcaagaggggccaggcggauggcuauucugggagacaccgccugggauuuugguaguaucggcggggucuucacaagcgugggaaaauugguacaucagguguuuggcacggcauacgguguucucuucuccggggucucuuggaccaugaagauuggcauaggaauccuguuaacuuggcugggccuaaauagccgaucaacaagucucuccaugaccuguauugcgguggggauggugacacuguaccuuggagucaugguucaggcugacagcggcugcgugaucaacuggaaaggucgcgaguugaagugugggucuggaaucuuugugacuaacgaaguacacaccuggacggagcaauauaaguuccaggccgauucaccgaaaagacugagugcagccauuggcaaggcuugggaagagggugucugcggcauaaggagcgccacacggcucgagaauaucauguggaaacagauuuccaacgaacugaaucauaucuuacuggagaacgacaugaaguuuaccgugguugugggggacgcaaauggcauucuuacucagggcaaaaagaugauccgcccucaacccauggaacacaaauacucuuggaagucgugggggaaggcuaaaauaaucggagccgauacccagaacacaacuuucauuaucgacggcccagauaccccugagugucccgacgaucagagagcguggaauauuugggaagucgaggacuaugguuuugggguguucacaacgaacaucugguugaagcucagggauagcuacacccagaugugcgaccaccgucugauguccgccgcuauaaaagauucaaaggcaguucaugccgacaugggauauuggauugagagugagaagaaugagacuuggaagcuagcucgggccucuuuuaucgaagugaagacauguauuuggccacgaagccacacccugugguccaacggcguacucgagucagaaaugaucauacccaaaaucuacgguggcccuauuagccaacauaauuauagaccaggguacuucacucagacagcaggaccguggcaccugggcaaacuugaguuggauuucaaccugugcgaggggaccacggucgugguggacgaacacugcggaaauaggggccccucuuuacgcacuaccacagucaccgguaaaaucauucaugagugguguugccgguccuguacucucccuccacugagauuuagaggggaagauggaugcugguacggcauggagauccgccccguuaaggagaaagaagagaaccuugugcgaaguaugguaagcgcggguucuggcgaaguggacuccuucucacugggguugcucugugucaguauaaugauugaggaagugaugcggagccguuggucgagaaagaugcugaugacaggaacccuagccguauuuuuccugcucaucaugggccagcugacauggaaugaccuuaucagguugugcauuauggugggggcuaacgucuccgaucgcaugggaaugggcacuaccuaucuggccuuaauggcaacguuuaagaugcggccuauguucgcugugggucuccuguuuagaaggcuuacaucucgagagguucugcuacucaccaucgggcugagcuugguggccucagucgagcugccaaacaguuuagaagaacucggagacggccuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuugggucuuuuggaugcaaaccucugacuauguucuugauuacagaaaauaagaucuggggucgcaaguccuggccacucaacgagggcauuauggcgguggggaucgucagcauacugcuaucgucacugcuuaaaaaugaugugccccucgccggaccucugaucgcaggcgguauguugauugcuuguuauguaaucucugggaguuccgccgacuuaagccuggaacgggccgcugaggugucuugggaggaagaggcagaacauagcggagccucccacaacauucucgucgagguucaggaugacggcaccaugaagaucaaagaugaagagagagacgauacgcugacuauacuucugaaggcgaccuugcuagcugugucaggcguguaccccaugaguauuccagccacacuguuugucugguauuucuggcagaaaaagaaacagaggagcggggugcucugggacaccccuucucccccagagguugaacgugcaguacuggaugacggaaucuaccgcauccuucagcgggguuuacugggcagaucccaggugggggucggaguguuccaagacggcguuuuucauacaauguggcacgugacuaggggugccguccucauguaucaggggaagcgauuggagccgucaugggcuagugugaagaaagaucugauuagcuacggaggcggcuggcgguuccagggguccuggaauaccggagaagagguacaggucauagcaguggagccugguaagaaccccaaaaauguucaaacgacaccaggcacuuuuaagacccccgaaggggaggugggagccaucgcgcucgacuucaaaccuggcacaucugguucgccaauugucaaccgcgaagggaagaucgugggacuguacggcaauggcguugugaccacuagcgggaccuaugucucagcuauugcccaggcaaaggccucccaggagggaccccuuccugaaaucgaggaugagguguuuaaaaagagaaaccugacaauaauggacuugcacccggguaguggcaaaacgaggcgguaccuaccagcuaucguacgagaagccauuaagagaaaacugcgcacucucaucuuagcacccaccagggugguugcuucugagauggccgaagcgcugaaggggaugccuauucguuaucaaacaaccgccgucaagagcgagcauacuggaaaagaaaucguggaucuuaugugccacgcaacauucaccaugcggcugcucuccccagugagaguccccaauuacaacaugauaauuauggacgaggcucauuuuacggauccugccucaaucgcugcaaggggcuauaucucuacucgcguagguaugggggaggccgccgcuauuuucaugacagcgaccccgcccggaagcguggaagcauuuccacagaguaaugccguuauccaggacgaggaacgagauauaccugagagauccuggaacagcggcuacgacuggauuaccgauuuccccggcaagacugugugguuugucccaucuaucaaaucagggaaugacauugcuaacuguuugcggaagaacggaaaaagggugauccagcugucccgcaagacauucgacaccgaauaucaaaagacuaaaaauaacgauugggacuacguugugacuacggauauaagugagaugggugccaauuuccgugcagacagagucauugauccucggaggugccucaagcccgugauccugaaagacggcccagagcgcguaauccuugccgggccgaugccugugaccgcugcgagcgccgcacagcgaagaggacggauuggcaggaaccagaauaaggaaggugaucaguacaucuauauggggcaaccccuaaacaaugacgaggaucacgcucauuggacagaagccaaaaugcuguuggacaacauuaauacuccagagggcauaauccccgcauuauuugagccugaacgcgagaagucggccgcuauugauggagaauacagacugggcggggaggccaggaagaccuucguugaacucaugaaacggggagaccugccagucuggcuuucuuauaagguggcguccgaggguuuucaguacagcgaucgucgcuggugcuucgacggcgagcgaaacaaucaggugcuggaagagaacauggacgucgaaaucuggacaaaagagggggaaagaaagaaacucaggccccggugguuggaugcacgcaccuauucagacccucuggcccuaagagaguuuaaggaguucgcugccggaaggcggaguguuucuggcgaucugauccucgaaauugguaaacuuccgcagcaccugacuuuacgagcucaaaaugcauuggacaaccuggugaugcuccacaauuccgagcaagggggaaaggccuacagacaugcuauggaagaacugccagauacgauagaaacccuuaugcugcucgccuugaucgcaguacugacaggaggcgugacuuuauuuuuccuaagcgggaagggacuggguaaaaccucaauuggccuccuuugugucauggcgaguagcgugcuguuguggauggccuccguugagccccacuggaucgcugccucuauuauccuggaguuuuuccucauggugcugcuuauaccugaacccgaccgccagaggacaccacaggauaaccagcucgcauaugucguaaucgggcuguuguuuaugauucugaccguggcugccaacgagaugggauuacuagaaacuacaaagaaagaccugggcaucggucauguuguggcagagaaucaccaccaugccacgaugcucgauauugaccuucacccugcuagcgcguggacccuguacgccgucgcaacuacaaucauaacccccaugaugcggcauaccauugagaacacaacugcuaauaucuccuugacggccauugccaaccaggcagcuauccugauggggcucgauaagggcuggccaauaucaaaaauggacaucggagugccucugcuugccuuaggcugcuacucucaggucaauccgcugacccucacagcggcuguguugaugcugguugcccacuaugcaauuaucgggcccggacuacaagccaaggcuacucgugaagcacagaagagaaccgccgcgggcauuaugaaaaacccaacaguggaugguaucguagcuauagaccuggacccuguggucuacgaugccaaguucgagaaacagcucgggcagauuaugcuucugaucuuguguaccagucaaauccugcucaugaggacuacgugggcacugugcgaaucgauuacauuagccaccggaccccuuacuacccugugggagggcagcccagguaaguuuuggaauacaacuaucgcuguuuccauggccaacauauuccgcggcucuuaucucgcaggggcuggacuagccuucucacugaugaaguccuugggcgggggacggcgaggcaccggugcgcagggggaaacacugggagagaaguggaagagacagcucaaucagcuuagcaaaagugaguuuaacacguacaagaggucuggcauuauggaaguggaccgcagcgaggccaaagaaggucugaagcggggcgagaccacuaaacaugcagucucaagagggacagcuaaguugcguugguucguggaaaggaaucugguaaagccugagggaaaagugaucgaucucggcugugggcggggaggcugguccuauuacugcgccgguuuaaagaaaguuaccgaggugaagggguauacuaaaggaggccccggccacgaggagccgauuccaauggcaacauacggguggaacaucgucaagcugcacaguggacgcgacguguuuuucaccccucccgaaaaaugugauacgcuucugugcgacauaggugagagcucuccaaaucccaccaucgaagagggccgaacacuaagaguccucaagaugguggagccuuggcugagggggaaccaauuuuguauuaagaucuugaauccguacaugcccuccguuguagaaacucuggagcagaugcagcggaaacauggaggcaugcucgugcgcaacccacuuucaagaaauagcacccacgaaauguauugggucucgugcgguacagggaacauugugucugcuguuaacaugacaaguaggaugcuguuaaaucgauucaccauggcccaucggaagccuacauacgagcgugauguggaccugggagccggcaccagacacgucgcgguggagcccgaaaucgcuaacuuggauauuaucggccagcgcauagagaauauuaaaaacgaacacaaguccacuuggcauuaugacgaggauaauccuuacaaaacgugggcauaucacgggagcuacgaaguaaagccaucaggauccgccucuagcauggugaacgguguugucaggcuccugacaaagcccugggacgugaucccuauggugacccaaaucgcuaugacugacaccacaccauuuggccagcagcgggucuucaaagagaagguugauacgagaacaccccgcccgaaaagggggacugcccaaauuauggaggugacagcaaaguggcuauggggauuucuuagucgaaauaaaaagccucggauauguaccagagaagaguucacuaggaagguacgcuccaacgccgcuaucggcgcgguguuugucgacgaaaaucaguggaacagcgccaaagaggcaguggaagaugagcguuucugggaccugguucaucgggagagagaacuccacaagcaggguaaaugcgcuacaugcguguauaauaugauggggaagagggagaaaaagcugggagaauuuggcaaggccaaaggcucucgcgcaauuugguacaugugguugggggcccgauuccuggaguucgaagcucucggauuuaugaacgaggaucauugguucucacgggagaauagucuuuccggugucgaaggcgaggggcugcacaaguuaggauacauccugagagacauuagcaaaaucccaggcgguaacauguaugccgaugacaccgcggggugggauacaaggauaacugaagacgauuugcagaaugaggcaaagaucaccgacauuauggagcccgaacacgcccuccuggcuacgucuaucuuuaaacuaaccuaccaaaacaaggugguacgcguucagagaccugccaaaucgggaacagugauggaugucauuucacggagggaccagcguggcagcggccagguggggacuuauggacuuaacaccuucacaaauauggaggugcaacugauccgacagauggaauccgaggguauauuuaguccaucugaacucgagaacagcaaucuggcagagcgcgucuuggacugguuagaaaagcauggcguugagagacugaagcggauggcuauuuccggggaugacugugugguaaaacccacugaugacagguucgccaccgcucucacggcccuuaacgauaugggaaaggugcgcaaagacaucccgcagugggaaccuucaaagggcuggaaugauuggcagcugguccccuuuugcagucaccauuuccaccaacuaaucaugaaagacgguagagagauugugguuccaugucggaaccaggaugaacugguggggagggcacgagucucucagggagcgggcuggagccuccgugagacagccugcuugggcaaguccuacgcucagauguggcaacugauguauuuucacagacgcgaccuucggcuggccgcaaaugcuauauguucagccgugccuguaaacuggguucccaccagcaggacuacauggucuauccaugcacaccaucaguggaugaccacugaggauaugcucuccguguggaauagagucuggauugaagagaacccauggauggaagacaagacccacgugaguagcugggaggacguucccuacuuagggaaacgcgaagaucaguggugcggaucgcugaucgguuugacagcccgggcgacgugggcuaccaauauucaaguggccaucaaccaggucaggcgacugauaggcaaugagaacuaucucgacuacaugacuuccaugaagagauucaaaaaugagucugauccugaaggggcacuuugguga

SEQ ID NO: 14231 - RNA, 9879 nt, Artificial Sequence
  derived and/or modified CDS sequence (opt3) from DENV-1__KR024707__SS-prME
agcgugaccaugcugcucaugcuucugcccacagcauuggcuuuccacuuaacuacgagaggaggggaaccucauaugaucgucuccaagcaagaaaggggaaaaucucuguuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguugacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaaacuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggcaagaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaaacuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguauuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacaagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcagaagaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagaacgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacuaagaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacguuuauaugggucaaccccuaaacaaugacgaagaucacgcucauuggacagaggccaaaaugcuguuggacaacaucaauacuccagaggggauuauacccgcauuauuugaaccugagcgcgaaaagucggccgcuaucgauggcgaguacagacugaggggagaagcccggaagaccuucgucgagcucaugcgucgcggcgaccugccaguguggcuuucuuauaaaguggcguccgagggguuucaguacagcgaucgaagauggugcuucgacggagaaaggaacaaucagguccuggaggaaaacauggacguugagauuuggacaaaggaaggugagcggaaaaagcuccgccccagaugguuggaugcaaggaccuauucagacccucuggcccuacgggaguuuaaagaguucgcugccggccgaagaagugugucuggggaucugauccucgagaucggaaaacuuccgcagcaccugacuuuacgcgcucaaaaugcauuggacaaccugguaaugcuccacaauuccgaacagggcgguaaagccuacaggcaugcuauggaggaacugccagauacgauugagacccuuaugcugcucacauugauagccgugcugacugggggcgucaccuuauuuuuccuaagcggaaagggccuggggaagacaucaaucggacuccuuugugugauggcaaguagcguucuguuguggauggcguccguggagccccacuggauugccgcuucuaucauucuggaauuuuuccucaugguccugcuuaucccugagcccgaccggcagcguaccccacaggauaaccaacucgccuauguagugauaggucuguuguuuaugauccugacuguugcagcuaacgaaaugggcuuacuagagacaacgaaaaaggaccuggggauuggacauguggucgccgagaaucaccaccaugcaaccaugcucgauaucgaccuucacccugccagcgcuuggacucuguacgcgguggccacaaccauuaucacccccaugaugagacauacaauagaaaacacuacggcaaauauuuccuugaccgcuaucgccaaccaggccgcaauucugaugggccucgauaaagguuggccaaucucaaagauggacauaggggucccucugcuugcuuuaggcugcuacucucaggugaauccgcugacacucacugccgcgguuuugaugcugguggcucacuaugccaucauuggacccggccuacaagcaaaagccaccagggaggcucagaagcgcacagcagccgggaucaugaagaacccaaccguagauggaauuguggcgaucgaccuggacccugucguuuacgaugcuaaauucgaaaagcagcucggccagauaaugcuucugauuuuguguacgagucaaauccugcucaugcggacuacaugggcccugugcgagucgaucaccuuagcaacugguccccuuaccacacugugggaagggagcccaggaaaauuuuggaauacuaccauugccguguccauggcuaacaucuuccgaggcucuuaucucgccggugcaggccuagcuuucucacugaugaaaagccuagggggaggcagaagggggacaggagcccagggcgagacgcugggugagaaauggaagcgccagcucaaucagcuuuccaagagugaauuuaacaccuacaaacggucugggauaauggaggucgacagaagcgaagcgaaggagggacugaaacguggcgaaacuacaaagcaugccgugucaagggguaccgcaaaauugcggugguucguagagcgcaaucuggugaagccugagggcaagguuauugaucucggguguggacgaggcgggugguccuauuacugcgcuggacuaaagaaggugacugaagucaaaggcuauacaaagggugggcccggacacgaggaaccgaucccaauggccaccuacggcuggaacauugugaaacugcacaguggcagagacgucuuuuucacgccucccgagaagugugauacccuucugugcgacaucggggaaagcucuccaaaucccacaauagaggagggaaggacucuacgggugcucaaaaugguugaaccuuggcugcgcgguaaccaauuuuguaucaagauuuugaauccguacaugcccuccguaguggagacccuggaacagaugcagagaaagcauggcgggaugcucgucaggaacccacuuucacgaaauagcacacacgagauguauugggugucgugcggaacuggcaacaucguuucugcagugaacaugaccagucggaugcuguuaaaucguuucacaauggcucauagaaaaccuaccuacgagcgcgaugucgaccugggugccgggacuaggcacguggccguagaacccgagauugcgaacuuggauaucauuggacagcggaucgaaaauauaaagaacgagcacaaauccacguggcauuaugacgaagauaauccuuacaagacaugggcuuaucacggcagcuacgaggugaaaccaucaggcuccgcaucuagcaugguuaacggggucgugagacuccugaccaagcccugggacgugauuccuauggucacucaaaucgccaugaccgacacaacgccauuuggacagcagcgcguuuucaaggagaaaguggauaccaggacuccccgaccgaagcgggguacagcucaaaucauggaaguaaccgccaaauggcuauggggcuuucuuaguagaaauaagaaaccuaggauuuguacucgcgaggaguucacacguaaggugcgguccaacgcagccauaggggcugucuuuguggacgagaaucaguggaacagcgcgaaggaagccguugaggaugagagauucugggaccuggugcauagggaacgcgagcuccacaaacagggaaagugcgcaaccugcgucuauaauaugaugggcaaacgagaaaagaaacugggugaguuugggaaggcuaagggaucucgggccaucugguacaugugguugggcgcaagauuccuggaguucgaggcccucggcuuuaugaacgaggaucauugguucucaagggaaaauagucuuuccgggguggagggagaaggucugcacaaauuaggcuacauucugcgcgacaucagcaagauuccagggggaaacauguaugcugaugacacagccggcugggauacuagaaucaccgaggacgauuugcagaaugaggcgaaaauaacggacaucauggaacccgagcacgcacuccuggccaccucuauuuuuaagcuaacauaccaaaacaaaguaguucgggugcagaggccugcuaagucggguacugucauggaugugaucucacgucgagaccagcgcgggagcggacaggugggcaccuauggccuuaacacauucacuaauauggaaguccaacugauuagacagauggaguccgaagggaucuuuaguccaucugagcucgagaacagcaaucuggccgaacggguuuuggacugguuagagaaacauggaguggaaaggcugaagcgcauggcaauauccggugaugacuguguagugaagcccaccgaugacagauucgcuacggcccucacagcucuuaacgauaugggcaaaguccggaaggacauuccgcagugggagccuucaaaaggguggaaugauuggcagcaagugcccuuuugcagucaccauuuccaccagcugaucaugaaggacggaagggaaaucguugugccaugucgaaaccaggaugagcuagucggccgugccagagugucucagggugcaggguggagccugcgcgagaccgcgugccucggaaaauccuacgcccaaauguggcaguugauguauuuucaccggagggaccugagacuugcugccaaugcaauuuguucagcuguaccuguuaacugggugcccacuagccgcacaaccuggucuauacaugcccaccaucaguggaugacuaccgaagauaugcuguccgucuggaaucggguguggaucgaggaaaacccauggauggaggacaagacacacguuaguagcugggaagacgugcccuaccucggcaagagggaggaucaauggugcggcucguuaauugggcugacggcacgagccaccugggcgacuaauauccaggucgcuauuaaccaggugagacgguugaucggaaaugagaacuaucuggacuacaugacauccaugaaaagguucaagaaugaaucugauccugagggugcccucugguga

SEQ ID NO: 14232 - RNA, 9879 nt, Artificial Sequence
  derived and/or modified CDS sequence (opt3) from DENV-1__KC172829__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggaaccuucaaacuggagaaggaagucgcugagacgcagcacgguacagugcuuguucagauaaaguacgagggcaccgacgcgccuugcaaaaucccauucagcacucaagaugaaaagggggugacacagaacggacgcuugauuaccgcaaaucccaucguaacugacaaagagaagccugucaacauagaagccgagccacccuuuggcgagucguauauugugaucggugcuggggaaaaagcccugaagcucucuugguucaagaaaggcuccucaaucggaaagauguuugaggcaaccgccagaggcgcuaggcggauggccauucugggggauacagcaugggacuucggaaguaucgguggcguuuuuacgagcguggggaaacuuguccaucagauuuucggaaccgcguacggcgugcuguuuuccgguguaucuuggacuaugaagauagggaucggcguguugcucacauggcugggauuaaauagccgaucaaccagucuguccaugacauguauugcuguuggccuagucacucucuaccugggggugauggugcaggccgauagcggaugcgucguuaacuggaaaggccgcgaacuuaagugugguucugggaucuucgugaccaaugaggugcacacguggacagaacaauauaaguuucaggcagacucaccgaaaagauugagugccgcuaucggaaaggccugggaggagggcguaugcgguauuaggagcgcaacccggcuggaaaacauaauguggaaacagaucuccaacgagcucaaucauauucuguuagaaaacgacaugaaguucacugucgugguuggcgauguggcugggauccuggcccagggcaagaagaugauucgcccucaacccauggaguacaaauauucuuggaagucguggggcaaggcgaaaaucauaggggccgacguccagaauaccacauuuaucauugauggaccaaacacuccugaaugucccgacgaucagagagcuuggaauaucugggagguggaggacuacggcuucgguauuuuuaccacaaacaucuggcuuagguugcgugauagcuauacgcagguuugcgaccaccggcucauguccgcagccauaaaggauucaaaagcugugcacgccgacaugggguacuggauugaaagugagaagaaugaaaccuggaaacuggcacgagcgucuuucaucgagguaaagacuuguauuuggccaaagagccauacacuaugguccaacggaguccuggaaucagagaugaucauacccaaaaucuauggcgguccuauuagccaacacaauuacagaccaggcuacuucacccagacugccgggccguggcaucucggaaagcuggagcuugauuuugacuugugcgaaggcacaaccgugguggucgaugagcacugcgggaacaggggacccucucugcgcacgacuaccguuacaggcaaaaucauucacgaaugguguugccgguccuguaccuuaccuccacucagauucaggggugaggacgggugcugguauggaauggagauccgccccgugaaggaaaaagaggaaaaucugguaaagaguauggugagcgcuggcucuggugaggucgacuccuuuucacuuggccuguuguguauaaguauuaugaucgaagaggugaugcgaagccgguggucgcguaagaugcucaugacugggacacuggccguuuucuuucuacugaucauuggacagcucaccuggaacgaucugaucagacuuuccauuauggugggcgcaaaugcuucugacaaaauggggaugggaacaacuuacuuggcccugauggcaaccuucaagaugaggccuauguuugccgucggcuuacucuuccgccggcugacgagcagagaggugcuucugcuaacaauaggucucucacugguugcuaguguggaauugccaaacucccuggaggaauuaggggauggacucgcgaugggcaucaugauucugaaacuucugaccgacuuucaaucucaucaguugugggccacucuccugagccuaaccuucaucaagacaacuuuuucccugcacuaugcauggaaaaccauggcuaugguccuuucaauuguaagccucuucccccugugcuugaguacgacaucucagaagaccacuuggcugccgguguuacucggcucccugggguguaagccucuuacaauguuucugaucaccgagaauaaaauauggggaagaaagagcuggccauugaacgaagguaucauggccguuggcauugugucgauccuccugucaucucuacugaaaaacgaugucccccuugccgggccucucauugcuggaggcaugcugaucgcaugcuacgugauaagugguuccagcgccgacuugucuuuagagaaggcggcugagguaagcugggaagaggaagccgagcauuccggggcaucacacaauauucugguggaaguccaggaugacggaacuaugaaaaucaaggaugaggagcgagacgauacacucaccauccugcuuaaagccacgcuguuggcuguuaguggcguguauccccuaagcauuccagcaacucuguucgugugguacuucuggcaaaagaagaaacagcgcucuggcguccucugggacaccccuucacccccagaaguggagcgggccguucuggaugacgggauauauagaaucaugcagaggggacuuuuaggucguagccagguaggcgugggggucuuucaagaaaacguguuccauacaauguggcacguuacccgcggagcggugcugauguaccagggcaagcggcucgagccgaguugggcuagcgucaaaaaggacuugauuuccuacggugggggauggagacugcagggcucuuggaauacaggcgaggaagugcagguaaucgccgucgagccugggaaaaaccccaagaaugugcaaacugcaccaggaaccuuuaagacgacagaaggugagguuggcgccauugcucucgauuucaaacccgggacuucgggaagcccuaucgugaacagggaaggcaagauagucggucuguaugggaauggagugguuaccacaucaggcaccuacguguccgccaucgcacaggcuaaagccagucaggagggcccacuucccgagauugaagacgaggucuuucgaaagcggaaccugacuaucauggauuugcacccugggucuggaaaaacccgcagauaucuaccggcgauugugagggaagccaucaagcggaagcugcgaacacucauauuagcaccaacgagaguaguggcuagcgagauggccgaagcucugaaagguaugcccauucgcuaccaaacuaccgcaguuaaguccgagcauacaggcaaagagaucgucgaccuuaugugucacgccaccuucacuaugaggcugcucucaccugugcgugugccaaauuauaacaugaucauuauggaugaagcccauuuuacagaccccucuagcaucgcugcgcggggguacauaaguaccagagucggaaugggcgaggcagccgcuauuuucaugacggccacuccuccggguuccguagaagcauuuccccagagcaaugccgugauccaggaugaggaaagggacauuccagagcgcucuuggaacucaggguaugaguggaucacagauuucuccggaaagaccguuugguuugugccuaguauaaaaagcggcaaugacauugcuaacugcuugcgaaagaauggcaagagagucauccagcugucgcggaaaaccuucgauacugaauaccaaaagaccaaaaacaacgacugggacuacgugguuaccacagauaucucugagaugggggcgaauuucagggccgaccgcgugauugauccccguagaugucucaagccagucauccugaaagacggaccugaacgggugauucuugcaggucccaugccaguaacuguggcuuccgccgcacagaggcgcggccgaauagggagaaaccacaauaaggagggagaucaguauaucuacaugggccagccgcuaaacaaugacgaggaucaugcccacuggacggaagcuaagaugcuguuggacaacauuaauaccccugaggguaucauccccgccuuauuugaaccagagcgggagaaauccgcggcaauugauggggaguauaggcugcgcggcgaggccagaaagacauucguugaacucaugaggcggggagaccugcccgucuggcuuucauacaaaguggcuagugagggcuuucaauauucugaucgucgcuggugcuucgacggggaacgaaacaaucaggugcuggaggaaaacauggaugucgagauauggacuaaggagggagaaaggaaaaagcucaggccucggugguuggacgcccgcaccuacuccgacccacuggcucuaagagaguuuaaagaguucgcagccgguaggcggagcguuucaggcgaucugauccucgagauugggaaacuuccccagcaccugacacagcgagcucaaaaugccuuagacaacuuggugaugcugcauaauagugaacagggaggcagagcauaucgccacgcgauggaggagcucccugauaccaucgaaacucugaugcuucuggcccucauugcuguauugacggguggggugacccuguuuuucuuaagcggcaggggacuaggcaagacauccaucgggcugcucugcgucauggccucuagcgugcuucuguggauggcauccguugagccgcauuggauagcugccucaaucauuuuggaauuuuuccugauggugcuccugaucccagagcccgaccggcagcguacuccucaggauaaccaacuugcauacgucguaauuggacuccuguuuaugaucuugaccguggccgcuaaugagaugggucuguuagaaacaaccaaaaaggaccuaggcauagggcacguugcggaugagaaccaccaucacgccgcaaugcuggacguggaucuccaucccgcuucugccuggacucuuuacgccgucgcaacaacgauuaucaccccaaugaugagacacacuauugaaaacacaaccgcuaauaucagucugaccgccauagcgaaccaggcugccaucuugaugggacuggacaaaggcuggccuauuucgaagauggauaucggugugccccuccuggcacuuggguguuauagccaggucaauccauuaacacugacugccgcugugcucauguugguugcacauuacgccauuaucggcccuggacugcaagcgaaagcuacgagggaggcccagaagcgcaccgcagccggcauaaugaagaacccgacaguggacgggauuguagcuaucgaucuagaccccguggucuaugacgccaaauucgaaaagcagcugggacagaucaugcuccuuauucugugcacuucccaaaucuugcugaugcggaccacaugggcacucugugagucuauaacccuggcuacuggcccauuaacgacacuuugggaggguucaccugggaaauuuuggaauaccacuauugccguuagcauggcgaacaucuuccgaggauccuaccuggccggcgcaggucucgcuuucagucuaaugaagucucugggcgggggaagaaggggcaccggggcccagggagaaacauugggcgagaaauggaagcgccagcugaaucagcucagcaagucagaauuuaacacuuauaaacgguccgguauuauggagguggauagaagugaagcaaaggaggggcuuaaacguggagagaccacaaagcacgcugucagcaggggcacggccaaacugcggugguucguggaacgcaauuugguaaagcccgaggguaaggugaucgaccugggcugcgggcgaggaggcuggucuuacuauugugccgggcucaaaaagguuaccgaagugaaaggauacacuaagggcgguccagggcacgaggaaccuauacccauggcgacauacggauggaacuuagucaaacugcauuccggcaaggauguguuuuucaucccgccagagaaaugcgacacccuucugugugauauuggcgagucaagcccuaaucccacuaucgaagaggggagaacacuaaggguccucaagaugguggaaccauggcugcggggaaaccaauuuugcauuaagaucuugaaucccuauaugccuucgguuguagagacccuggagcagaugcagcgcaaacacgguggcaugcucgugagaaacccgcuuucuaggaauaguacgcaugaaauguacugggucuccugugggaccggaaacauugugagcgcuguuaauaugacaucacgaaugcuguuaaaccgguucacuauggugcaccguaagcccaccuaugagagagacgucgaucugggcgcagguacacgccacguggccguagaaccagagguggcuaacuuggacaucauagggcagaggauugaaaauaucaaacaugagcacaaguccacuuggcauuacgaugaggacaacccuuauaaaaccugggccuaccacggaucuuaugaaguuaagcccagcggcagugcauccagcauggucaauggcguggugaagcuccugacaaaaccuugggaugucaucccaaugguuacccaaauugccaugacugacacgacacccuuugggcagcagcggguguucaaggagaaaguagacaccagaacuccuaaggcuaaacgcggaaccgcgcaaauaauggaagugacagccagguggcuaugggguuuucuuucucgaaacaagaagccacggaucugcacgagagaggaguucaccaggaaaguccgcucaaaugcagcuauuggcgccguguuuguugaugagaaccaguggaauagugcaaaggaggccguggaagacgagcguuucugggaucugguccaucgggaaagagagcuccacaaacaggggaagugugcuacuugcguguacaacaugaugggaaaaagggaaaagaagcugggcgaguuugguaaagccaaggggucccgcgcgaucugguacaugugguugggagcacgauuccuggaguucgaagcccucggcuuuaugaaugaggaccacugguucagccgggaaaacucucuuucgggcguagagggggagggacugcauaaauuagguuauauucugagagauaucucaaagauacccggcgggaauauguacgcugacgauacagccggaugggacaccaggaucacugaagaugacuugcagaacgaggcaaaaauuacagauaucauggaaagcgagcacgcucuccuggccaaguccauuuuuaaacuaaccuaucaaaauaagguugugcgcguccagagaccggcuaagaacggcacagugauggacgugaucagucggagggaucagcgugguucugggcaggucggaacuuacggccuuaauaccuucacgaacauggaagcccaacugauacgacagauggagagcgagggcauauuuuccccuucagaacucgagaccccaaaccuggcagaacgcgcguuggacugguuagagaaacaugggguugaaagacugaagcggauggccaucaguggagacgauugcgugguaaaacccaucgacgauagguucgcuacagcccucacugcacuuaaugacauggguaaggugcgcaaagauauuccucagugggagccaucuaagggcuggaacgacuggcagcaaguccccuuuuguagccaccacuuccaucagcugauaaugaaggaugggagagagaucgugguuccgugccggaaucaggacgagcuagugggaagggcucgagucucccagggcgccgguuggucacugcgugagaccgcaugucucgggaaaagcuaugcccaaauguggcaguugauguacuuucacagacgcgaucugcggcuugcggcuaacgccauuugcucugcagugccuguagacuggguucccacauccaggacuaccuggaguauccaugcccaccaucaguggaugacgacagaagauaugcugagcguguggaauagagucuggauugaggaaaacccauggauggaggacaagacccacaucucguccugggaggacgugccuuaucucggaaaacgcgaagaucaaugguguggcucuuuaauaggccugacugcucgggccacaugggcaaccaauauccagguugcuauuucacaggugaggcgauugaucgggaacgagaauuaccuggacuacaugacuagcaugaagagauucaaaaacgaaagugaucccgagggagcccucugguga

SEQ ID NO: 14233 - RNA, 9879 nt, Artificial Sequence
  derived and/or modified CDS sequence (opt3) from DENV-1__EU359008__SS-prME
agcgugaccaugcugcucaugcuuaugcccacggcacuggcuuuccacuugacuacgagaggcggggaaccucauaugaucgucuccaagcaggaaagagggaaaucuuuacuguuuaagaccucagccgguguuaacaugugcacauuaauugccauggaccucggcgagcugugugaagauacucuuaccuacaaaugcccacggauaacagaggcggaaccggacgauguggacuguuggugcaaugcuaccgauacuuggguaacauaugggaccuguagccaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaagcagagauuuuguggaggguuugaguggcgcgacuuggguagacguugugcuggagcacggguccugugucacaaccauggcaaaggauaaacccacucuagacaucgaacuccugaagacagaggugaccaacccugccgugcuuaggaaacugugcauugaagcuaagaucucuaauacgaccacagauagccgguguccaacucaaggagaggccaccuuggucgaagaacaggacgcaaacuucguuugccgccgaacauuuguggauagaggcugggguaauggguguggacucuucggcaaaggcucccugauaacuugcgcuaaguuuaagugcguaaccaaauuagaggggaagauugugcaguacgaaaaccugaaauauucagucaucgugacaguucacaccggagaccagcaucaaguggguaaugagaguacugaacacggcacgacagccaccauuacuccccaggcgccuaccacagagauccagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuacacaagagaccuggaaucggcaggacuugcucguaacauucaaaacugcucacgccaagaagcaggaaguugugguccuggguagccaagagggggcuaugcacaccgccuuaacgggcgcaaccgaaauccagacaaguggaacuaccacaauuuuugccggccaucugaaaugccgucuaaagauggauaaacucacucugaaggggaugucuuaugugauguguaccggauccuucaaacuugagaaggaagucgcugagacgcagcacgguacaguguugguucagauaaaguacgagggcaccgacgcgccuugcaaaaucccauuccugacucaagaugaaaagggggugacacagaacggacgccucauuaccgcaaaucccaucguaacugacaaagagaagccugucaacauagaagccgagccacccuuuggcgagagcuauauugugaucggugcuggggaaaaagcccugaaacuuucgugguucaagaaaggaucuuccaucggaaagauguuugaggcaaccgccagaggcgcuaggcggauggccauucugggggauacagcaugggacuucggaucaaucgguggcguuuuuacgaguguggggaaauugguccaucagauuuucggaaccgcguacggcgugcucuuuagcgguguauccuggacuaugaagauagggaucggcgcucuguuaacauggcugggacuaaauucucgaagcaccucacucaguaugacauguauugccgugggccugguuacucuuuacuugggggucauggugcaggcagauuccggaugcgugaucaacuggaaaggccgcgaacugaagugugguagcgggaucuucgucaccaaugagguucacacguggacagaacaauauaaguuucaggccgacucuccgaaaagacucucagcugccauuggaaaggcaugggaggagggcgugugcgguauaaggagugcuacccggcuggaaaacaucauguggaaacagauuagcaacgaguuaaaucauauccugcuugaaaacgacaugaaguucacugugguagucggcgauguggccgggauuuuggcgcagggcaagaagaugauccgcccucaacccauggagcacaaauacuccuggaagucuuggggcaaggccaaaauaaucggggcugacguucagaauaccacauuuauuaucgauggaccaaacacuccugaaugucccgacgaucagagagcauggaauauuugggagguggaggacuauggcuucgguaucuuuaccacaaacauauggcucaagcugagggauucguacacgcaggucugcgaccaccgucuaaugagcgccgcuauuaaagauuccaaggccgugcaugcagacaugggguauuggaucgaaucagagaaaaaugaaaccuggaagcuggcgcgggccaguuucauugagguuaagacuuguaucuggccaaaaucucacacacucuggagcaacggagugcuggaauccgagaugauaauccccaagauuuacggcgguccuaucucacaacauaauuaucgaccaggcuacuucacccagacugcugggccguggcaccuuggaaaauuggagcuggauuuugacuuaugcgaaggcacaaccguagucguggaugagcacugcgggaacagaggacccagccucaggacgacuaccgugacaggcaagauuauccaugaaugguguugccgcucuuguacccugccuccacuucgguucagaggugaggacgggugcugguacggaauggagauaaggcccgucaaagaaaaggaggaaaaucugguuaaguccauggugagugccggcagcggugagguagacucuuuuuccuugggccuccuguguauuucaaucaugaucgaagaggugaugcgcagucgauggagccggaaaaugcuaaugacugggacacuggcagucuucuuucuccugauuaugggacaggugaccuggaacgaucuuauccguuugugcauuaugguuggcgcuaaugccucggacagaauggggaugggaacaacuuaucuggcauuaauggccaccuucaagaugaggccuauguuugcugugggccuccuguuccgccggcuuacguccagagagguccugcuacucacaauaggucugucuuugguggcgagcguugaacugccaaacucauuagaggaacucggggauggacuggccaugggcaucaugauucuuaaacuguugaccgacuuucaaagucaccagcucugggcaacucugcuaucccugaccuucaucaagacaacuuuuucucuucauuacgcuuggaaaaccauggccauggugcucagcauugucucccuguuccccuugugucugucaacgacaagccagaagaccacuugguuaccgguacuccugggcagucuugggugcaagccucugacaauguuuuugaucgccgagaauaaaauauggggaaggaagucuuggccacucaacgaagguaucauggcugugggcauuguuuccauccugcuaagcucgcugcuuaaaaacgaugugccccucgcagggccucugauugccggaggcauguugaucgcguguuaugucauaucagguucuagugcugacuuaucccuggagaaggccgcagaggugagcugggaagaggaagccgagcacucuggggcuagccauaauauucucguagaagugcaggaugacggaaccaugaaaaucaaggaugaggagcgagacgauacucugacaauccuucugaaagcaaccuugcuagccgucuccggcguuuacccccugucaauuccagcgacacucuucgugugguauuucuggcaaaagaagaaacagcgcaguggcgugcugugggacacuccuagucccccagaagucgagcgggcugugcuugaugacgggauauacagaaucaugcagaggggauuacugggucguucucagguuggcguagggguguuucaagaaaacgucuuccacaccauguggcacgugacacgcggagccguucucauguaucagggcaagcgguuggagccguccugggcaucagugaaaaaggaccugauuaguuacggugggggauggagacuccagggcagcuggaauaccggcgaggaaguccaggugaucgccguagagccugggaaaaaccccaagaauguccaaacagcuccaggaacuuuuaagacccccgaaggugaggugggcgccauugcacuggauuucaaaccugggacguccggaucuccaaucguuaacagggaaggcaagauagugggucuuuacgggaauggagucgugacaacuucgggcaccuauguuagcgcuaucgcccaggcgaaagccucacaggagggcccccugccugagauugaagacgagguguuucgaaagcggaacuugacaaucauggaucuacauccgggguccggaaaaacccgcagauaccugccagcaauugucagggaagcuaucaagcggaagcuccgaacuuuaauacuggcccccaccagagugguagcuagugagauggcagaagcccuuaaagguaugccuauucgcuaucaaacaacggccgugaagucugagcacacuggcaaagagaucguugaccugaugugccaugcuaccuucacaaugaggcucuugagcccaguccgugugcccaauuacaacaugaucauuauggaugaagcgcacuuuaccgacccuuccucaaucgcagcccggggguauauaucuacuagagugggaaugggcgaggcugccgcaauuuucaugacagccaccccgcccgguagcgucgaggcuuuuccacagaguaaugcggccauccaggaugaagaaagggacauuccugagcgcuccuggaacagcggguacgaguggaucacggauuuccccggaaagacuguaugguuugugccaucuauaaaaucaggcaaugacauugcaaacugucugcgaaagaauggcaagagaguuauccagcucucccggaaaacauucgauaccgaauaucaaaagaccaaaaacaacgacugggacuacguggucacuacagauaucagugagaugggggcuaauuucagggccgaccgcgugauugauccucguagaugccugaagcccguuauccuuaaagacggaccagaacgggugauucuagcagguccgaugccugucaccguggccagcgcugcccagaggcgcggccgaauagggagaaaccauaauaaggagggagaucaguacaucuauaugggccagccccugaacaaugacgaggaucacgcgcacuggacagaagcaaagauguuguuagacaacauuaauacuccagaggguaucauccccgcccuguuugaaccugagcgggaaaaaucggcugccauugauggggaguacaggcuccgcggcgaggcuagaaagacguucguagaacugaugaggcggggagaccuuccaguguggcugucuuauaaaguugcauccgagggcuuucaauacagcgaucgucgcuggugcuucgacggggaacgaaacaaucagguccucgaggaaaacauggauguggagauauggaccaaggagggagaaaggaagaaguugaggccccgguggcuggacgcccgcacauauucagacccucuagcucugagagaguuuaaagaguucgccgcagguaggcggagugugucuggcgaucucauccuugagauugggaagcugccgcagcauuuaacucagcgagcgcaaaaugccuuggacaaccuggucaugcuccacaauuccgaacagggaggcagagcuuaccgccaugccauggaggagcugccagauaccaucgaaacacuuaugcugcucgcauugauugcuguucugaccgguggggugacuuuauuuuuccuaagcggcaggggacugggcaagacgucaaucgggcuccuuuguguaauggccaguagcgugcuguuguggauggcauccgucgagccccacuggauagccgcuucuaucauucuggaauuuuuccucauggugcugcuuaucccugagcccgaccggcagcguaccccacaggauaaccaacucgcguauguugugauuggacuguuguuuaugauccugacagucgccgcaaaugagauggguuuacuagaaacuaccaaaaaggaccugggcauagggcacguagcuguggagaaccaucaccaugccgccaugcucgauguugaccuucacccugcaagcgcuuggacacuguacgccguggcgaccacuauuaucacacccaugaugagacauacgauugaaaacaccacugcuaauaucuccuugacagccauagcaaaccaggccgcuauccugaugggacucgauaaaggcuggccaauuucaaagauggacaucggugucccucugcuugcauuagggugcuacucucaggugaauccgcugacccucaccgccgcggucuugaugcugguggcucacuaugccauuaucggccccggacuacaagcaaaagccacaagggaggcucagaagcgcacugccgcaggcauaaugaagaacccaacgguugaugggauuguggcuaucgaccuggauccuguaguguacgacgccaaauucgaaaagcagcucggacagaucaugcuucugauuuuguguaccagucaaauccugcucaugcggacaacuugggcgcugugcgagucgauaaccuuagccacaggcccccuuaccacucugugggaggguagcccagggaaauuuuggaauacgacaauugcagucuccauggcuaacaucuuccgaggaucuuaucucgccggcgcaggucuagcuuucucacugaugaaaagccuaggcgggggaagaaggggcaccggggcccagggagaaacucugggcgagaaauggaagcgccagcucaaucagcuuuccaagagugaauuuaacaccuacaaacggucugguauuauggagguugacagaagcgaagccaaggaggggcugaaacguggagagacaacuaagcacgcggugucaaggggcaccgcuaaauugcggugguucgucgaacgcaaucuggugaagccugaggguaagguaaucgaucucggcugugggcgaggaggcugguccuauuacugcgcaggguugaaaaaggugacagaaguuaaaggauauacgaagggcggucccgggcaugaggaaccgauaccaauggccaccuacggauggaaccuggugaaacuucacaguggcaaggacgucuuuuucaucccucccgagaaaugugauacucugcuaugcgacauuggcgagagcucuccaaaucccacaaucgaagaggggagaacccucagggugcugaagauggucgaaccuugguugcggggaaaccaauuuuguauuaagauccugaauccguacaugcccuccgugguugagacucucgagcagaugcagcgcaaacaugguggcaugcuuguaagaaacccacugucaaggaauagcacacacgaaauguauugggugucgugcgggaccggaaacauugucucugcugugaauaugacgagucgaauguuacugaaccgguucaccauggcccaccguaagccuacauacgagagagauguugacuugggcgcagguacucgccauguggccgucgaacccgagguggcuaaccucgauaucauagggcagaggauugaaaauaucaaacacgagcauaaguccaccuggcacuaugacgaggauaacccuuacaaaacaugggcguaucauggaagcuacgaaguaaagccaucaggcuccgccucuagcauggugaauggcguugucaagcugcuaacuaaacccugggacgugaucccuauggugacccaaauugcaaugacagauaccacuccauuugggcagcagcgggucuucaaggagaaaguugacacgagaacacccaaggcuaaacgcggaaccgcccaaauaauggaagugacugcaagguggcuuugggguuuucugagucgaaacaagaagccgcggaucuguaccagagaggaguucacaaggaaaguacgcuccaaugccgcuauuggcgccguguuugucgacgagaaccaguggaauagcgcgaaggaggcaguggaagaugagcguuucugggaccucguucaccgggaaagagagcugcacaaacaggggaagugcgccacgugcguguauaacaugaugggaaaaagggaaaagaaguugggcgaguuugguaaagcuaaggggucucgcgccaucugguacauguggcugggagcacgauuccucgaguucgaagcucuuggcuuuaugaaugaggaucauugguucucacgggaaaacagucuguccggcgucgagggggagggauuacacaaacuggguuacauuuugagagacaucagcaagauaccuggcgggaauauguaugccgaugacaccgcuggaugggauacuaggaucacagaagacgaucuccagaacgaggccaaaauuaccgacaucauggaaccagagcaugcacugcuagcgaaggccauuuuuaaacuuacuuaccaaaauaaggugguacgcguucagagacccgcuaagaacggcacagugauggaugucaucucucggagggaccagcgugguucgggacaggugggaaccuauggccugaauacauucacuaacauggaagcccaacucauacgacagauggagucagagggcauuuuuagcccuuccgaacuggagaccccaaacuuggcagaacgcguguuagauuggcuggagaaauacggggucgaaagacucaagcggauggcuaucaguggagacgacuguguugugaaacccaucgaugacagguucgccacggcacuuaccgcccugaaugauauggguaagguacgcaaagacauuccgcagugggagccuucuaagggcuggaacgauuggcagcaagugcccuuuugcagccaccacuuccaucagcuaauaaugaaggacgggagagagaucgucgugccaugucggaaucaggaugaacugguuggaagggcgcgagugucccagggcgcugguuggucacuccgugagacagccugcuuggggaaaaguuaugcacaaauguggcagcugauguacuuucacagacgcgaccuucggcuggccgcuaacgccauuuguucugcagucccuguggauuggguacccacuagcaggaccacaugguccauccaugcucaccaucaguggaugacuaccgaagacaugcucucaguuuggaauagaguguggauugaggaaaacccauggauggaggauaagacgcacaucagcucuugggaggacguccccuauuuaggaaaacgcgaagaccaauggugcggcucccugauaggcuugacagcccgggcgaccugggcuacuaauauccagguggccauuaaccagguuaggcgacugaucgggaaugagaacuaccucgauuacaugacaaguaugaagagauucaaaaaugaaagcgacccugagggagcacuuugguga

SEQ ID NO: 14234 - RNA, 9879 nt, Artificial Sequence
  derived and/or modified CDS sequence (opt3) from DENV-1__AY835999__SS-prME
agcgugaccaugcugcucaugcuuaugcccacagcccuggcuuuccacuugacuacgagaggaggggagccucauaugaucgucuccaagcaggaaaggggaaaaucuuuacuguuuaagaccucagccgguguuaacaugugcacacuaauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacugguagcuucaaacuugagaaggaagucgcugagacccagcacgguacgguguugguucagauuaaguacgagggcacagacgcgccuugcaaaauaccauuccugacccaagaugaaaagggggugacucagaacggacgccucaucacagcaaaucccauuguaaccgacaaagagaagccugucaacaucgaagccgagccacccuuuggcgagucguauauagugauuggugcuggggaaaaagcccugaaacuuucuugguucaagaaaggcuccucaaucggaaagauguuugaggcaacugccagaggcgcuaggcggauggccauccugggggauaccgcaugggacuucggaaguguugguggcguguuuacaagcgucgggaaauuggugcaucagauuuucggaacggcguacggcguacucuuuuccggugugucuuggaccaugaagcuggggaucggcguuuuacugacuuggcuaggacucaauagccgaucaacaagucuguccaugaccuguauugcugucggccuugugacauuguaccugggggugaugguccaggccgauagcggaugcguuauaaacuggaaaggccgcgaacucaagugugguucugggaucuucgugacuaaugaggugcacaccuggacggaacaauauaaguuucaggcagacucaccgaaaagacugagugccgcuauuggaaaggccugggaggagggcguaugcgguaucaggagcgcaacacgguuagaaaacaucauguggaaacagauuuccaacgagcugaaucauauacuuuuggaaaacgacaugaaguucaccgucgugguuggcgauguggcugggauccucguccagggcaagaagaugauucgcccucaacccauggaguacaaauauucuuggaagucguggggcaaggccaaaaucauuggggcggacgugcagaauagcacuuuuaucauagauggaccaaacaccccugaaugucccgacgaucagagagccuggaauaucugggagguugaggacuacggcuucgguauuuuuacaacuaacaucuggcugaagcuaagggauuccuauacccaggugugcgaccaccgucugaugucagcugcaauuaaagauaguaaggccguacacgcugacaugggguacuggaucgaaucugagaaaaaugaaacauggaagcucgcccgggcauccuucauagaggucaagacguguauuuggccaaaaucccauacccuguggucaaacggagugcuugaaagcgagaugaucauucccaagaucuauggcgguccuauaucucaacacaauuaccgaccaggcuacuucacucagacagcggggccguggcauuugggaaaacuggaguuagauuuugaccucugcgaaggcaccacuguggucguugaugagcacugcgggaacagaggacccucccugaggacaaccacggugacuggcaagaucauucacgaaugguguugccgcaguuguacccuuccuccacugcgguucagaggugagaaugggugcugguauggaauggagaucaggcccguaaaagaaaaggaggaaaacuugguaaagagcauggucucugccggcuccggugagguggacucauuuagucucggccugcuauguauuagcaucaugauagaagagguuaugcgcucgcgauggucccggaaaaugcugaugacagggauucucgcuguguucuuucugcuuaucaugggacaguugaccuggaaugaccugauccguuuaugcauuauggucggcgccaacgcaucugauagaauggggaugggaacuacauaccucgcucugauggccaccuucaagaugaggccuauguuugcagugggccuucuguuccgccggcuaacaagcagagagguucuccuguugacuaucggucugucauuaguggccagugucgaacucccaaauucccuggaggaacuuggggacggacuggcuaugggcauuaugauauugaaacuccugaccgauuuucaaucucaucagcuaugggcgacgcugcuuagccucacauucaucaagaccacuuuuucccugcacuaugccuggaaaaccauggcaaugguauugucaauugugagccuguuccccuuaugucucaguacaacuucucagaagaccacguggcugccgguucuucugggcuccuuggggugcaagccucucacaauguuucugaucgcugagaacaaaauuuggggaagaaagagcuggccacuaaacgaagguaucauggccgugggcauagucucgauccugcuuucaucucuccugaaaaaugacgugcccuuggccgggccuuuaauugcuggaggcaugcugaucgcauguuacguaauuagugguuccagcgccgaucucucucuggagaaggcggcugaggugagcugggaagaggaagccgagcauuccggggcaucacacaacauccuugucgaaguucaggacgauggaaccaugaaaauaaaggacgaggagcgagaugacacucugacaauuuugcuaaaagccacccugcucgcugugaguggcguguauccccugagcaucccagcaacucuuuucgucugguacuucuggcaaaagaagaaacagcgcucuggcguguuaugggauacaccuucacccccagaaguugagcgggccguacuggacgaugggaucuauagaauuaugcagaggggacucuugggucguagccaggugggcgucgggguguuucaagaaaauguuuuccauaccauguggcacgugacgcgcggagcgguccugauguaccagggcaagcggcucgagccgaguugggcuagcgugaaaaaggaccugauauccuacggugggggauggagacuucagggcucuuggaacacuggcgaggaaguacaggucaucgccguggagccugggaaaaaucccaagaacguucaaaccgcaccaggaacauuuaagacccccgaaggugaggugggcgccauugcucuggacuucaaaccugggacaucgggaagcccaaucgucaauagggaaggcaagauuguggguuuguaugggaacggaguugugacuaccucaggcacguacgucuccgccaucgcacagacaaaagcuagucaggagggcccccuaccugagauagaagaugagguguuucgaaagcggaaucugacuaucauggaccuccacccggggucuggaaaaacccgcagauauuuaccagccauuguaagggaagcgaucaagcggaagcugcgaacacuuauucuggcccccaccagagugguugcaagcgagauggcugaagcccucaaagguaugccuauccgcuaccaaacuaccgcugucaaguccgagcauacaggcaaagagauaguggauuugaugugccacgcaacguucacuaugaggcugcucucaccagugcguguccccaacuauaauaugauuaucauggacgaagcccauuuuaccgauccuucuagcaucgccgcucggggguacauuaguacaagaguaggaaugggcgaggcggcagccaucuucaugaccgcuacuccgcccgguuccauggaagccuuuccacagagcaacgcagugauacaggacgaggaaagggauauuccugagcgcucuuggaacucaggguaugaguggaucacagacuuccccggaaagaccguuugguuugugccauccauuaaagccggcaacgauaucgcuaauugucugcgaaagaacggcaagagagucauacagcuuagucggaaaacguucgacacugaauaccaaaagaccaaaaauaaugauugggacuacgugguuaccaccgacauuagcgagaugggggcgaacuucagggccgaucgcgugaucgacccucguagaugccuaaagcccgucauccugaaagauggaccagaacgggugauuuuggcagguccgaugccuguaacuguggcuucggccgcacagaggcgcggccgaaucgggagaaaucacaacaaggagggagaccaguauauuuacaugggccagcccuuaaauaacgaugaggaccaugcccacuggacagaagcuaagaugcugcucgauaauauaaacaccccagaggguaucauucccgcccuguuugaaccugagcgggaaaaaucugcggcaaucgacggggaguauaggcuucgcggcgaggccagaaagacauucguugaacugaugaggcggggagaucucccagucugguuguccuacaaaguggcuagcgagggcuuucaauauucagaccgucgcuggugcuucgauggggaacgaaauaaccaggugcuggaggaaaauauggacgucgagaucuggacuaaggagggagaaaggaaaaagcuaaggccccgguggcuggaugcccgcacguacagugacccucucgcucuuagagaguuuaaagaguucgcagccgguaggcggucuguuuccggcgaccugauuuuagagauagggaaguugccgcagcaccugacccagcgagcucaaaacgcccucgauaaucuggugaugcuucauaacagcgaacagggaggcagagcauaucgccacgcgauggaggagcugccagacacaaucgaaacucucauguugcuggccuuaauugcuguacuaaccgguggggugacacuguuuuuccucucaggcaagggacuuggcaaaaccaguaucgggcuguugugugucauggccagcuccgugcugcucuggauggcaucuguugagccccauuggauugcugccagcaucauacuggaauuuuuccuuauggugcuccugaucccugagcccgauaggcagcggacuccacaggacaaucaauuggcauacgucguaauuggacuguuauuuaugauccuaacgguggccgcuaacgagaugggucugcucgaaaccacaaagaaagaucuuggcauugggcacguugcgguggagaaccaccaucacgccgcaaugcuggacgucgauuugcauccugcuuccgccuggacucuguacgccguggcaaccacaaucauaacccccaugaugcgucacacuauugaaaauacaacggcuaacaucucacucaccgccauugcgaaucaggcugccauccugaugggacuugacaagggcuggccaauaucuaaaauggauaucggugucccuuuacuggcacucgggugcuauagucaggugaacccguugacucugacagccgcucuacugaugcucguugcacauuacgccauuaucggccccggacuucaagcgaaggcuaccagagaggcccagaagaggaccgcagccggcauuaugaaaaauccaacaaucgacgggauaguggcuauugaucuggacccuguaguguaugaugccaaguucgaaaaacaguugggacagaucaugcugcucauccuguguacuucgcaaauuuuacuuaugcgcacgaccugggcacugugcgagagcaucacacucgcuacuggcccccuaaccacacugugggaggguuccccagggaaguuuuggaacaccacuauagccgucucuauggcgaauauuuuccggggaucauacuuggccggcgcaggucuggcuuucagccucaugaaaucccuuggcgggggacgaagaggcacgggggcccagggagaaacacugggcgagaaguggaagaggcaguugaaccagcugaguaaaucugaauuuaauaccuauaagcgcagcgguaucauggagguugaccggucagaagcaaaagaggggcucaagagaggagagacuaccaaacacgcugugucccguggcacagccaaguuaaggugguucgucgaacggaaccuggugaagccugaggguaaaguaauugaccuuggcugugggcgcggaggcuggaguuacuauugcgccgggcugaagaaagugacugaaguuaagggauacaccaaaggcggucccgggcacgaggaaccgaucccaauggcgacauacggauggaaucuagugaagcuccauagcggcaaagaugucuuuuucauaccucccgagaagugugacacgcuguugugcgauaucggcgagucuuccccaaaccccaccauugaagaggggcgaacucugagagugcucaagauggucgaaccuuggcuuaggggaaaucaauuuuguaucaaaauucugaacccguauaugcccucagugguugagacauuagagcagaugcagcggaagcacgguggcaugcugguacgcaauccauugagcagaaacucgacccaugaaauguacugggugucuugcgggacuggaaauaucgucagugcugugaacaugacauccaggaugcuccugaaccgauucaccauggcacaccggaaaccuacguaugagcgugacguugaucuaggcgccgguaccagacacguggcugucgaacccgagguggccaaucuugacauuaucgggcagcgcauagaaaacauuaagcaugagcacaaaagcacauggcauuacgaugaggacaauccuuauaagacuugggcauaccacggaucauaugaaguaaagccauccggcucugccagcaguauggugaacggcguugucaaacugcucaccaagcccugggaugugaucccuauggugacacaaaucgcuaugacugacaccacaccauuugggcagcagagggucuucaaagagaagguugauacccggacucccaaagcgaagagaggaacggcccaaauuauggaagugacagcacgcuggcuguggggauuuuuguccaggaauaagaaaccgcgaauauguacccgggaggaguucacuagaaagguaaggagcaacgcugccaucggcgcaguguuugucgacgagaaucaguggaacucugccaaagaggcuguggaagacgaucgcuucugggaccugguucaucgugagcgggaacuccacaagcaggggaaaugcgcaacaugcguguacaauaugaugggaaagagagagaagaaacuuggcgaauuugguaaggcgaaagggucaagggcaauuugguacauguggcugggagcccgcuucuuagaguucgaggcucugggcuuuaugaacgaagaucacugguucagucgagaaaauuccuugagcggcgucgaaggggagggacuccauaagcuggguuauauccuacgggacauuucuaaaaucccuggcgggaacauguacgccgaugacacagcaggaugggauacgagaauaaccgaggacgaucuucagaaugaagcuaagaucacugacauuauggagccagaacacgcccaacuggcuaaaucgaucuuuaagcucacauaucagaacaaggugguaaggguucagcgccccgccaaaaauggcaccgugauggaugucauuucaagacgggaccagagggguagcgggcaagugggaacuuacggccugaacacauucaccaacauggaggcacaguugauccgucagauggaauccgagggcauauuuaguccuaaugaguuagaaacaccaaaccuggcggagcgagugcucgauuggcuugaaaaguauggggucgagcgccugaaaagaauggccauuucuggagacgacuguguugugaagcccaucgaugaccgguucgcuacugcccuaaccgcacugaaugauauggguaaaguaaggaaggacaucccgcagugggaaccuagcaagggcuggaacgauuggcaacaggugcccuuuugcucccaucacuuccaccagcucauuaugaaagacgggcgcgagauagucgugccauguagaaaucaggaugaguugguuggacgggcuagggugucacaaggcgccgguuggagucugcgagaaacggcaugccuugggaagucuuacgcccagauguggcagcugauguauuuucaucguagagaccuccgcuuagcggcuaacgccaucuguagcgcagucccuguggauuggguacccaccucccggacaacuuggucaauucacgcccaucaccaauggaugaccacagaggacaugcugagcguuuggaauaggguguggaucgaagagaacccauggauggaagauaaaacuagaauuucuuccugggaggacguccccuacuugggaaagcgcgaggaccaguggugcggcagucugaucggccucaccgcucgggccacgugggcaacaaauauacagguggcuaucaaccagguuaggcgacuuauugggaaugaaaacuacagcgauuauaugaccucgaugaaaagauucaagaaugaguccgaaccugagggagcccugugguga

SEQ ID NO: 14235 - RNA, 9879 nt, Artificial Sequence
  derived and/or modified CDS sequence (opt3) from DENV-1__KP686070__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaagggggugucuuaugucauguguacaggauccuucaaauuggagaaggaaguggcugagacucagcacgguaccguucuggugcagguaaaguacgagggcacggaugcgccuugcaaaauaccaaucagcacacaagacgaaaagggggucacccagaacggacgccucauuacugcaaaucccaucgugacagauaaagagaagccuguuaacauagaaaccgagccacccuucggcgagucguauauugugaucggugccggggaaaaagcucugaagcuuucuugguuuaagaaaggcuccucaaucggaaagauguucgaggccacugcaagaggcgccaggcggauggcuauucugggggacaccgccugggauuuuggaaguaucgguggcgucuucacaagcguggggaaauugguacaucagguguuuggaacggcauacggcguucucuucuccggugucucuuggaccaugaagauugggauaggcauccuguuaacuuggcugggacuaaauagccgaucaacaagucucuccaugaccuguauugcggugggcauggugacacuguaccuuggggucaugguucaggcugacagcggaugcgugaucaacuggaaaggccgcgaauugaagugugguucugggaucuuugugacuaacgagguacacaccuggacggaacaauauaaguuccaggccgauucaccgaaaagacugagugcagccauuggaaaggcuugggaggagggcgucugcgguauaaggagcgccacacggcucgaaaauaucauguggaaacagauuuccaacgagcugaaucauaucuuacuggaaaacgacaugaaguuuaccgugguugugggcgacgcaaaugggauucuuacucagggaaaaaagaugauccgcccucaacccauggagcacaaauacucuuggaagucguggggcaaggcuaaaauaaucggggccgauacccagaacacaacuuucauuaucgacggaccagauaccccugaaugucccgacgaucagagagcguggaauauuugggaggucgaggacuauggcuuugguguguucacaacgaacaucugguugaagcucagggauagcuacacccagaugugcgaccaccgucugauguccgccgcuauaaaagauucaaaggcaguucaugccgacaugggguauuggauugaaagugagaaaaaugaaacuuggaagcuagcucgggccucuuuuaucgaggugaagacauguauuuggccacgaagccacacccugugguccaacggaguacucgaaucagagaugaucauacccaaaaucuacggcgguccuauuagccaacauaauuauagaccaggcuacuucacucagacagcagggccguggcaccugggaaagcuugaguuggauuucaaccugugcgaaggcaccacggucgugguggacgagcacugcgggaauaggggacccucuuuacgcacuaccacagucaccggcaaaaucauucaugaaugguguugccgguccuguacucucccuccacugagauuuaggggugaggaugggugcugguacggaauggagauccgccccguuaaggaaaaagaggaaaaccuugugcgaaguaugguaagcgcgggcucuggugagguggacuccuucucacugggcuugcucugugucaguauaaugauugaagaggugaugcggagccguuggucgagaaagaugcugaugacagggacccuagccguuuuuuuccugcucaucaugggacagcugacauggaaugaccuuaucagguugugcauuauggugggcgcuaacgucuccgaucgcauggggaugggaacuaccuaucuggccuuaauggcaacguuuaagaugcggccuauguucgcugugggccuccuguuuagaaggcuuacaucucgagagguucugcuacucaccaucggucugagcuugguggccucagucgaacugccaaacaguuuagaggaacucggggacggacuggcaaugggcauuaugaugcuuaaacuguugacugauuuccaaucccaccagcucuggaccacacugcuaucucugacuuuuauaaagaccacgcuuagccucgacuacgccuggaaaacaauggcuaugguacuguccaucgugucauuguucccccuguguuuaagcaccacuagucagaagacaaccuggcucccgguucugcuuggcucuuuugggugcaaaccucugacuauguucuugauuacagagaauaagaucuggggacgcaaguccuggccacucaacgaagguauuauggcggugggcaucgucagcauacugcuaucgucacugcuuaaaaaugaugugccccucgccgggccucugaucgcaggaggcauguugauugcuuguuauguaaucucugguaguuccgccgacuuaagccuggagcgggccgcugaggugucuugggaagaggaagcagagcauagcggggccucccacaacauucucgucgaaguucaggaugacggaaccaugaagaucaaagaugaggagagagacgauacgcugacuauacuucugaaggcgaccuugcuagcugugucaggcguguaccccaugaguauuccagccacacuguuugucugguauuucuggcaaaaaaagaaacagaggagcggcgugcucugggacaccccuucucccccagaaguugagcgugcaguacuggaugacgggaucuaccgcauccuucagcggggauuacuggguagaucccaggugggcgucgggguguuccaagacggaguuuuucauacaauguggcacgugacuaggggcgccguccucauguaucaggguaagcgauuggaaccgucaugggcuagugugaagaaagaucugauuagcuacgggggaggcuggcgguuccagggcuccuggaauaccggggaggagguacaggucauagcaguggaaccuggaaagaaccccaaaaauguucaaacgacaccagguacuuuuaagacccccgagggcgaagugggggccaucgcgcucgacuucaaaccuggaacaucuggcucgccaauugucaaccgcgaggguaagaucguggggcuguacggaaauggcguugugaccacuagcggcaccuaugucucagcuauugcccaggcaaaggccucccaggaagggccccuuccugagaucgaggaugaaguguuuaaaaagagaaaccugacaauaauggacuugcacccgggaagugguaaaacgaggcgguaccuaccagcuaucguacgagaggccauuaagagaaaacugcgcacucucaucuuagcacccaccagggugguugcuucugaaauggccgaggcgcugaagggcaugccuauucguuaucaaacaaccgccgucaagagcgaacauacugggaaagagaucguggaucuuaugugccacgcaacauucaccaugcggcugcucuccccagugagaguccccaauuacaacaugauaauuauggacgaggcucauuuuacggauccugccucaaucgcugcaaggggauauaucucuacucgcguaggcaugggugaagccgccgcuauuuucaugacagcgaccccgcccgggagcguggaggcauuuccacagaguaaugccguuauccaggacgaagagcgagauauaccugaaagauccuggaacagcggauacgacuggauuaccgauuuccccggcaagacugugugguuugucccaucuaucaaaucaggcaaugacauugcuaacuguuugcggaagaacgggaaaagggugauccagcugucccgcaagacauucgacaccgaguaucaaaagacaaaaaauaacgauugggacuacguugugacuacggauauaagugagaugggagccaauuuccgugcagacagagucauugauccucggaggugccucaagcccgugauccugaaagacgguccagaacgcguaauccuugccggcccgaugccugugaccgcugcgagcgccgcacagcgaagagggcggauuggaaggaaccagaauaaggagggcgaucaguacaucuauaugggucaaccccuaaacaaugacgaagaucacgcucauuggacagaggccaaaaugcuguuggacaacauuaauacuccagaggggauaauccccgcauuauuugaaccugagcgcgaaaagucggccgcuauugauggcgaguacagacugaggggagaagcccggaagaccuucguugagcucaugcgucgcggcgaccugccagucuggcuuucuuauaaaguggcguccgagggguuucaguacagcgaucgaagauggugcuucgacggagaaaggaacaaucaggugcuggaggaaaacauggacgucgagaucuggacaaaggaaggugagcggaaaaagcuccgccccagaugguuggaugcaaggaccuauucagacccucuggcccuacgggaguuuaaagaauucgcugccggccgaagaaguguuucuggggaucugauccucgagauuggaaagcuuccgcagcaccugacuuuacgcgcucaaaaugcauuggacaaccuggugaugcuccacaauuccgaacagggcgguaaagccuacaggcaugcuauggaggaacugccagauacgauagagacccuuaugcugcucgccuugaucgcaguacugacagggggcgugacuuuauuuuuccuaagcggaaagggccuggggaagaccucaauuggacuccuuugugucauggcgaguagcgugcuguuguggauggccuccguugagccccacuggaucgcugccucuauuauccuggaauuuuuccucauggugcugcuuauaccugagcccgaccggcagcguacaccacaggauaaccaacucgcauaugucguaaucggucuguuguuuaugauucugaccguggcugccaacgaaaugggcuuacuagagacuacaaaaaaggaccuggggaucggacauguuguggcagagaaucaccaccaugccacgaugcucgauauugaccuucacccugcuagcgcguggacccuguacgccgucgcaacuacaaucauaacccccaugaugagacauaccauugaaaacacaacugcuaauaucuccuugacggccauugccaaccaggcagcuauccugaugggccucgauaaagguuggccaauaucaaagauggacaucggggugccucugcuugccuuaggcugcuacucucaggucaauccgcugacccucacagcggcugugaguauguugguugcccacuaugcaauuaucggacccggccugcaagccaaagcuacuagggaggcacagaagcgcaccgccgcggggauuaugaagaacccaacaguggauggaaucguagcuauagaccuagacccuguggucuacgaugccaaauucgaaaagcagcugggccagauuaugcuccuuauccuguguaccucgcaaaucuugcugaugcggacuacgugggcacucugcgagagcauuacacuggccaccggucccuuaacuacccuuugggaaggguccccaggaaaauuuuggaauacaacuaucgcuguuucuauggccaacauauuccgaggcucauaucuggcaggugcuggccucgccuucagccuaaugaagucccuggggggaggcagaagggggaccggagcgcagggcgagacauugggugagaaauggaagcgccagcugaaucagcucaguaagucugaauuuaacacguacaaacggagcgggauuauggagguggacagaucagaagccaaggagggacuuaaacguggcgaaaccacuaagcaugcagucuccagggguacagcuaaacugcggugguucguggagcgcaauuugguaaagccugagggcaaggugaucgaucugggguguggacgaggcggguggaguuauuacugcgccggacucaaaaagguuaccgaagugaaaggcuauacuaagggugggcccggacacgaggaaccgauuccaauggcaacauacggcuggaacaucgucaaauuacacagcggcagagacguguuuuucaccccucccgagaagugugauacgcugcuuugcgacauaggggaaucuuccccaaaucccaccaucgaggagggaaggacacugcggguccuaaaaaugguggaaccuuggcuccgcgguaaccaauuuuguauuaagauccugaauccguacaugcccucaguuguagagacuuuggaacagaugcagagaaagcauggcgggaugcuggugaggaacccacucagccgaaauucgacccacgagauguauugggucucuugcggaacaggcaacauugugagugcuguuaacaugacuucccggaugcuucugaaucguuucaccauggcccauagaaaaccuacauacgagcgcgauguggacuuaggugccgggaccaggcacgucgcgguggaacccgagaucgcuaaccuggauauuaucggacagcggauagaaaauauuaagaacgagcacaaaagcacuuggcauuaugacgaagauaauccuuacaagacgugggcauaucacggcucauacgagguaaaaccauccggcucugccagcaguauggugaacgggguugucagauugcucacaaagcccugggacgugaucccuauggugacccaaaucgcuaugacugacaccacaccauuuggacagcagcgcgucuucaaggagaaaguugauacgaggaccccccgaccgaagcgggguacugcccaaauuauggaagugacagcaaaauggcuguggggcuuucuauccagaaauaagaaaccuaggauauguacccgcgaggaauucacucguaagguacggagcaacgccgcuaucggggcgguguuugucgacgagaaucaguggaacucugccaaggaagcaguggaggaugagagauucugggaccuuguucauagggaacgcgagcugcacaaacagggaaagugcgcuacaugcguguauaauaugaugggcaaacgagaaaagaaacucggugaguuugggaaggccaagggaucacgggcaauuugguacauguggcugggcgccagauucuuggaauucgaggcucugggcuuuaugaacgaggaucauugguucaguagggaaaauucccucagcggggucgagggagaaggucuucacaaacugggcuacaucuuacgcgacauuucuaagaucccagggggaaacauguaugccgaugacaccgcgggcugggauacaagaauaacugaggacgaucugcagaaugaggcaaaaaucaccgacauuauggaacccgagcacgccuugcucgcuacgucgaucuuuaagcugaccuaccaaaacaaagugguacggguucagaggccugccaagucagguacagugauggaugucauuagccgucgagaccagcgcggguccggacaggugggcacuuauggccuaaacaccuucacaaauauggaagugcaacuuaucagacagauggagagugaagggauauuuucuccaagcgagcuggagaacuccaaucucgcagaacggguccuggacugguuggagaaacauggaguugaaagguuaaagcgcauggcuauuucaggugaugacugugugguaaagcccacugaugacagauucgccaccgcucugacggcccucaacgauaugggcaaagugcggaaggacaucccgcagugggagccuaguaaaggguggaaugauuggcagcaaguccccuuuugcucucaccauuuccaccagcuuaucaugaaggacggaagggaaauugugguuccaugucgaaaccaggaugagcuggugggccgugcaagagucagccagggugcgggguggucccuacgcgagacagccugccugggaaaaucauacgcucaaauguggcagcucauguauuuucaccggagggacuugagacuggccgcaaaugcuauauguagcgccgugccuguaaacuggguucccaccucucgcacuacaugguccauccaugcacaccaucaguggaugaccacugaagauaugcuuaguguguggaaucgggucuggauugaggaaaacccauggauggaggacaagacccacgugagcucgugggaagacguucccuaccugggcaagagggaggaucaauggugcggcucccucaucggguuaacagcccgagcgacgugggcuaccaauauucagguggccaucaaccaggucagacggcugauaggaaaugagaacuauuuggacuacaugacuucuaugaaaagguucaagaaugaaucagauccugagggugcacugugguga

SEQ ID NO: 14236 - RNA, 9876 nt, Artificial Sequence
  derived and/or modified CDS sequence (opt3) from DENV-1__KF672760__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaagcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuuugguggcccuauaagccaacauaauuacagaccaggguauuucacccagacugcgggaccguggcaccucggcaagcuggaacuugauuuugacuugugcgaggggacaaccgucgugguggaugaacacugcggaaacaggggccccucucugcgcacgacuaccgucacagguaaaaucauucaugagugguguugccgguccuguaccuuaccuccacucagauucaggggggaggacggaugcugguacggcauggaaauccgccccguuaaggagaaagaagagaaucuggugcgaaguaugguaagcgccgguucuggcgaaguggauuccuuuucacuugggauucugugugucaguaugaugaucgaggaggugaugcggagccguuggucgagaaagauguugaugacuggaacacucgcuguuuuccugcuacugauaaugggccagcucaccuggaacgaccugauuaggcuuugcaucauggugggggccaaugcauccgaccgcaugggaaugggcacaacuuacuuggcucugauggccaccuuuaagaugcggccuauguucgcagucgguuuacucuuuagaaggcugacgucucgagaagugcuucugcuaacaaucgggcucagccugguugccuguguggaguugccaaacucacuggaagaguuaggagauggccucgcuaugggcauuaugaugcugaaacuucugaccgaauuccaaccccaccaguuguggacuacccuccugagucuaacauuugucaagacuacccugucccuugacuaugcguggaaaacgacagccaugguacucucuaucgugagccuguucccguugugccuguccaccacuucacagaagacaaccugguuaccuguucuccuggggagcuuuggauguaaaccacuuacuauguuccugauuacagagaacaagauauggggucgcaagaguuggcccuugaaugagggcaucauggcaauugggaucgugucuauucuccuguccagccuacugaaaaacgaugucccucuugcuggaccccucaucgccggcgguaugcugauagccugcuacgugaucucggggucaucugcugacuugaguuuagaaaaggcagccgagguauccugggaacaggaggcggaacauagcggagcuucucacaauauucugguggagguccaagaugacggcaccaugaaaaucaaggaugaggaacgggacgauacgcucacuauucugcuuaaagccacccuguuggcaguuagcggcguguauccaauguccaucccugccacacuauucgugugguacuuuuggcagaagaaaaagcagagaucagggguccugugggacacccccaguccaccggagguggaaagggcuguucucgaugacggaauauaucguauucugcagcgcggucuuuuaggccggagccaaguaggggugggagucuuccaggauggcguguuucauacaauguggcacguuacuagaggugcagugcugauguaccaggggaagaggcucgagccuucuugggccuccgucaaaaaggacuugaucucauauggaggcggcuggcgauuccaggggaguuggaacaccggagaggaagugcaaguaaucgcggucgagcccgguaaaaauccaaagaacgugcagacgacacccggcacuuuuaaaaccccugaaggggagguuggagcuauugcccuggacuucaagccaggcacaagcgguucccccauagugaaucgggaagggaagaucgucggacucuacggcaacggcgugguuaccacuucugggaccuacgugucggcaauugcccaggcuaaagccagccaagagggaccucugccggagaucgaagaugaggucuuuaagaaacgcaaucuuacaauuauggaccugcacccagguucaggcaagacgagaagguauuugcccgcaaucgugcgggaagcuauaaaacgaaagcuaagaacucugauccucgccccuacccgcguaguggcguccgagauggccgaagcauuaaaggggaugccaauuagguaccagacaaccgcuguuaaaagugagcauacuggacgugagaucgucgaucugaugugucacgccacauucaccaugcggcuucugucucccgugagagugccuaacuauaauaugauuaucauggacgaagcucauuuuacggauccggcaagcauagccgccaggggcuacauuuccacucgcgucgguaugggggaggcugcggcaaucuucaugacagccacccccccaggaucaguagaagcuuuuccucagucuaacgccgugauccaggacgaggaacgagauauucccgagagaagcuggaauaguggcuaugacuggaucaccgauuucccaggcaagacuguuugguucgugccuuccauaaaaagcgggaacgacauugcaaauugccuccggaagaacggaaaaagggucauccaauugucucgcaagacauuugauaccgaguaccagaagacaaaaaacaaugacugggacuaugugguuacuacggauauuucagaaaugggugccaacuuccgugcugacagagugaucgauccccggaggugccugaagccagucauacucaaagacggcccggagcgcgugauucuggcggggccuaugcccguaaccguggccuccgcagcucagcgaagaggacggaucggcaggaaucagaacaaggaaggugaucaauacguuuacauggggcagccacuuaauaacgacgaggaucacgcccauuggacagaggcaaaaaugcuacuggacaauaucaacacucccgaaggcauuaucccugccuuguuugagccagaacgcgagaagagugcugccauugauggagaauauagauuaaggggcgaggcgcggaagaccuucgucgagcugaugcgucgcggggaccuccccguguggcugagcuacaaaguggcaucggaaggauuucaguauucugaucgaagaugguguuucgacggugagaggaauaaccagguccuugaagagaauauggauguugaaauauggacaaaggagggcgagcggaaaaagcugcgcccuagauggcucgacgccaggaccuacuccgacccguuggcucugcgggaauuuaaagaguucgccgcugggcgaagaagcgugucaggagaucuaauccuggaaauuggcaagcucccacaacaccuuacucugcgcgcacagaacgccuuagacaauuugguaaugcugcacaacagugagcagggugggaaagcuuauaggcaugccauggaagagcuccccgauacgaucgagacccugaugcuucuggcacucaucgcgguguugacaggcggagucacucuguuuuucuuaucuggcaaggggcuaggaaagaccuccauuggucugcucugcgugacagccagcucagcucuucuguggauggccaguguugaaccucacuggauagcagcuagcaucauuuuggaguuuuuccugauggugcuccugauccccgaaccagaccggcagcguaccccucaagauaaucagcuugccuacgucguaauuggccuccuguuuaugaucuugacuguggcagccaacgagauggggcuguuagagacaacgaaaaaggaccuaggaauaggcuauguugcugcggaaaaccaucagcacgccaccaugcuggauguggaccuccaccccgcauccgcuuggacucuuuacgccgucgccacaaccgugaucaccccaaugaugagacauacaauugagaauacuacggcaaacaucucucugaccgcuauugccaaucaagcggcuaucuugaugggucuggauaaaggguggccuauaagcaagauggacauuggcgucccgcuccuggcccuuggauguuacucccaggugaaccccuuaacacugacugcagccguucucauguugguggcucacuaugcaaucauuggcccagggcugcaggccaaagcgaccagggaagcucagaagcgcacagccgcaggaaucaugaagaauccuaccguagauggcauaguggccaucgaccuagaucccgucguuuacgacgcuaaauucgagaagcaacugggucagauuaugcuccuuauccugugcacuucacagauuuugcugaugcggacgacaugggcccucugugaaucuaucacccuggcaacugggccauuaaccacacuuugggagggaaguccuggcaaauucuggaacacuaccauagcugugucgauggccaauauuuuucgagguagcuaucuggcgggcgccgggcucgcauucucccuaaugaagucucugggaggcgggagaaggggaacaggcgcucagggugagacguugggggaaaaauggaagcgccaacugaaccagcucucaaagagcgaguuuaauaccuacaaacgguccggaaucauggaagucgacagaagugaggccaaggaaggccuuaaacguggugagacuacaaagcaugcagugucuaggggcaccgcuaaacugcggugguucguagagcgcaacuuggugaagcccgaagggaagguuaucgaucugggaugcggccgagggggauggagcuauuacugugccggccucaaaaaggugacugaggucaaagguuauacaaaggggggaccgggccacgaagagccaauuccuauggccaccuacggcuggaauuuagugaaacugcauucagggaaggacgucuuuuucaugcccccagaaaaaugcgauacgcuucugugugacaucggagaguccagucccaacccuaccauagaggaagguagaacacuaagggugcucaagaugguugagccguggcugcggggcaaucaguuuugcauuaagaucuugaaccccuacaugccaagcguaguggaaacucuggagcgcaugcagagaaaacacgggggaaugcucgucaggaauccucuuucucgaaacuccacccacgagauguauugggugucauguggcacagguaauauuguuagcgcggugaacaugacuucgcggaugcuguuaaaccguuucaccauggcucauagaaagcccacauacgaacgcgaugucgaccugggggcaggaaccaggcacguggccguagagccugaaguggcuaauuuggauaucauaggccaacggaucgagaacauuaaaaaugaacauaagucuacuuggcacuaugacgaggauaacccauacaaaacgugggccuaucacggcaguuacgagguuaagcccuccgggagcgcaucauccauggucaauggaguggugagacuccugacaaagccuugggacgucaucccaaugguuacccagauugccaugacugauaccacacccuuuggucagcaacgcguguucaaagaaaagguagacacgaggaccccgcgagcuaaacggggcacuacacagaucauggaggugaccgcgaaguggcuauggggguuucuuucuagaaacaaaaagccuaggauuugcacucgcgaagaguucacacguaagguccggagcaaugccgcaaucggagcuguguuuguugacgaaaaccaguggaauagugccaaagaggcaguggaggaugaaagauucugggaccugguccauagggagcgcgaacuccacaagcagggcaaaugcgccaccuguguguauaacaugauggguaagcgagagaaaaagcugggggaauucggaaaggcuaaaggcucccgggccauaugguacaugugguugggcgcgagauuucuggaguucgaggcacucggguuuaugaaugaagaucauugguucagcagggagaacucucuuucaggaguagaaggugagggccugcacaaguuaggguacauucugcgcgacaucaguaaaaucccaggaggcaauauguaugccgaugacacagcugguugggauacuagaauuaccgaggacgauuugcaaaacgaagccaagauaacggacaucauggagcccgaacaugcacuccuggcuaccuccauuuuuaaacuaacauaccagaauaagguugugcggguccagaggccugccaaaaacgggacugugauggaugugaucagccgucgagaccagcgcggaucuggccaagucggcaccuaugggcuuaacacauucacuaauauggagguucagcugauuagacagauggaaucggagggaaucuuucucccaucagagcuggaaacccccaacuuggcugagcgggccuuagauuggcuggaaaagcacggugcagagaggcucaagcgcauggcgauaagcggcgacgacugcgugguaaaaccgaucgaugacagauucgccacggcucuuacagcccugaaugauauggggaaggugcggaaagacauuccucagugggaacccuccaagggauggaacgauuggcaacaggucccauuuuguagucaccauuuccaccagcuaaucaugaaagacggcagggagauugugguuccuugccgaaaucaggaugagcuggugggucgugcaagagucucucaaggggcuggauggagccuccgcgaaaccgccuguuugggcaaguccuacgcacagauguggcagcugauguauuuucaucggagggaccuuagacuggccgcgaacgcuaucugcucagccgugcccguagauuggguuccagcaagucgcacuacauggucuauacacgcccaccaucaauggaugaccacugaggacaugcucagcguguggaaucgggucuggauugaagagaaccccuggauggaagauaagacccacguguccucaugggaggagguuccuuacuuaggcaaaagggaagaccaguggugugggagccugaucggauugacagcucgagccacgugggcaaccaauauccagguggcuauuaaccaggucagacggcugauagguaaugagaacuaucucgacuacaugacuucuaugaagagguucaaaaaugaauccgauccagagggcgcccuuugg

SEQ ID NO: 14237 - RNA, 9876 nt, Artificial Sequence
  derived and/or modified CDS sequence (opt3) from DENV-1__KF672759__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccaagcuggaggggaaaauaguccaguacgaaaaccucaaguauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaagaacuggacuagauuucaacgaaauggugcugcucacaaugaaagagaagagcuggcugguacauaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcacacagcucugacuggcgccaccgaaauccagacgaguggaaccacaacuauuuuugcaggccaucuaaagugccggcucaaaauggacaagcugacccuuaaagggaugucuuaugucauguguacaggauccuucaaguuggagaaggaaguggccgagacucagcacgguaccguucuggugcagguaaaauacgagggcacggaugcuccuugcaagauaccauuccucacacaagacgaaaaaggggucacccagaacggacgucugaucacugcgaaucccauugugacagauaaggagaaaccuguuaacaucgaaaccgagccacccuuuggcgagagcuauauaguggucggugcaggggaaaaggcccuuaagcugucgugguucaaaaagggcucuuccauuggaaaaauguuugaggcuacugcccgcggcgcaagaaggauggccaucuugggggacaccgcuugggauuucggaucaaucgguggccucuuuacaaguguggggaagcugauucaucagguauucggaacggccuacggcguguuauuuagcgguguuuccuggaccaugaaaaucgggauuggcauacugcuaacuuggcucggacugaauucucggagcacaucacuuaguaugaccuguaucgcagucggcauggugacauuguaccugggggugaugguccaggcggacuccggaugcguuauuaacuggaagggccgagaacucaagugugguagcgggaucuucgugacuaacgaggugcacaccuggacggaacaauauaaauuucaggcugauucuccgaagcgccugucagccgcaaucggaaaagccugggaggagggcguaugcgguauuagaagugcuacaagguuagaaaauauaauguggaagcagaucagcaacgagcugaauuacauucuuuuggaaaacgacaugaaauucaccgucgugguuggcgacgugaaugggauccucgcccagggaaagaaaaugauucggccucaacccauggagcauaaguauuccuggaagucuuggggcaaagcaaagaucauaggggcugauauccagaacacuaccuuuauuaucgacggaccagauacaccugaaugucccgacgaucagcgcgccuggaauauuugggaggucgaggacuacggcuucgguaucuuuacuaccaacauauggcugaaacuaagagauucgcacacacagaugugcgaccacaggcugaugagcgcggccauuaaggauuccaaagcugugcaugcagacaugggguauuggaucgaaucagagaagaaugaaacguggaagcucgcccgugcuaguuucauugagguuaaaaccuguaucuggccaaagucucacacucuguggagcaacggagugcuugaauccgagaugguaauacccaaaaucuacggcgguccuauuucacaacauaauuaucggccaggcuacuucacacagaccgccgggccguggcacuugggaaagcuggaguuagauuuugaccucugcgaaggcacuacagucgugguggaugagcacugcggguaccgaggacccagccugagaaccacgacugucaccggcaaaaucauucaugaaugguguugcaggucuuguacacuuccuccacugcgcuuccggggugaggacgggugcugguauggaauggagaucagacccguuaaggaaaaggaggaaaacuuggugagguccaugguaagugcaggcagcggugagguggacucuuuuucccucggcauacugugugucucaauucuaaucgaagaggugaugcgcagucgauggagccggaaaaugcugaugaccgggacucucgcgguuuuccugcuuuugaucaugggacagcugacauggaaugauuuaauucgucucugcaucauggugggcgccaacgcuucggacagaauggggaugggaaccacauaccuggcccuuauggcaacuuuuaagaugaggccuauguucgcugucggccugcuauuucgccggcucaccuguagagaggugcuguugcugacgguugguuuaucccucguggccucugucgaacugccaaauagccuugaggaacugggggauggauuggcaaugggcauuaugaugcucaaacugcuaacagacuuccaaccccaccagcuguggaccacucuucucucacugaccuuuauaaggacaaguuugucccuggauuaugccuggaagacuauggcuauggcguuaucuaucguaagccucuucccgcugugccuuuccaccacgucacagaaaacaaccuggcugccuguguugcucggcagcuuuggguguaagccacugacuauguuccuaauuacagagaacaagaucuggggacgaaaaaguuggcccauuaacgaagguaucauggccguuggcauagugucuauccugcuuuccagccuccugaagaaugacgucccuuuggcagggcccuuaauugcuggaggcaugcugaucgccugcuacgugauuucggguucaucugccgaucucagucuggagaaagcugcagagguauccugggaagaggaagccgagcauagcgggaccucucacaacauccuuguggaaguccaggacgauggaacuaugaagauaaaagacgaggagcgcgaugacacacugaccauuuugcuaaaggcgacgcugcucgcuguuagcggcguguauccaauguccaucccugccacucuguuugugugguacuucuggcaaaaaaagaagcagcggucaggcguccuuugggauacccccaguccaccgaaaguggaaagagcaguuuuagacgacgggaucuauaggauucugcagcguggacucuugggucgcagccagguaggcgugggggucuuccaagauggaguguuucauacaauguggcacguuacccggggcgccgugcugauguaccaggguaagagacucgagccuucuugggcuuccgucaaaaaggaccugauaucauacgggggaggcuggagguuccagggcaguuggaauacaggggaagaggugcagguaaucgcagucgagcccggaaaaaacccaaagaaugugcaaacuacccccgguacguuuaagacaccugaaggcgagguuggggccauugcgcuugauuucaaaccaggaacuagcggcucccccaucgugaaccgagaagguaagauugucgggcuguauggaaauggcgugguuaccacaucuggcaccuacgugucggcuaucgcccaggcaaaagccacucaggaggggccuuugccggaaauagaggacgaggucuuuaagaaacggaaccuaaccaucauggaucugcacccaggaagcgguaagacacgcagauaucuccccgcuauugugagggaagccaucaagcggaaauuacgaacgcugauucuugcaccuacuagaguaguggcuucagagauggccgaagcgcugaagggcaugccaauccgcuaccaaaccacagccguuaaauccgagcauaccgggagggaaauagucgaccucaugugucacgcaacuuucacaaugcguuugcugagucccgugcgggugccuaauuauaacaugauuaucauggaugaggcucauuuuaccgacccggccucuaucgcugcaagaggauacauuagcacgagggucggcaugggugaggccgccgcuaucuucaugacugcgacacccccaggguccguagaagcauuuccucagucaaaugccgugauacaggaugaggaacgcgacauucccgagcgaucuuggaacagcggauaugauuggaucaccgacuucccaggcaagaccguuugguuugugccuaguauuaaauccggcaaugacaucgcuaacugccucagaaagaaugggaagcgggucauacagcugagcaggaaaacuuucgauacagaauaccaaaagaccaaaaacaacgacugggauuacgugguuacaacugacauuucugagaugggagccaauuuccgcgcagaucgugugaucgaccccagacggugccuuaagccagucauccuaaaagaggguccggaaagggugauucuggccggcccuaugcccguaacgguggcuucagcggcccagcgccgagggagaaucggacggaaccagaauaaggagggcgaucaguauauuuacaugggucaaccauugaacaaugacgaagaucacgcacauuggaccgaggcuaagauguuacuggacaacauaaauacacccgaggggaucauuccugcccucuuugaaccagagagggaaaaauccgcagccaucgauggcgaguaucgccugagaggagaagcuaggaagacuuucguugagcuuaugcggcguggcgaccugcccgucuggcucaguuacaaaguggccagcgagggguuucaguauucggaucgccgaugguguuucgacggagaaagaaacaaucagguguuggaggaaaacauggacgucgagaucuggaccaaggaaggugagaggaaaaagcugcggccucgcuggcuagaugcgagaacauacucugacccgcuggcacucagggaguuuaaagaauucgccgcuggccggcgauccguuagcggggaucuuauucuggagauaggaaaguuaccacagcacuugacccugagagcccaaaaugcucucgacaaccuggugaugcuucacaauucagaacagggcgguaaggcauaucgccaugccauggaggaacugcccgauacuaucgagacgcucauguugcuggcuuuaauugccguacuaaccgggggcgugacacuguuuuuccucaguggaaaaggccuugggaagacuucuaucggacuguugugcgucauggcauccagcgcgcugcucuggauggccucaguggagccucacuggauugcugccaguaucauacuggaauuuuuccuuaugguucuccugauccccgagccagacaggcagcggaccccucaggauaaccaauuggcauacguggucauuggucuguuauuuaugauccuaacaguagcugccaaugaaaugggccugcucgagaccacuaaaaaggaccuugggauuggacauguggcaguugagaaccaccaccaugccacaaugcuggauguggacuugcgucccgcuagcgcguggacgcuguacgccgucgcaaccacugugaucacaccaaugaugagacacaccauagaaaacaccacagcuaauauuucccucacugccaucgccaaccaggcagcuauucugaugggccuugauaaagguuggccuaucucuaagauggacauaggggucccguuacuggcccucggcuguuauagccaggugaaucccuugacgcugaccgcggcuguucuaaugcugguggcccauuacgcaaucauuggaccaggccuccaagccaaggcuacaagggaggcacagaaacgcacugccgcggggaucaugaagaacccuaccguagauggaauugugacaaucgaccuugaccccgucguuuaugaugcuaaauucgaaaagcagcugggccagauaauguugcugauucucugcaccucccaaauccuguuaaugcggacuacgugggcccuuugugagucaaucacacuggcaaccgguccacucacuacccuaugggaagggucuccuggaaaauuuuggaauacaacuauugccgugaguauggcuaacaucuuccgaggcucguaccuggccggugcaggcuuggcuuucagccugaugaagucccucgggggaggcagaagggggaccggagcccagggcgagacacuuggugagaaguggaaacgccagcugaaucaguugucuaagucagaauuuaacacguauaaaaagagcgggauaauggaggucgaccgguccgaagcgaaagagggacugaagagaggcgaaaccacuaagcacgccgugagucgugguacagcaaaacucaggugguucguagagcggaauuuagugaagcccgagggcaaaguuauugaucuggggugcggacgcggcggguggucuuacuauugugcuggacuuaagaaagugaccgaagucaagggcuacacuaaaggugggccgggacaugaggaaccaaucccuauggccacauacggcuggaaccuggugaagcuacacagcggcaaggacgucuuuuucacccccccagagaaaugcgauacgcuccugugugacauuggggaaucaucccccaauccuaccaucgaggagggacgaacauugagagugcugaagaugguugaaccguggcucagggguaaccaauuuugcauaaaaauccuuaaucccuauaugccaaguguaguggagacucuggaacagaugcagcggaagcacggcgggauguuaguccgcaacccucugagcagaaauucuacccaugagauguacuggguguccuguggaacaggcaacauuguuucagcagugaauaugacuagcaggauguugcucaaccgauucaccauggcucaccggaaacccacauaugagcgugaugucgaccugggugccgggaccagacauguggccguagaaccugagguggcgaaccuagauaucauuggacagcgcaucgaaaauauuaagaacgagcacaagucgacuuggcacuacgacgaagauaauccauauaaaacgugggcuuaccauggcucuuaugagguuaagcccaguggcuccgcaagcucaauggucaacgggguggugaggcuucugacaaaaccuugggacgucaucccaaugguuacccaaauagccaugacugacaccacacccuuuggacagcagcggguguucaaggagaaaguagauacgagaaccccgcgcgcuaagagggguacugcccaaauuauggaagugacagcaaaguggcucuggggcuuucugucccgaaauaaaaagccucggaucugcaccagagaggaauucacuaggaaaguccgcucuaacgccgcuaucggggcgguguuuguugacgagaaucaguggaacagcgccaaggaagcaguggaggaugagcguuucugggacuugguccaccgggaaagagagcugcauaaacagggaaagugcgcuacauguguguacaauaugaugggcaagagggaaaaaaagcucggugaguuugggaaagccaagggaagucgcgcaauuugguacauguggcuuggcgcccgauuccuggaauucgaggcuuuaggcuuuaugaacgaggaucacugguucucccgggaaaauagccugucugggguagagggagaagguuugcauaaacucggcuauauacugagagacaucucaaagauuccagggggaaacauguacgccgaugacaccgcgggcugggauacaaggaucacugaggacgaucuacagaaugaggcaaaaauuaccgacaucauggaacccgagcacgcccuucuggcuacgaguauauuuaagcucaccuaucaaaacaagguugugcgcguccagagaccugccaaauccgguacagugauggaugugaucagccggagggaccagcgugggucuggacaggucggcacuuacggccugaauaccuucacaaacauggaaguucaauugauucgacagauggagucggaagggaucuuuucaccaagcgaguuagagacucccaaccuggcaaagaaagugcucgacuggcuugaaaagcacggagcugagcgccugaaaagaauggccauuuccggugaugacugcguagugaagccgaucgaugaccgguucgcuaccgcccuaacggcacugaaugauaugggcaaggucaggaaagacauaccucagugggaacccaguaagggguggaacgauuggcagcaagugccauuuuguucucaucacuuccaucagcucauuaugaaagacggacgcgagaucguugugccuugcagaaaucaggaugaauuggucggccgggcgagggugagccagggugccggguggucccugcgagagacagcuugucuuggaaagucauaugcccaaauguggcagcugauguacuuucaccguagagaccuccgcuuagcagcuaacgccaucugcagugcaguacccguugauugggugccaaccucucggacuacauggagcauucacgcccaucaccaguggaugaccacugaggacaugcuguccgucuggaauaggguguggauagaagagaaccccuggauggaagacaaaacccauguuucaagcugggaggaagugccuuauuugggcaagagagaggaucaaugguguggcucucugaucgggcucacagcgcgcgcuacgugggccaccaauauucaggucgcaaucaaccaggugcggaggcuuauuggaaaugagaacuaccuggacuacaugacuuccaugaagcgauucaaaaaugaaagugauccagagggugcccuaugg

SEQ ID NO: 14238 - RNA, 9876 nt, Artificial Sequence
  derived and/or modified CDS sequence (opt3) from DENV-1__KF672761__SS-prME
agcgugaccaugcuguucaugcuccuucccacagcacuggcuuuucacuugacuacgcggggaggggagccucauaugaucgucuccaagcaagaaaggggaaaaucuuuacuguucaagaccucagccgguguuaauaugugcacccuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggaggccaccgccgagacaagcguagcguggcccuugcaccccaugucggucugggguuggagacuagaaccgagacauggauguccucugaaggagccuggaaacagauccagaagguggagacuugggcucucaggcacccuggcuuuaccguuauugcacuguuccuggcccaugcuaucggcacaucgauuacccagaaggggaucauauuuauccucuuaaugcuggugacgccaucaauggccaugcggugcgucggaauugguaaucgcgauuucguggaaggccuuagcggggcgacuuggguagacguuguguuggagcacggaaguugugucacaaccauggccaagaauaagcccacucuggauaucgagcuacucaaaacagaagugaccaacccugccgugcugagaaaacuuugcauugaggcuaaaaucuccaauacgaccacagacucuagguguccaacucaaggcgaagccacccuggucgaggaacaggaugcaaacuuuguuugccggcgcacauucguggaccgagguugggggaauggauguggcuuguuuggcaaggggagccuccugacuugcgcuaaguucaaaugcguaaccaaguuagagggaaaaauagugcaguacgagaaccugaaguauuccgucauugugacaguucacaccggugaucagcaucaagugggcaaugaaacuacggagcacgggacaaucgccaccauuacuccccaggcgccuaccucagaaauccagcucacagacuacggagcccuuacccuggacuguaguccacggacuggcuuggauuuuaacgagaugguccuacugacaaugaaagaaaagagcuggcucgugcauaaacagugguuccuggaccuuccgcugcccuggacgucuggugcauccaccucacaagagacuuggaauaggcaggauuugcucguaacauuuaagaccgcucacgccaagaaacaggagguugugguccuggggagccaagaaggcgcuaugcacacagccuuaacuggagcaaccgagauccagacgaguggcaccacaacuauuuucgccgggcaucugaagugccggcuaaaaauggacaagcucacccugaaaggaacaucuuaugugauguguacugguuccuucaaacuugaaaaggaggucgcugaaacccagcacggcacgguguugguucaggugaaauacgaggggacagaugcgccuugcaagauaccauuuagcacccaagacgagaaaggaguaacucagaacggccgucugaucacagcaaaucccauugucaccgauaaggaaaaaccugugaacaucgagacugaaccacccuucggugagucguauauaguugugggggccggcgagaaggcucucaagcugucuugguuuaaaaagggauccucaauuggcaaaauguucgaagccaccgcacgcggggccagaaggauggcuauccuuggagacacagccugggauuuugguaguaucggcggggucuucacgagcgugggaaagcugguacaucagguguuuggcaccgcauacgguguuuuguucuccggggucucuuggacuaugaaaauuggcaucgggauucuccugacaugguuaggccugaauagccggucaaccagucuauccaugacauguauagcgguggggauggugacucucuaccugggagucaugguucaggcugacagcggcugcgugaucaacuggaagggucgagagcuuaagugugggucuggaauuuuugugaccaacgaaguacacacguggacagagcaauauaaauuccaggccgauucaccgaagcgcuugagugcagccaucggcaaggcuugggaagagggugucugcggcaucagaagcgccaccaggcuggagaauauuauguggaagcagauauccaacgaacucaaucauauccuguuagagaacgacaugaaauuuacugugguugugggggacgcaaauggcauucuggcucagggcaagaaaaugauccggccucaacccauggaacacaaguacucuuggaagucgugggggaaagccaagauuaucggagcggauauacagaacaccacauucaucauugacggcccagauacuccugagugucccgacgaacagcgcgccuggaauaucugggaggucgaggauuaugguuuugggauuuucaccacaaacaucuggcuuaaauugagagacagcuacacgcagaugugcgaucacaggcucauguccgcugcaauaaaggacucaaaagccgugcaugcugauaugggauauuggauugaaagugagaagaaugaaaccuggaagcuggcccgugcaucuuucaucgagguuaaaacuuguauuuggccaaagagccacacacuaugguccaacggcgugcuggaaucagagaugaucauacccaaaaucuacgguggcccuauuagccaacauaauuaucggccaggguacuuuacccagacugcgggaccguggcaccucggcaagcuggagcuugacuucgauuugugcgaagggacaaccguagucguggacgagcacugcggaaaccgaggccccucucugagaacgacuaccgugacagguaaaaucauucaugaaugguguugcagguccuguaccuuaccuccacuccgcuuuagaggggaagauggaugcugguacggcauggagaucagacccgucaaggaaaaggaggaaaaucugguuaggaguauggugagcgccgguucuggcgagguagacuccuucucacuugggauacugugugugaguauuaugaucgaagaggucaugcgcagccgauggucgcggaaaauguugaugacuggaacacucgcuguguuucugcuacugaucaugggccagcucaccuggaacgaccugauucgucuuugcaucaugguuggggccaaugcauccgauaagaugggaaugggcacaacuuauuuggcucugauggccaccuucaaaaugagaccuauguuugcaguggguuuacucuucaggcgccugacgucucgggagguccuucugcuaacaauugggcucagccugguggccucaguugaauugccaaacagucuggaggaauuaggagacggccucgcuaugggcauaaugaugcugaaacuucugaccgaguuucaaccccaccaguuguggacuacccuccugucccuaacauucaucaaaacuacccugucucuugauuacgcguggaagacgacagccauggugcucagcauugucucccuguuuccguugugucugucaaccacuagccagaagacaaccugguuaccuguacuccuggggaguuucggaugcaaaccacuuacuauguuucugaucacagaaaacaagauuugggguagaaaaucuuggcccuugaaugagggcaucauggcaauagggaucguguccauucuccugagcucgcuacugaagaacgacguuccucuugcuggaccccucaucgccggcgguaugcugauugccuguuaugugaucucagggucuagugcugauuuguccuuagagaaagcagccgaagucagcugggaggaagaggcggaacauucuggaaccagccacaauauacugguggagguacaggacgauggcacgaugaagauuaaagacgaggaaagggaugacacucucaccauccugcuuaaggcuacacuguuggccguguccggcgucuacccaaugucaaucccugcaacccuauucguuugguauuucuggcaaaagaaaaagcagcgaaguggggugcugugggauacacccagcccaccggagguggaacgcgccguccucgacgauggaauuuaccggauacugcagagaggucuuuuaggcaggucucagguggggguuggaguauuucaagacggcguguuccauacuauguggcacgucacccguggugcugugcugauguaucaggggaaacgccucgagccuuccugggcaucaguuaagaaagacuugaucaguuacggaggcggcuggcgguuucaggggagcuggaacacgggagaggaagugcaggucauugccguggagcccgguaagaauccaaagaacguacaaacaacucccggcaccuucaaaacaccugaaggggaggucggagcgaucgcucuggauuuuaagccaggcaccuccgguucucccauugugaauagagaagggaaaaucguuggacucuacggcaacggcguggucacuaccucggggacauaugugagcgccauagcacaggccaaggcuucacaggagggaccucugccggagaucgaagacgagguuuucaaaaagaggaaucuuacgauuauggaucugcacccagguuccggcaagacucgacgguacuugcccgccaucgugcgcgaagcaauuaaaagaaagcuaaggacccugauccucgcuccuacacgggucguggccagugagauggcggaagccuuaaaagggaugccaauacgauaucaaaccacugcaguaaagucugagcauacaggaagagagauuguggaccugaugugccacgcuaccuuuacgaugcgccuucugagccccguuagggucccuaacuacaauaugaucaucauggaugaagcccauuucacugacccggcuuccauugcagcccguggcuauaucucaacacggguggguaugggggaggccgcugcgauauuuaugaccgcaacacccccaggaucuguggaagccuucccucagagcaacgcugucauucaggaugaggaaagagacauccccgagaggaguuggaacuccggcuacgauuggauuacugacuuuccaggcaaaacaguaugguucgugccuagcaucaagucugggaacgauauagccaauugucuccgcaagaacggaaaacgaguuauucaguugucaagaaagaccuucgacacagaguaucagaagacuaagaacaaugacugggauuacguggucacgaccgacaucuccgaaaugggugcaaacuuucgggccgauagggugaucgacccccgccguugccugaaaccaguuauucucaaggauggcccggagagagugauccuggcugggccuaugcccgucacaguggcgagugccgcacagcggaggggacgcauuggccgaaaucagaacaaggaaggugaccaguacguauauauggggcaaccacuuaauaacgaugaggaccacgcucauuggacugaggccaaaaugcuacuggauaauauaaacacccccgaaggcaucauuccugcauuguucgagccagaaagagaaaagagcgccgcuaucgacggagaauaccgguuaaggggcgaggcccgcaaaacauuuguggagcugaugagaaggggagaucuccccguuuggcugucguauaaggucgcgucugaaggauuccaguacuccgaccggcguuggugcuuugauggugagcgcaauaaccaggugcuugaagagaauauggacguggaaaucuggaccaaagagggcgagcgaaagaaacugagaccuagguggcucgacgcacggacuuauagcgauccguuggcccugcgcgaguucaaggaguuugcugccgggagaaggucagucaguggagaccuaauucuggaaauaggcaagcucccacagcaccuuacgcugcgggcucaaaacgcauuagauaauuugguuaugcugcacaacucugagcagggugggaaagccuaccgacaugcuauggaggaacuccccgacaccaucgagacacugaugcuucuggcccucauugcaguguugacuggcggaguaacccuguucuuuuuauccggcaaggggcuaggaaaaacaagcaucggucugcucugugugaccgcgucaagugcccuucuguggauggcuagcgucgaaccucacuggauugccgcauccaucauauuggaguucuuucugauggugcuccugauccccgaaccagauagacagcgcacuccucaggacaaucaacuugcuuauguugugauuggccuccuguucaugaucuugacagucgccgcaaacgagauggggcuguuagagacgaccaagaaagaucuaggaauuggccauguagccgcugaaaaccaccagcacgcgacuaugcuggacguggaucucaggcccgccucugcauggacacuuuacgcuguugccaccaccgugaucacaccaaugaugcggcauacuauagagaauacgaccgccaacauuagccugacagcaaucgcuaaucaggccgcgauuuugaugggucuggacaagggguggccuaucuccaagauggauauaggcgucccgcuccuggcucuuggaugcuacucacaagugaaccccuuaacucugaccgccgcaguccucauguugguggcccacuaugcuaucauuggcccagggcugcaggcaaaagccacacgugaagcgcagaagagaaccgcugccggaaucaugaaaaauccuacuguugacggcauuguggcaaucgaucuagaccccguaguguacgacgccaaguuugagaaacagcugggucaaauaaugcuccuuauucuguguacgucucagaucuugcugaugaggacaaccugggcucucugcgaaaguaucacucuggccaccgggccauuaacaacucuuugggagggaucgccuggcaaguucuggaacaccacaauugcagucagcauggcuaauaucuuccgcgguuccuaucuggccggcgcggggcucgccuuuucucuaaugaagucacugggaggcgggcggcgaggaacgggcgcacagggugagaccuugggggaaaaauggaagagacagcugaaccaacucagcaaauccgaguucaauacuuacaagaggaguggaauaauggaaguugaucgcucugaggcuaaagaaggccuuaagcggggugagacaaccaagcaugccgugagcagaggcacugcaaaacugcguugguuugucgagaggaacuuggugaagcccgaagggaaaguaauugaccugggauguggcagagggggauggucauauuacugcgcuggccucaagaaagugacagagguuaaggguuauaccaaagggggaccgggccacgaggaaccaaucccuauggccacguacggcuggaauuuagugaagcugcauuccgggaaggaugucuucuuuaugcccccagaaaaaugugacacccuucugugcgauauuggagagaguagccccaacccuacaaucgaggaaggucgcacucuacgagugcucaagauggucgagccguggcugagaggcaaucaguucuguauaaaaaucuugaaccccuacaugccaucugugguugaaacccuggagcagaugcagaggaagcacgggggaaugcucguacggaauccucuuucccgcaacucaacacacgagauguauugggugagcugcggcacugguaauauugucucggccgugaacaugaccucuagaaugcuguuaaacagguuuacaauggcgcaucgaaaacccaccuacgaacgggacguugaucugggggcuggaacucgucacguggcagucgagccugaaguggccaauuuggacaucauuggccaaagaaucgagaacauuaagaaugaacauaagaguacguggcacuaugaugaggacaacccauacaaaacaugggcuuaucacggcuccuacgagguaaagcccagcgggucagccuccucuauggugaauggaguuguccgccuccugaccaaaccuugggaugugaucccaauggugacucagauagcaaugaccgacacaacgcccuucggucagcaaagggucuuuaaggaaaaaguugacacccggacuccgagagccaagcgcggcacagcucagauuauggaggugaccgcgaaguggcuauggggguuccuuagcaggaacaaaaagccucgaaucuguacucgggaagaguuuacaagaaaaguaaggaguaaugccgcaaucggagcuguguucgucgaugaaaaccaguggaacuccgccaaggaggcaguggaggacgaacgcuuuugggaucugguucaucgugagcgggaacuccacaaacagggcaagugcgcaaccugcguguauaacaugauggguaagagagagaaaaagcugggggaguucggaaaagcuaagggcagcagggccauuugguacaugugguugggcgcgcgcuuccuggaguuugaggcacucggguucaugaaugaagaccauugguuuucucgagagaacucacuuaguggagucgaaggugagggccugcacaaauuaggguacauacugcgggauaucuccaagauuccaggaggcaauauguaugccgacgauacagcugguugggacacuagaaucaccgaggaugacuugcaaaacgaagccaaaauuacggauaucauggagcccgaacaugcacuccuggcuaccagcauauucaagcuaacauaccagaauaaggugguaaggguucagcgcccugccaaaaacgggacugugauggacgucaucucuagacgggaucagaggggaucgggccaagugggcaccuaugggcuuaacacauuuacuaauauggaggugcagcugauucgucagauggaaucagagggaaucuuccucccaagcgagcuggaaacccccaacuuggcugagcgagucuuagacuggcuggaaaagcacggugccgagcgccucaaaagaauggcaauuuccggcgacgauuguguugugaagccgaucgacgaucgguuugcgacggcccuuauagcucugaaugacauggggaaaguaaggaaggauauuccucagugggaacccaguaagggauggaacgacuggcaacaggugccauucugcucucaccauuuucaccagcuaaucaugaaagauggccgcgagaucgucgugccuuguagaaaucaggacgagcugguuggucgggccagggugagccaaggggcaggauggucccuccgagaaacagcuugcuugggcaagucauacgcccagauguggcagcugauguauuuccaucguagagaucuucgccuggcagccaacgcgauuuguagugcuguccccguggacuggguaccaaccucucggacuacauggagcauacacgcccaccaucaauggaugaccacugaggauaugcucuccguuuggaauaggguguggaucgaagagaaccccuggauggaagacaaaacccacgucucaagcugggaggaggugccuuacuuaggcaagagagaagaccaguggugcgggucucugauuggauugacagcacgcgccacgugggcuaccaauauccagguugccauuaaccaggugcggaggcugaucgguaaugagaacuaucucgauuacaugacuuccaugaaacgauuuaagaaugaaagugacccagagggcgcacuuugg

SEQ ID NO: 14239 - RNA, 9876 nt, Artificial Sequence
  derived and/or modified CDS sequence (opt3) from DENV-1__KF672762__SS-prME
agcgugaccaugcugcucaugcuucugcccaccgcauuggcuuuccacuuaacuacgagaggcggggaaccucauaugaucgucuccaagcaggaaagaggaaaaucucugcuguuuaagaccucagccgguguuaauaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagagaaaagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcauagaugcgccuugcaagaucccauucagcacacaagacgaaaaagggguaacccagaacggacgucucauuacugcaaaucccaucgucacagauaaggagaaaccugugaacauagaaaccgagccacccuuuggcgagucguauauuguugugggugccggggaaaaggcucugaaacuuucuugguucaaaaagggcuccucaaucggaaaaauguuugaggccacugcacgcggcgccagaaggauggcuauccugggggacaccgccugggauuucggaaguauugguggcgucuuuacaagcguggggaaguugguacaucaggugcucggaacggcauacggcguucuguucuccggugucucuuggaccaugaaaaucgggauuggcauauuacugacuuggcuaggacucaauagccggucaacaagucuguccaugaccuguaucgcggugggcauggugacacuuuacuugggggucaugguucaggcugacagcggaugcgugauuaacuggaagggccgagaacugaagugugguucugggaucuuugugacuaacgagguacacaccuggacggaacaauauaaauuccaggccgauucaccgaagcgccucagugcagccaucggaaaggcuugggaggagggcgucugcgguauuagaagcgccacaaggcuggaaaauauaauguggaagcagaucuccaacgaguuaaaucauauucugcuugaaaacgacaugaaauuuaccgugguugugggcgacgcaaaugggaucuuggcucagggaaagaaaaugauucggccucaacccauggagcacaaguacucuuggaagucguggggcaaagccaagaucauaggggcggauauccagaacacuaccuucauuaucgacggaccagauacaccugaaugucccgacgagcagcgcgccuggaauauuugggaggucgaagauuauggcuuugguaucuucacuaccaacauauggcucaaacugagagacagcuacacacagaugugcgaucacaggcuaauguccgcugcaauuaaggacucaaaagccgugcaugcugauaugggguauuggaucgagagugaaaagaaugagacguggaagcuggcccgugcaucuuuuauugaaguuaaaaccuguaucuggccaaagagccacacucucugguccaacggagugcuggagucagagaugauaauccccaaaauuuacggcgguccuaucagccaacauaauuaucggccaggcuacuucacacagaccgcggggccguggcaccuuggaaaguuggaacuggacuucgauuuaugcgagggcacuacaguagucguggacgaacacugcgggaaccgaggacccucucucagaaccacgacugugaccggcaaaauuauccaugagugguguugcagguccuguacacugccuccacuucgcuuucggggugaggaugggugcugguacggaauggaaauaagacccgucaaggagaaggaagagaaucugguuaggaguauggugagcgccggcucuggugaaguagacuccuucucauugggcauucucugugugaguaucaugaucgaggaggucaugcgcagccgauggucgcggaaaaugcugaugaccgggacucuagcuguguuucugcuccugauuaugggacagcuuacauggaacgacuugauccgucugugcauuaugguuggcgccaaugcauccgauaagauggggaugggaaccacauauuuagcucucauggccacuuucaaaaugagaccuauguuugcagugggccugcuuuucaggcgccugaccucucgggaaguccuacuccugacgauagguuugagccugguggccucaguugaguuaccaaacagucucgaagaacugggggacggacuugcuaugggcaucaugaugcugaaguugcucacagaauuucaaccccaccagcuguggaccacucuacugucccuuaccuucauuaaaacaacucucucucuggauuacgcguggaagaccacggccaugguguugagcaucgucucccuguuuccguuaugucucucaacaaccagccagaagacuacauggcugccuguacuucugggcaguuucgggugcaaaccauugaccauguuucucauuacugagaacaagaucuggggaagaaaaucuuggccccugaaugaggguauaauggcaaucggcauuguguccauccuacugagcucgcuucucaagaacgacguuccucuggcugggcccuugauugccggaggcauguuaaucgccuguuaugugauaucagguucuagugcugaucugucccucgaaaaagcagccgaggucagcugggaagaggaagcggagcauucugggacaagccacaauauucugguggagguacaggacgauggaaccaugaagaucaaagacgaagagagggaugacacgcuuacuauccuguugaaggcuacccuacuggccguguccggcgucuacccaaugucaauuccugcaacacucuucguuugguauuuuuggcaaaagaaaaagcagcgaaguggcgugcugugggauacccccagcccaccggaaguggagcgcgccguccuugacgaugggauauaccggaucuuacagagaggacugcucgguaggucucaggugggcguugggguauuccaagacggaguguuccauacaauguggcacgucacucguggcgcuguguugauguaucaggguaaacgccuggagccuuccugggcaucaguuaagaaagaccucauuaguuacgggggaggcuggcgguuucagggcagcuggaacaccggggaagaggugcaggucaucgccguggaacccggaaagaauccaaagaacguacaaacgacacccgguacuuucaaaaccccugagggcgaagucggggcgauugcucuggauuuuaagccaggaacauccggcucucccaucgugaauagagaggguaaaauaguugggcuuuacggaaacggcguggucaccacuucgggcaccuaugugagcgccaucgcacaggccaaggcuucacaggaggggccucugccggaaauugaggacgaaguuuucaaaaagaggaauuugacaaucauggaucuacacccaggauccgguaagacgcgacgguaccugcccgccauugugcgcgaggcaaucaaaagaaagcucaggacuuuaauacuggcuccuacccgggucguggccagugaaauggcggaggcccuuaaaggcaugccaauucgauaucaaacaaccgcaguaaagucugagcauacugggagagaaaucguggaccugaugugccacgcuacauuuaccaugcgccucuugagccccguuagggucccuaacuacaauaugaucauuauggaugaggcccauuucacggacccggcuuccaucgcagcccguggauauauaucaacucgggugggcaugggugaagccgcugcgauuuuuaugacagcaacacccccagggucuguggaggccuucccucagagcaacgcugucauccaggaugaagagagagacauucccgagaggaguuggaacuccggauacgauuggaucaccgacuuuccaggccgcacuguaugguucgugccuagcauaaaaucuggcaacgauauugccaauugucugcgaaagaacgggaagagaguuauccagcucucacggaaaacauuugacaccgaauaucaaaagaccaaaaauaaugacugggauuacguggucacuacggacaucuccgagaugggagcaaacuucagggccgaucgcgugauugacccccguagaugccugaagccaguuauccuuaaagaugguccggaacgggugauucuagcuggcccuaugcccgucaccguggcgagugccgcacagaggcgcgggcgaauaggaagaaaucagaacaaggagggcgaccaguacguauauaugggucaaccacugaauaacgaugaggaccacgcucauuggacagaagccaagauguuguuagauaauaucaacacucccgaggggauuaucccugcacuguucgaaccagagcgggagaaaagcgccgcuaucgacggcgaguacaggcuccgcggagaggccagaaagaccuuuguggaacugaugaggcggggcgaucuucccguuuggcugucguauaaagucgcgucugagggguuccaguacuccgaccgucgcuggugcuuugauggagaacgaaauaaccaggugcucgaggaaaauauggacguggagauuuggacaaaggagggugaaaggaaaaaguugaggccucgguggcuggacgcacgcaccuauagcgauccgcuagcccugagagaguucaaagaauuugcugccggcaggcggucagucaguggggaccucauacuugagaucggaaagcugccacagcacuuaacuuugcgagcucaaaacgcacuggauaaucucguuaugcugcacaacucugaacagggcgguaaggccuacagacaugcuauggaggagcuucccgacacgauugaaacccugaugcucuuggcccugaucgcaguguuaacagggggcguaacucuauucuuucuguccggaaaaggccucgggaagaccagcauuggacuucugugugugacagcgucaagugccuugcuguggauggcuagcgucgagccucacuggaucgccgcauccauaauccucgaguucuuucugauggugcuucucauucccgagccagaucgccagaggaccccucaggacaaucaacuggcuuauguugugaucgguuugcuguucaugauuuuaacugucgccgcaaacgagaugggccuacuggaaacaacgaaaaaggaucucgggaucggacauguagccgcugagaaccaccagcacgcgaccaugcuugacguggaucugcggcccgccucugcauggacuuuguacgcuguugccacaaccgugauaaccccaaugaugcgucauacaauugaaaauacuacggccaacaucagccugaccgcaauugcuaaucaggccgcgauccucaugggccuggacaaagguuggccuauauccaagauggauaucggggucccgcuuuuagcucugggcugcuacucacaagugaacccccucacauugacugccgcaguccugaugcuaguggcccacuaugcuauuaucggaccaggccugcaggcaaaggccaccagagaggcgcagaaaaggacagcugccgggauuaugaagaauccuaccguugacggaaucguggcaauagaucucgaccccguaguguacgacgccaaauuugaaaagcagcuuggccaaauuaugcuguugauccuguguacuucucagauccuccugaugcgcacgacaugggcuuuaugcgagaguauuacccuugccacugguccacugaccacacucugggaggggucgccuggaaaauucuggaacacuaccaucgcagucagcauggcuaauauauuucggggcuccuaucuagccggugcgggccuggccuucucuuugaugaagucacuagggggaggccgaagagggacaggagcacagggcgaaacgcucggugagaaguggaaaaggcagcuuaaccaacugagcaaguccgaguucaauaccuacaaacgcagugggauuauggagguugaucggucugaagcuaaggagggauugaaaagaggcgagacuacaaagcaugccgugagccgugguaccgcaaagcugaggugguuugucgaacggaaccucgugaaacccgagggcaagguaaucgacuuaggguguggacgcggcggguggucauauuacugcgcuggacugaaaaaggugacugaaguuaaaggcuauacaaagggugggccgggacacgaggaaccaauuccuauggccaccuacggcuggaaucuugugaaacugcauuccggcaaggaugucuucuuuaugcccccagagaagugugacacgcuacucugcgauaucggggagaguagccccaacccuaccauagaagagggacgaacacugagaguguugaaaauggucgaaccguggcugagggguaaucaguucuguaucaagauucucaaccccuacaugccaucugugguugagacucuugagcagaugcagcggaaacacggcgggaugcugguacgcaauccuuuauccagaaacucaacccacgaaauguauugggugagcugcggaacaggcaauaucgucucggccgugaacaugacuucuaggaugcuguugaaccgauuuaccauggcgcaucggaagcccacauacgagcgugacguugaucucggugcugggaccagacacguggcagucgaaccugagguggccaaucuggacauuaucggacaacgcauugaaaacaucaaaaaugagcauaagaguacuuggcacuaugaugaggacaacccauacaagacgugggcuuaucacggcuccuacgaaguaaaacccagcggcucagccuccucuauggugaaugggguugucaggcuacuuacaaagccuugggaugugauaccaauggugacccagauugcaaugacugacaccacacccuucggacagcaacgggucuuuaaagagaagguugacacgagaaccccgcgcgccaaaagggguacugcucagaucauggaagugacagcgaaguggcuguggggcuuccucagccgaaacaagaaaccucggaucuguaccagagaggaauuuacuaggaagguacgcaguaaugccgcaauuggggcuguguucgucgaugagaaccaguggaacuccgccaaagaggcaguggaagacgagcguuuuugggaucugguucaucgggaaagagaguugcacaagcagggaaaaugcgccacaugcguguauaacaugaugggcaagagggaaaagaaacugggugaguucgggaaggcuaaaggaagccgcgccauaugguacauguggcucggcgcgcgauuucuugaguucgaagcacugggcuucaugaaugaggaccauugguuuucucgggaaaacucauuaaguggggucgagggagagggucugcacaaguugggcuacauccucagagauauuuccaaaaucccagggggaaauauguaugccgacgauaccgcuggcugggacacaaggauuacugaagaugaccugcaaaacgaggccaagaucaccgauauaauggaacccgagcaugcacuacuugcuacgagcaucuucaaacugaccuaccagaauaaggugguacgcguucagagaccugccaagaacgguacagugauggacgucauuucucggagggaucagcgugggucgggacaagugggcacuuauggccucaacaccuuuacaaauauggaagugcagcugauccgacagauggagucagaggggauuuucuugccaagcgaauuagagacucccaaccuggcugaacgcguccucgacuggcuugagaaacacggagccgaaagacugaagcggauggcaaucuccggugacgauuguguugugaaaccgauagacgauagguuugcgaccgcccuaauugcucugaaugacaugggcaagguacgcaaagauaucccucagugggagcccaguaagggguggaacgacuggcaacaggugccauucugcucucaccauuuucaccagcucaucaugaaggauggaagagagauugucgugccuugucggaaucaggacgaauugguuggcagggcccgagugagccaaggugcaggguggucccugcgugagacggcuugccuuggaaaaucauacgcccagauguggcagcugauguauuuccauagacgcgaucuccgguuagcagccaacgcgauauguagugcuguccccaucgacugggugccaacaucuaggaccacuuggagcauucacgcccaccaucaauggaugacaaccgaagauaugcuguccguauggaauagaguuuggaucgaggaaaaccccuggauggaggacaaggcacacgugucaagcugggaggaagucccuuacuugggcaaacgcgaggaccaguggugcggcucucugauugggcucacugcccgggcuaccugggccacaaauauccagguggcaauaaaccagguuaggcgacuuaucggaaaugaaaacuaucuggauuacaugacguccaugaagagauuuaaaaaugagagugacccagagggugcucuaugg

SEQ ID NO: 14240 - RNA, 9879 nt, Artificial Sequence
  derived and/or modified CDS sequence (opt3) from DENV-1__JF459993__SS-prME
agcgugaccaugcuguucaugcuccuucccaccucccuggccuuucacuugacuacgagaggaggggagccucauaugaucgucucuaagcaggaaaggggaaagucauuacuguucaagaccagugcugguguuaauaugugcacacuaauugcaauggaccucggcgagcugugugaagauacuaugaccuacaaaugcccacggauaacagagaccgaaccggacgauguggacuguuggugcaaugccacugagacauggguaaccuaugggacguguagccaaacuggagagcaccgccgagauaagcguuccguggcgcuugcuccccaugucggccuggguuuggaaaccagaacagagacuuggaugucuucggaaggggccuggaaacagauccagaagguggagaccugggcacucggacacccuggcuuuacaguuauugcccuguuccuggcucaugcaaucggcaccucaauuacgcagaaggggaucauauuuauccucuuaaugcuggugacuccaagcauggccaugaggugcgucggaauugguaaccgggacuucguggagggccuuaguggggcuacauggguagauguuguguuggaacacggauccugugucaccacuauggccaaagacaagcccacacuggauaucgagcuacucaaaaccgaagugacgaauccugcgauucugcgcaaacuuugcaucgaggcaaaaauaucuaacaccacaacugacagcagauguccaacccaaggcgaagccacacugguggaggagcaggauacuaauuuugucugcaggcggaccuucguugaccgcgguugggggaacggauguggcuuguuuggcaaggggucccucauuacaugcgcuaaguucaaaugcgugaccaagcuggaaggaaaaaucguacaguacgagaauuuaaaguauucagugauugucacugugcacacgggugaucagcaucaaguuggcaacgaaacaaccgagcacgggacuaccgccacaaucacaccccaggcaccuacaagugaaauccagcugacagacuacggagcucucacgcuugacuguagcccacgaaccggccuggauuuuaaugagaugguguugcuaacuaugaaagagaagucuuggcugguccauaaacagugguuccucgaccugccgcuucccuggacauccggugccucaaccagccaagaaacauggaacagacaggaucuguuggugacuuuuaagaccgcgcacgccaagaaacaggagguaguugugcucgggagucaagaaggcgcaaugcacacggcucugaccggagccacagagauucagacuucuggcaccacaacuauauucgcugggcauuuaaagugcaggcugaaaauggacaagcuaacccucaaaggagucuccuaugugauguguacggguagcuucaagcuggaaaaggaggucgccgagacacagcacggcaccgugcuuguucaggugaaauacgaagggacugaugcaccuugcaagaucccauuuucgucucaagacgagaaaggaguaauucagaauggccgguugaucacagccaaccccauagucaccgauaaggaaaaaccugugaauauugaggcugagccacccuucggugaauccuauaucguugugggggcgggcgagaaggcacugaagcucucaugguuuaaaaagggaaguagcaucggcaaaauguucgaagccacugcucguggggcccgcagaauggcaauucugggagacaccgccugggauuuugguuccaucggcggggucuucacaucugugggaaaacuuguacaucagauuuuuggcacggcuuacggugugcuguucagcgggguuucauggaccaugaaaauaggcaucggaauuuugcucacuuggcugggcuuaaacaguagguccacaagccugucuaugaccuguaucgccgucgggauggugacacuauaccucggagugaugguccaggcagacucaggcugcguuaucaauuggaagggucgggagcugaagugugggaguggaauuuuugugacuaacgaagugcacaccuggacggagcaauauaaauuccaggcggauagcccgaagcgacuuuccgcugccauaggcaaagcaugggaggaagguguaugcggcauccgcucugccacaagauuggagaacauuauguggaagcagaucucgaaugaacugaaccauauucuccuggagaaugacaugaaauuuaccgucgugguuggggacguggcuggaaucuuagcccagggcaagaaaaugauaaggccucaacccauggaauacaaguauagcuggaaguccugggggaaagcaaagaucauuggagcugauguccagaacgccacuuucaucauugacggcccaaauaccccugagugucccgaugaccagcgggcguggaacaucugggagguggaagauuacgguuuugggauauucacaacuaauauuuggcugaaacuucgcgacucauauacccagguuugcgaucacagauugaugagugccgcuaucaaggacucuaaagcagugcacgccgauaugggauacuggauugagagcgaaaagaacgagacauggaagcucgcuagggccuccuucaucgaaguaaaaacgugugucuggccaaagucacauacccuguggagcaauggcgugcuagagucugagaugauaauccccaaaauuuaugguggcccuaucucccaacacaaccaucguccaggguacuuuacucagacagcaggaccguggcaccugggcaagcucgaacuggacuucgaucuuugcgaggggaccacuguggucguugacgaacacugcggaaaucggggccccaguuugcgaacaaccacggugacugguaaaauuauccaugagugguguugcagaagcuguacccugccuccauuaagguuucgcggggaggauggaugcugguacggcauggaaauacggcccguaaaggagaaggaagagaaccucgugaaaucuauggucuccgcggguucaggcgaaguggacaguuucagccuggggcuucuguguauuucgaucaugaucgaggagguuaugagauccagguggucucgcaagauguugaugacaggaacccucgccguguuuuuccugcuaauuaugggccagcugacuuggaaugaccucauccgacugugcauuauggucggggcuaacgccagcgaucggaugggaaugggcacaaccuaucuugcauugauggcuacauuuaaaaugcguccuauguucgccgugggucuguuauuuagaaggcucacuucacgcgaaguucugcuucugaccauagggcuaagucucguggcauccgucgagcugccaaauucuuuggaggaacugggagacggcuuagccaugggcaucaugauucucaagcugcuuacggauuuccaaagccaccagcugugggcuacauugcucucccugaccuuuaucaaaacuaccuucucacuacauuacgcguggaagacaauggccaugguacugagcauugugagucuuuuuccccucugucugucuacuaccucccagaagacgacaugguugccgguucuguuagggagccucggaugcaaaccucugaccauguuccuuaucgcagaaaacaagauauggggucggaaaucguggccacugaacgagggcaucauggcuguggggauugucucaaucuugcucucuagucugcuaaagaaugacgugccccuggccggaccucuuauugccggcgguaugcucaucgcuuguuauguaauauccgggagcucugcagaucugagcuuggagaaagccgcggaaguguccugggaggaagaggcugaacacucaggagccagucauaacauuuuagucgagguucaggacgauggcacuaugaagaucaaagacgaggaaagagaugacacacugaccauccuccugaaggcaacucuucuggccgugagcggcguguaccccuugucuauuccagcuacacuauucgucugguauuuuuggcaaaagaaaaagcagagguccggggugcugugggauaccccuucacccccagagguugaacgagcaguacucgacgauggaauauaccgcaucaugcagcggggucugcuuggcagaagucaggugggggucggaguguuccaagagaauguuuuucacacgauguggcacgugacuaggggcgccgucuuaauguaucaggguaaacgucuggagccgagcugggcguccgugaagaaagaccucauuucuuacgggggaggcuggcgcuugcagggcucguggaacaccggggaagagguacaggucaucgcuguggaaccuggaaagaaucccaagaacguucaaacagccccagguaccuucaaaacacccgagggcgaagugggggcaauugcccuggacuuuaagccuggaacuagcggcucaccaaucgucaaucgggaggguaaaauaguggggcucuacggaaacggcguugugaccacguccggcacauaugucagugcuaucgcccaggcaaaggcuucucaggaggggccccugccugaaauugaggaugaaguguucagaaaaaggaaucuuacuaucauggaccugcauccgggaagcgguaagacccgacgguacuugccagccauuguacgcgaggcgaucaagagaaaacuaaggacacugauacucgcccccacccgggugguugcauccgaaauggcugaggccuuaaagggcaugccuauucgauaucaaacuaccgcugucaaaucagagcacacagggaaggaaaucguggaucugaugugccaugcaacguuuacuaugagacuucugucuccagugcgcguccccaacuacaauaugaucauuauggacgaggcccacuucaccgauccuagcaguaucgccgcuaggggauauauauccacacguguaggcaugggugaagcggcagccauuuuuaugaccgcuacuccgcccgggagcguggaggccuucccacagucuaacgcaguuauccaggacgaggaacgggauauuccugagagaucauggaacuccggauacgaauggaucacagacuuucccggcaaaaccgugugguucgucccaaguauaaagagcggcaacgauauugccaauugucucaggaagaacgggaaacgcgugauccaguugucgcgaaagacguucgacacugaguaucaaaagacuaagaacaaugauugggacuacguugugaccaccgacaucucugaaaugggagcuaacuuuagagcggaucgggucauugacccuaggcgcugccugaaacccgugauccucaaggaugguccagagcguguaauucuggccggcccgaugccugugacuguugcauccgcugcccagagacgggggaggauaggacgcaaucauaacaaggagggcgaccaguacaucuauaugggucagccccuuaauaacgaugaagaccacgcacacuggacagaggccaaaaugcuacuggauaauauuaacaccccagaagggaucauccccgcuuuguucgagccugaacgagaaaagagcgccgcgauugacggcgaguacagauuacggggagaagcaaggaaaacauuugucgagcugaugcgcagaggcgaucucccaguguggcugucauauaagguggccagugaaggguuccaauacucugacaggcgguggugcuuugauggagagcguaauaaccagguccuugaagagaauauggacguugagauauggacuaaagaaggugagcgcaagaaacugcgacccagauggcucgaugcuaggacguauuccgacccuuuggcccugcgggaguucaaggaguuugcugcaggccgcagaagcgugucaggggaccuaauccuggaaauuggaaagcucccgcagcaucuuacccagagggcccaaaacgcucuggauaauuuaguaauguugcacaacagugagcagggcggucgggccuaccgacaugcacuggaggaacucccagacacaaucgagacucugaugcuucuggcgcucauugccguguugaccgggggcgucacacuguucuuuuuaagcggaagaggccuagggaaaaccuccaucggacugcucugugugauggcuucuagcgcccuucuguggauggcauccguugaaccccacuggauagcugccucaaucauuuuggaguucuuucugauggugcuccugaucccugagcccgaucgccagaggacuccacaggacaaucaacuugcauaugucguaauuggucuccuguucaugaucuugacgguggccgcuaacgaaaugggccuguuagagaccacaaagaaagaucuagggauaggacacguugcgguggaaaaccaucaccaugccucuaugcuggacgucgaucuccacccugcaagugcuuggacucuuuacgccguggccaccacaauuaucacccccaugaugcggcauacuauugagaauacaacggcaaacaucucgcugaccgcuauagccaaucaggcggcuaucuugaugggccuggacaaggguuggccaauuagcaaaauggauaucggggucccucuccuggcccuuggcugcuacucccaggugaacccguuaacucugacagcagccguucucauguugguggcucacuaugcaauuaucggacccggccugcaagccaaggcgacccgugaagcucagaagagaaccgccgcagggauaaugaaaaauccaacaguagacggaauuguggccaucgaucuagacccugucguuuacgaugcuaaguuugagaaacagcugggccagaucaugcuccuuauucuguguacuucucaaaucuugcugaugaggacgaccugggcccucugcgagucaauaacacuggcaacuggucccuuaaccacacuuugggaagggagcccaggaaaguucuggaacaccacuauugcuguguccauggccaauaucuuccgcggcaguuaucuggcgggugccggccucgcauuuucucuaaugaaaagccuagggggcgggcggcgagggacgggagcucagggcgagacauugggugaaaaguggaagagacagcugaaccagcucucaaaauccgaguucaauaccuacaagaggagugggauuauggaagucgaccgcagcgaggccaaagagggacuuaagcggggcgaaacuaccaaacacgcagugucuagagguacagcuaagcugcguugguuuguagagaggaacuuggugaagccugaaggcaaaguuaucgaccugggguguggacggggcgggugguccuauuacugcgccggacucaagaaagugacugaggucaagggcuauaccaaaggugggcccggacaugaggaaccgauaccaauggccacauacggcuggaauuuagugaagcugcacucaggcaaagaugucuucuuuaucccucccgagaagugugacacgcuucugugcgauauuggggaaagcucgccaaaccccaccaucgaggaaggacgcacucuacgagugcucaagaugguugagccuuggcugagagguaaucaauucuguauuaaaaucuugaacccguacaugcccucuguaguggagacacuggaacagaugcagaggaagcauggcgggaugcucguccggaauccacuuagucgcaacuccacccacgagauguauugggugagcugcggaacuggcaauauuguuucagcggugaacaugacauccagaaugcuguuaaacagguuuaccauggcucaccgaaaaccuacguacgaacgggacgucgaucugggugcagggacccgucauguggccguagagcccgaaguggcuaauuuggacaucauaggacagagaauugagaacaucaagcacgagcauaaaucuacauggcacuaugaugaagacaauccuuacaagacuugggccuaucauggcagcuacgagguuaagccaaguggcuccgcaagcucuauggucaacgggguggugaaacuccugaccaagcccugggaugucaucccuaugguuacacaaauugccaugacugacaccacaccauucggacagcagcgcguguuuaaagaaaagguagauaccaggacucccaaagcuaagcgggguacggcgcaaauaauggaggugacagccagauggcuauggggcuuccuuucacgcaauaagaaaccgaggaucuguacccgagaagaguuuacucggaaggucagaaguaacgcagcuauuggggccguguucguugacgagaaucaguggaacuccgcaaaagaagccguggaggacgaaagguuuugggaucugguccaccgcgagcgugaacuccacaagcagggaaaaugcgcuaccugcguguauaauaugaugggcaagcgggagaagaaacugggugaguucgggaaggccaaaggaagcagagcgaucugguacaugugguugggcgcaagguuccuggaauuugaggcccucggcuucaugaacgaagaccauugguuuucucgcgaaaauucgcuuucagggguagagggagaaggucugcacaaguuaggcuacauucugcgagauaucagcaaaauaccugggggaaacauguaugcugacgauacagccggcugggacacgcggaucaccgaggaugacuugcagaaugaagcaaagauuacugauaucauggagccagaacaugcucuccuggccaaauccauuuucaagcuaacauaccaaaacaagguugugagaguccagaggcccgcuaaaaaugguaccgugauggacgugaucagucgcagagaucagcgggggucuggacaggucggcacuuauggccuuaacacauuuaccaacauggaggcccaacugauaaggcagauggagagcgaagagauuuucuccccuucagaacucgagacaccaaaucuggcagaacguguuuuggacugguuagagaaguacgggguggagcgacugaaacgcauggcgaucaguggagaugacuguguagugaagcccaucgacgauagauuugccacugcucucaccgcccuuaacgacauggguaaaguccggaaggauauuccgcagugggaaccuucuaagggcuggaaugacuggcagcaagugcccuucugcagccaccacuuucaucagcugauaaugaaagaugggagggagguuguggucccaugucgcaaccaggacgagcuggugggcagagcacggguaucccagggcgcugguuggucacugagggagacggccugccucggaaagagcuaugcacaaauguggcaguugauguacuuccaccgacgugaucugagacuugccgcgaaugcuaucuguucugccguuccuguggacuggguccccaccucccgcacaacuuggaguauucaugcacaccaucaguggaugaccacagaagauaugcugagcguguggaaccggguuuggaucgaggagaauccauggauggaagacaaaacucacgugucguccugggaggauguccccuaucucggaaagagggaagaccaauggugcggcucuuuaauuggccugaccgccagagcuacgugggccacaaacauccagguggcaauaaaucagguacgccgguugaucgggaacgagaauuaccuggacuacaugaccucaaugaaaagguuuaagaacgagagcgauccugaaggagcucucugguga

SEQ ID NO: 14241 - RNA, 9876 nt, Artificial Sequence
  derived and/or modified CDS sequence (opt3) from DENV-1__KF672763__SS-prME
agcgugaccaugcugcucaugcuucugccaacugcauuggcuuuccacuuaacuacgagaggaggggagccucauaugaucgucuccaagcaagaaaggggaaaaucucugcuguuuaagaccucagccgguguuaacaugugcacacucauugccauggaccugggcgagcuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugucggggaaaaggcccugaaacuuucuugguucaaaaagggcuccucaauuggaaaaauguuugaggcuaccgcccgcggcgcaagaaggauggccauccugggggacacagcuugggauuucggaaguaucgguggcguguuuacgagcguagggaaguuggugcaucagguuuucggaaccgccuacggcguccucuuuuccggugugucuuggacuaugaaaauugggaucggcauucuguuaacauggcugggacuaaauagccggucaaccagucucuccaugacauguauagcagugggcauggucacucuguaccuugggguuauggugcaggcggacagcggaugcgugaucaacuggaagggccgagaauugaagugugguucugggauuuucguaaccaacgagguccacacguggacagaacaauauaaauuucaggcugauucaccgaagcgccugagugccgcaaucggacgagcaugggaggagggcgugugcgguaucaggagcgcuacccggcucgaaaauauuauguggaaacagauauccaacgagcugaaucauaucuuacuggaaaacgacauuaaguucacuguuguggucggcaaugccgacgggauccuugcacagggcaaaaagaugauucgcccucaacccauggagcacaaauacucuuggaagucguggggcaaggcuaaaaucauaggggccgauauccagaacaccacauuuauuaucgacggaccagauacuccugaaugucccgacgagcagagagcguggaauauuugggagguggaagauuauggcuucgguaucuuuaccacaaacauaugguugaagcucagggacagcuacacgcagaugugcgaucaccgucugauguccgccgcuauuaaagacucaaaggcaguucaugccgauaugggguauuggaucgagagugagaaaaaugagaccuggaagcuagcucgggccucuuucauugaagugaagacuuguaucuggccaaaaagccacacacugugguccaacggaguacucgagucagagaugauaauccccaagauguacggcgguccuauuagccaacauaauuaucgaccaggcuacuucacccagacugcagggccguggcaccugggaaaacuugaauuggacuuugaucugugcgagggcacaaccgucgugguggacgaacacugcgggucuagaggacccuccuuaaggacgacuaccgucacaggcaagaucauucaugagugguguugccgcaguuguacccucccuccacugcgguucagaggugaggaugggugcugguacggaauggaaaucaggcccguuaaagagaaggaagagaaccuugugcgcagcaugguaucugcgggcuccggugaaguggacucauuuagucugggcauauugugugucagcauuaugaucgaggaggugaugcgaucgcgguggucccguaagaugcucaugacugggacacuggccguuuuccuacugcucaucaugggacagcugaccuggaaugaccuuauuagauugugcaucauggugggcgcuaacgccucugauaaaauggggaugggaacaacuuaucuggcauuaauggcuaccuuuaagaugaggccuauguucgccgucggccuccuguuucgccggcuuacgagcagagaagugcugcuacucacaauuggucugucauugauggcaaguguugagcugccaaauuccuuagaggaacucggggacggacuggccaugggcauaaugaugcuuaaacuguugaccgaguuccaaccccaccagcucuggacuacccugcuaucucugacauuuaucaagacuacccuuagccucgauuacgcuuggaaaacgacagcgauggugcuguccauugucucauuguucccgcuguguuuaagcaccacaagucagaagacaaccuggcucccuguacugcuuggcucuuuugggugcaagccacugacuauguucuugaucacagagaacgagauuuggggaaggaaauccuggccccucaacgaagguaucauggccauaggcaucgugagcauucugcuaucgucacugcuuaagaaugacguuccucucgcagggccccugaucgcuggaggcauguugauugccuguuaugugaucucugguaguuccgccgauuuaagccuggagaaagcugcagaagucucuugggaggaagaggccgagcauagcgggaccucccacaacauacucguggaaguacaggacgauggaacgaugaagauuaaagacgaggaacgagaugacacucugaccauccuucugaaggcgacauugcuagcugugucaggcgucuacccaaugaguaucccugccacccuguuuguuugguauuucuggcagaaaaagaagcagcgcagcggcgugcucugggauacacccucuccaccggagguggagcgggcaguccuggacgaugggauuuacagaauacuucagaggggauuacugggucguucccaggugggcguugggguauuccaagacggaguguuucauacuauguggcacgucacccgcggcgccgugcucauguaucaggguaaacgguuggaaccuucaugggcuaguguuaagaaagaccugaucagcuacgggggaggcuggagauuccagggcuccuggaauacgggggaggaagugcaggucauugcaguggagcccggaaagaaccccaaaaauguacaaacaacucccgguaccuuuaagacaccugaaggcgaggucggggccaucgcgcucgauuucaagccaggaaccucuggcucgcccauugugaacagggaggguaaaaucguugggcuguacggaaauggcguggucacuaccagcggcacauaugugucagcuauagcccaggcaaaggccucccaggaagggccucuuccggagaucgaagacgagguuuuuaaaaagcgaaaccugacgauuauggauuugcacccaggaagugguaaaacucggcgcuaccuacccgcuaucgugagagaagccauuaagaggaagcugcggacccucaucuuagcaccuacacgagucguggcuucugagauggccgaggcgcugaaaggcaugccaauaagauaucaaaccacugccguaaagagcgaacauacagggcgcgagauuguggaccuuaugugccacgcaaccuucacgaugaggcugcucucccccguucgugucccuaauuacaacaugaucaucauggaugaagcucauuuuacugacccggccucaauugcugcacggggauauaucucuacaagagugggcaugggugaggccgccgcuauauucaugaccgcgacacccccagggagcguggaagcauuuccucagaguaaugccgucauucaggaugaggagagggacauccccgaacgcuccuggaacagcggauacgauuggauuacugacuucccaggcaaaacaguaugguuugugccuucuaucaagucaggcaaugauauagcuaacuguuugcggaaaaaugggaagagaguuauucagcuguccagaaagaccuucgacacagaguaucagaaaacuaagaacaacgacugggauuacguggucacgaccgacaucagugaaaugggagccaauuucagggcagaucgcgugaucgacccccguagaugccucaaaccaguuauucugaaggaugguccggagcgggugauccuugccggcccuaugcccgucacaguggcuagcgcggcccagaggcgcgggcgaauuggaagaaaccagaauaaagagggcgaccaguacguauauaugggucaaccacuaaacaaugaugaagaccacgcacauuggacugaggcuaagaugcuguuggauaacauaaauacccccgaagggaucauuccugccuuauuugagccagaacgggagaagucggcagccaucgacggcgaguacaggcugcgcggagaagcuagaaaaacauucguggagcucaugaggcggggcgaucugcccguuuggcuuucuuauaaggucgccuccgaaggguuucaguacagcgaccgucgcuggugcuucgauggagagcgaaacaaucaggugcuggaagagaacauggacguggagaucuggaccaaagaaggugagagaaagaaacucaggccucggugguuggacgcgcgcacuuauucagauccgcuggcacuaagagaauuuaaggaguucgccgcuggcaggcggagugucucuggggaccugauucucgaaauaggaaaacuuccacagcaccugacguuacgagcccaaaaugcuuuggauaaccugguuaugcuccacaauuccgagcagggcgguaaggcauacagacaugccauggaggaacugcccgacaccaucgagacacuuaugcugcucgcuuugauugccgugcugacugggggcguaaccuuauuuuuccuaagcggaaagggccuggggaaaacaucaaucggacuccuuugugugaccgcaaguagcgcgcuguuguggauggccuccgucgaaccucacuggauugcugccucuaucauacuggaguuuuuccucauggugcugcuuauccccgagccagaucgccagaggacuccucaggacaaccaacucgcauauguugugauuggucuguuguuuaugauccugacagucgcugccaaugaaaugggcuuacuagagacgaccaagaaagaucuggggauuggacauguagcagccgaaaaccaccagcacgcuacuaugcucgacguggaucuucaucccgcgagcgccuggacacuguacgcaguugcuaccaccgugaucacaccaaugaugcggcacacuauagagaacacgaccgccaauauuuccuugacagccaucgcaaaccaggcugccauucugaugggccucgacaaggguuggccuaucucaaaaauggaucugggggucccgcuuuuagcgcugggcugcuacucucaagugaauccccucacuuugaccgcugccguccugaugcuaguggcacauuaugccauaaucggaccaggccugcaggcuaaggcaacacgugaagcccagaagagaaccgcggcugggauuaugaaaaacccuacuaucgacggaauuguugccaucgaucucgaccccgugguauacgacgcaaaguucgagaaacagcuuggccaaauaaugcuguugauucuguguacgagucagauccuccugaugaggacaaccugggccuuaugcgagucgaucacucuugcuaccgguccacugacaacucucugggaagggagcccuggaaaguuuuggaauaccacaauugccguguccauggcaaacaucuuccgcggcucuuaucuagcuggugccggccuggcguucucauugaugaaaagccuagggggaggccggcgagggacgggagcccagggcgagacccucggugaaaaguggaagagacagcuuaaucaacuguccaaaagugaguuuaacacuuacaagaggucugggauaauggaagucgaucgcagcgaggcaaaagagggauugaagcggggcgaaacaaccaaacacgcuguuucaagagguacugccaagcugcguugguucguggagaggaaucucgucaagcccgaaggcaaagugauugacuuaggguguggacggggcgggugguccuauuacugcgcaggacugaagaaaguaacagaggugaagggcuauaccaaaggugggccgggacaugaagaaccaaucccuauggcuacguacggcuggaaccuuguuaagcugcacaguggcaaagauguguuuuucaugcccccagagaagugugacacccuacucugcgauauuggggaaagcucucccaauccuacaaucgaggaaggacgcacucugcgagucuugaagaugguggagccguggcugagagguaaccaguuuuguauaaaaauccucaaucccuacaugccauccgucguggagacccuugaacagaugcagaggaagcacggcgggaugcugguucggaacccuuuaucacgcaauagcacacaugagauguauuggguaucgugcggaacuggcaacauugugucugccgucaauaugaccaguagaaugcuguugaacagguucacaauggcccaccgaaaacccaccuacgaacgggacguggaucucggugcggggacucgucauguugcuguggagccugaagucgcaaaccuggacaucauuggacaaagaaucgagaauauuaagaacgagcacaaauccacguggcacuaugaugaagacaauccauacaagacaugggccuaucauggcagcuacgaggugaagcccucaggcuccgcuucuagcaugguaaacggggugguucgccuacuuaccaaaccuugggaugucaucccaauggugacucagauagccaugaccgacacaacgcccuuuggacagcaaaggguguucaaggaaaaagucgacacccggacuccgagagcaaagcgcgguacagcccagauuauggagguuaccgcuaaauggcuguggggcuuucucaguaggaauaagaagccucgaaucuguacucgggaagaguucacaagaaaagugagguccaacgcggccaucggggcaguauuuguggaugagaaucaguggaacagcgcuaaggaagccgucgaggacgaacgcuucugggaucuggugcaccgugagcgggaauugcauaaacagggaaagugcgcaaccugcguuuauaauaugaugggcaaaagagagaagaagcugggugaguuugggaaagccaagggaucuagggcuauuugguacauguggcucggcgcccgcuuccuugaguucgaggcgcugggcuuuaugaacgaagaccacugguucucacgagagaauaguuuauccgggguggagggagaaggucugcauaaauugggcuacauacuccgggauaucagcaagauuccagggggaaacauguaugcagacgauacagccggcugggacacuagaaucaccgaggaugaccugaggaaugaagcuaaaauuacggauaucauggagcccgaacacgcccuacuugcaaccucuauauuuaagcugacauaccaaaacaaagucgugcgcguacagagaccugcuaagaaugguacuguuauggacgugaucucgcggagggaucagcgugggucaggacaggucggcaccuauggccucaacacauucacuaacauggaggugcaacugauucgacagauggagagcgaagggaucuuuuucccauccgaguuggaaagucccaauuuagccgagcgcgugcuggacuggcucgaaaagcacggagcugagagacuuaaacggauggccauuucuggugacgauugugucguuaagccgaucgacgauagguuugcaaccgcgcugauagcccuaaacgacaugggcaaagugcgcaaggauauuccucagugggagcccagcaaaggguggaaugacuggcagcaaguaccauucugcucccaucacuuucaucagcugaucaugaaggauggaagagaaaucguggucccuugucggaaccaggacgagcucgugggcagggcucgaguuucacagggugccggguggaguuugcgugaaacggcaugccugggaaagucuuacgcucaaauguggcagcuuauguauuuccacagacgcgaucugcggcucgccgcaaaugccauuuguagcgcggugcccgucgacugggugccaacauccaggaccacuuggucaauacacgcucaucaccaguggaugacaaccgaggauauguuaagcguauggaacagaguuuggaucgaagagaaucccuggauggaggacaaaacucaugugucuuccugggaagaggucccuuaccugggcaagcgcgaagaccaauggugcggcaguuugauugggcugaccgcccgggcaacaugggccacgaacauccagguggcuauuaaucagguuaggcgacucaucggaaacgagaauuaucuugauuacaugaccagcaugaaaagauuuaagaacgagucggacccagaaggugcccugugg

SEQ ID NO: 14242 - RNA, 9876 nt, Artificial Sequence
  derived and/or modified CDS sequence (opt3) from DENV-1__KF672764__SS-prME
agcgugaccaugcugcucaugcuucugcccacagcauuggcuuuccacuuaacuacgagaggaggggaaccucauaugaucgucuccaagcaggaaaggggaaaaucucugcuguuuaagaccucagccgguguuaacaugugcacacucauugcaauggaccugggagaacuuugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggcagagcuugggaggagggcgucugcgguaucaggagcgccacccggcucgaaaauauuauguggaaacagauauccaacgagcugaaucauaucuuacuggaaaacgacauuaaguucacugugguugugggcaaugcaaacgggauccuuacccagggcaagaagaugauucgcccucaacccauggagcacaaauacucuuggaagucguggggcaaggcuaaaaucauaggggccgacauccagaauacaacuuuuauuaucgauggaccagacaccccugaaugucccgaugagcagagagcguggaacauuugggaggucgaagacuauggcuucgguaucuuuacaacgaauauaugguugaagcucagggauagcuacacccagaugugcgaccaccgucugauguccgccgcuauuaaagauucaaaggcagugcaugccgacaugggguauuggaucgagagugagaagaaugagacuuggaagcuagcucgggccucuuucauugaaguuaagacauguaucuggccaaaaagccacacccugugguccaauggagugcucgagucagagaugauaauccccaagauguacggcgguccuauuagccaacauaacuaucgaccaggcuacuucacucagacagcagggccguggcaccugggaaaacuugaauuggauuuugaccugugcgagggcaccacgguagucguggaugaacacugcgggucuagaggacccuccuuaaggacuaccacagugaccggcaagaucauucaugagugguguugccgcaguuguacucucccuccacugcgguucagaggugaggacgggugcugguacggaauggaaaucaggcccgucaaagagaaggaagagaaucuuguuaagagcauggugucugcgggcuccggugaaguagauucauuuagucugggcauauugugugugagcauuaugaucgaggaggucaugcgcucgcgauggucccggaaaaugcucaugacagggacccuggccguguuccuacugcucaucaugggacagcugacauggaacgaccuuauucguuugugcaucaugguuggcgcuaaugccucugacaagauggggaugggaacuaccuaucuggcauuaauggcuacguuuaaaaugagaccuauguucgccgugggccuccuguuuaggcgccuuacaagccgggaaguccugcuacucaccauuggucugucauugguggcaaguguugagcugccaaacuccuuagaggaacucggggauggacuggccaugggcauaaugaugcuuaagcuguugacugaguuccaaccccaccagcucuggaccacacugcuaucucugacuuuuaucaaaaccacgcuuagccucgacuacgcuuggaagacaaccgcgauggugcuguccauugucucauuguucccgcuguguuuaagcacuacaagucagaagaccacuuggcucccuguacugcuuggcucuuuugggugcaaaccacugacaauguucuugaucaccgagaacaagauuuggggaagaaaauccuggccccucaaugaggguaucauggccauaggcaucgugagcauucugcuaucgucacugcuuaagaacgauguuccucucgcagggccccugaucgcuggaggcauguugauugccuguuaugugaucucugguaguuccgccgacuuaagccuggaaaaagcugcagaggucucuugggaagaggaagccgagcauagcgggacgucccacaauauacucguggagguacaggaugacggaacuaugaagauuaaagaugaagagagggacgauacccugacaauccuucugaaggcgaccuugcuagcugugucaggcgucuacccaaugaguaucccugccacacuguuuguuugguauuucuggcaaaagaaaaagcagcgaagcggcgugcucugggacacucccucuccaccggaaguggagcgcgcaguccuggaugacgggauuuaccggauacuucagagaggauuacuggguaggucccaggugggcguugggguauuccaagauggaguguuucauaccauguggcacgucacgcguggcgccgugcucauguaucaggguaaacgcuuggagccuucaugggcuaguguuaagaaagaccugaucagcuacgggggaggcuggcgguuccagggcuccuggaacacaggggaagaggugcaggucauugcaguggaacccggaaagaauccaaagaacguacaaacuacccccgguacauuuaaaaccccugagggcgaagucggggccaucgcgcucgacuucaagccaggaacuucuggcucgcccauugugaauagagaggguaaaaucguugggcuguacggaaacggcguggucaccacaagcggcacguaugugucagcuauagcccaggcaaaggccucccaggaggggccucuuccggaaaucgaggaugaaguuuuuaaaaagaggaaucugacuauuauggacuugcacccaggaagugguaagacccgacgguaccuacccgcuaucgugcgcgaggccauuaaaagaaagcugaggacacucaucuuagcaccuacccgggucguggcuucugaaauggccgaggcgcugaaaggcaugccaauacgauaucaaacuacagccguaaagagcgagcauaccgggagagaaauuguggaucuuaugugccacgcaacguucacuaugcgccugcucucccccguuagggucccuaacuacaauaugaucaucauggacgaggcucauuuuacagauccggccucaauugcugcacguggauauaucucuacccgggugggcaugggugaagccgccgcuauauucaugaccgcgacucccccagggagcguggaggcauuuccucagaguaacgccgucauucaggacgaagagagagauauccccgagagguccuggaauagcggauacgacuggauuacagauuucccaggcaaaaccguaugguuugugccuucuaucaagucaggcaacgacauagcuaauuguuugcgcaagaacgggaaacgaguuauucagcuguccagaaagacauucgauacugaauaucagaaaacgaagaacaaugacugggacuacguggucaccacagauaucagugagaugggagccaacuuccgggcagacagggugaucgauccccgccguugccucaaaccaguuauucugaaggacgguccggaaagagugauccuugccggcccuaugcccgucacuguggcuagcgcggcccagcggagggggcgcauuggacgaaaucagaacaaggagggcgaucaguacguauauaugggucaaccacuaaauaacgacgaggaucacgcacauuggaccgaagcuaaaaugcuguuggacaauauaaacacacccgaggggaucauuccugccuuauuugaaccagagagagaaaagucggcagccaucgauggcgaguaccggcugaggggagaggcucgcaaaaccuucguggaacucaugagaaggggcgaccugcccguuuggcuuucuuauaaggucgccuccgagggguuucaguacagcgaucggcguuggugcuucgacggagaacgcaauaaccaggugcuggaggaaaauauggauguggagaucuggacuaaagagggugaacgaaagaaacucagaccuaggugguuggacgcgcggacguauucagacccgcuggcacuacgcgaguuuaaggaguucgccgcuggcagaaggagugucucuggggaucugauucucgagauaggaaaacuuccacagcaccugaccuuacgggcccaaaacgcuuuggacaaucugguuaugcuccacaacuccgaacagggcgguaaagcauaccgacaugccauggaggagcugcccgauacaaucgaaacucuuaugcugcucgcuuugauugccgugcugaccgggggcguaacauuauuuuuccuaagcggaaagggccuggggaaaaccucaaucggacuccuuugugugacugcaaguagcgcgcuguuguggauggccuccgucgagccucacuggauugcugccucuaucauacuggaauuuuuccucauggugcugcuuauccccgagccagacagacagcgcacaccucaggauaaucaacucgcauauguugugauuggucuguuguuuaugauccugacggucgcugccaacgagaugggcuuacuagaaaccacuaagaaagaccuggggauuggacauguagcagccgagaaccaccagcacgcuacaaugcucgauguggaccuucaucccgcgagcgccuggacccuguacgcaguugcuaccacagugaucacuccaaugaugaggcacacgauagaaaauaccacagccaacauuuccuugacugccaucgcaaaucaggcugccauucugaugggccucgauaaggguuggccuaucucaaagauggaccugggggucccgcuuuuagcgcugggcugcuacucucaagugaacccccucaccuugacagcugccguccugaugcuaguggcacauuaugccauaaucggaccaggccugcaggcuaaagcaacccgggaggcccagaagcguacugcggcugggauuaugaaaaauccuacgguugauggaaucguggccauugaccucgaucccguaguguacgacgcaaaguucgaaaaacagcuuggccaaaucaugcuguugauacuguguacaagucagauucuccugaugagaaccacuugggccuuaugcgagucgaucacccuugcuacagguccacugacuacccucugggaggggagcccuggaaaguuuuggaacacaacgaucgccgucuccauggcaaauauuuucaggggcucuuaucuagcuggugccggccuggcguucucauugaugaaaagccuagggggaggccgccgggggaccggagcccagggcgaaacucucggugagaaauggaagcgacagcuuaaccaacuguccaaaagugaauuuaauacauacaagagaucugggaucauggagguugacaggaccgaagcaaaagagggauugaagcgcggcgagacuacaaagcacgcugugagccgggguaccgccaaacugagaugguucgucgaacguaaccucgugaagcccgagggcaaaguaauagauuuaggguguggaaggggcggguggucauauuacugcgcaggacugaagaaagugacggaaguuaagggcuauaccaaaggugggccgggacaugaggaaccaauuccuauggcuacauacggcuggaaucuugugaagcugcacuccggcaaggacgucuuuuucaugcccccagagaaaugugauacucuacucugcgacaucggggagaguagccccaacccuaccauugaagagggacggacacugcgcguguugaagauggucgaaccguggcugcgagguaaucaguuuuguaucaaaauacucaaccccuacaugccaucugugguugagacucuugagcagaugcagagaaagcacggcgggaugcugguaaggaauccuuuaucccggaacucaacccaugaaauguauugggugagcugcggaacaggcaauaucgucucggccgugaacaugaccucucgcaugcuguugaacagauucacuauggcccacaggaaacccacguacgagcgagauguugaccucggugcggggacacggcauguggcugucgaaccugagguggcaaaucuggauauuaucggacaacguauugaaaacaucaagaaugagcacaagaguaccuggcacuaugacgaggauaacccauacaaaacuugggccuaucauggcuccuacgaaguaaagcccagcggcucagcuuccucuauggugaaugggguugucagacuacuuaccaaaccuugggacgugauuccaauggugacacagaucgccaugacggauaccacucccuuuggacagcaacgcgucuucaaggagaaaguugacacaaggaccccgcgggcaaagagagguacugcccagauaauggaagugacagcuaaguggcuguggggcuuucucagccgcaacaaaaagccuaggauuuguacccgagaggaguucacacggaaaguaagaaguaaugcggccaucggggcaguguuugucgacgagaaccaguggaacuccgcuaaggaggccguggaagaugagagguucugggaccugguucaccgcgaacgugaguugcauaaacagggaaagugcgcaacuugcguguauaacaugaugggcaagcgggagaaaaagcugggugaguuugggaaagccaagggaagcagagcuaucugguacauguggcucggcgccagguuccuugaguucgaagcgcugggcuuuaugaaugaggaucacugguucucucgcgaaaacucauuaaguggggucgagggagagggucugcauaaauugggcuacauucuccgagacauauccaagaucccagggggaaauauguaugcagaugacaccgccggcugggauacgcggauuaccgaagacgaucugcaaaacgaggcuaaaaucacagacauuauggaacccgagcacgcccuacuugcaacuagcaucuuuaagcugaccuaccagaauaaggugguaagaguucagaggccugcuaaaaacgguacagugauggaugucauaucucgcagagaccagcgggggucgggacaagugggcacuuauggccucaacaccuucacgaauauggaagugcagcugaucaggcagauggagucagaggggauauuuuucccaagcgaauuggagucccccaacuuagccgaacguguccuggauuggcucgagaagcacggagcugaacgacuuaaacgcauggccaucaguggugacgacuguguugugaagccgauugaugacagauuugcaacagcgcugaucgcccuaaaugauaugggcaaaguacggaaggacauaccucagugggagcccucuaagggguggaacgauuggcaacaggugccauucugcagccaucacuuucaucagcugauuaugaaagacggaagggagaucgucgugccuugucgcaaucaggaugaacucguuggcagagcucgggugucccaaggugccggguggucauugagggagaccgcaugccugggaaagaguuacgcucagauguggcagcuuauguauuuccaccgacgugaccugagacucgccgcaaacgccaucuguucugcgguccccguggauuggguaccaacuagccgcacaaccugguccauucacgcucaucaccaauggaugacuaccgaagacauguuaucaguuuggaaucggguguggauagaggaaaaccccuggauggaggauaaaacacaugucagcucuugggaggaagugccuuaccugggcaagagggaggaccaguggugcggcuccuugaucgggcugacggccagagcaaccugggccacuaauauucagguugcuaucaaccaggugcgccggcucauuggaaaugaaaacuaucuugacuacaugacaaguaugaaaagguuuaagaaugagagcgauccagagggugcccugugg

SEQ ID NO: 14243 - RNA, 9879 nt, Artificial Sequence
  derived and/or modified CDS sequence (opt3) from DENV-1__EU863650__SS-prME
agcgugaccaugcugcucaugcuucugcccacuguauugacuuuccacuuaacgaccagaggaggggagccucauaugaucguuuccaagcaggaaaggggaaaaucucuguuauuuaagaccucagccggugugaauaugugcacucucauugcuauggaccugggcgagcuuugugaugacaccaugacauacaaaugcccacggauaaccgaaacugagccggaugacguagauuguuggugcaaugcaacagaaaccugggugacguaugggacuuguagucaaaccggagagcaccgccgagacaagcguuccgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaacagagauuuuguagaggguuugagcggcgccaccuggguugacgugguccuggagcacgggaguugugugacuacaauggcuaaggauaaacccacccuggacaucgaacuccugaagacggaggugaccaauccugccguccuuaggaaacugugcauugaagcgaagaucuccaacacaacuaccgauucucgguguccaacacaaggagaggcaacuuugguugaagaacaagacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaucuggcgcuuccaccucacaagagacauggaaccggcaggacuugcucguuacuuucaaaaccgcccacgcgaagaagcaggaaguggucgugcuggguagccaagagggggccaugcacacggcauuaaccggcgcuacagaaauucagacaaguggaaccacaacuauauuugccggccaucugaaaugccgucuaaagauggauaaacucacccugaaggggaucucuuaugucauguguacgggacuuuucaaauuggagaaggaaguggcugagacacagcacgguaccguucuggugcagguaaaguacgagggcacugacgccccuugcaaaauuccauucuccagccaagaugaaaagggggcaacacagaauggacgccucgucaccgccaaccccaucgugacugacaaagagaagccuguuaauauagaagcugagccacccuuuggcgagucguauauuguggucggugcgggggaaaaagcacugaaacuuucuugguucaagaaaggcuccucaaucggaaagauguuugaggccaccgcuagaggcgccaggcggauggcaauccugggggauacagccugggacuucggaaguauugguggcguguuuacgagcguagggaaauuggugcaucagaucuucggaaccgcuuacggcguucucuuuuccggugucucuuggacuaugaagauugggauaggcauccuguuaacauggcugggacuaaacagccgaucaaccagucucuccaugacauguauugccgugggcauggugacucuguaccuuggggucaugguucaggcagauagcggaugcgugaucaauuggaaaggccgcgaauugaagugugguucugggaucuucgugaccaacgagguacacacguggacagaacaauauaaguuucaggcggacucaccgaaaagacugagugcugccauuggaaaggcaugggaggagggcgucugcgguauaaggagcgccacccggcucgaaaacaucauguggaaacagauuuccaaugagcugaaccauaucuuacuggaaaaugacaugaaguucacugugguugugggcgaugucucugggauucuugcucagggcaagaagaccauccgcccucaacccauggagcacaaauacucguggaaaagcuggggcaaggccaaaauaaucggggcagacgugcagaacacaacuuuuauuaucgauggaccaaauaccccugaaugucccgacgaucagagagcuuggaacauuugggagguugaggacuauggcuucgguaucuuuacaacgaauauaugguugaagcucagggauuccuacacccaggugugcgaccaccgucugaugucagccgcgauuaaagauaguaaggccguacaugcugacaugggguauuggaucgaaucugagaaaaacgaaacuuggaagcuagcacgggccagcuucauugaggucaagacauguguguggccaaaaucccacacccuguggucacauggagugcucgaaagcgagaugaucauacccaagaucuacggcgguccuauuucucaacacaauuaucgaccaggcuacuucacucagacagcugggccguggcaccugggaaaacuugaguuggauuuugaccugugcgaaggcaccacggucguuguggaugagcauugcgggaacagaggacccuccuuaaggacuaccacaguaaccggcaagaucauucacgaaugguguugccgcaguuguacucucccuccacugcgguucaaaggugaggacgggugcugguacggaauggagaucagacccgugaaggaaaaggaggaaaaucuugucaaaagcauggugucugccggcuccggugagguugacucauuuagucugggcuugcucuguauaagcauuaugaucgaagaggugaugaggucgcgcuggucccgaaagaugcugaugacagggacccuagucguguuccugcuccugacacuuggacaguugacuuggaacgaucugauccgguuaugcauuaugguuggcgcaaaugcgucugacaacauggggaugggaaccacguaucucgcccugauggcuacauuucguaugagaccuauguucgccgugggccuucuguuuaggcgccuaaccagccgggagguccuccuguugacuguaggucugucauuaguggcaaguguugaacucccaaauucccuggaugagcuuggggacggacuggcuaugggcaucaugauuuugaaacuccugaccgauuuccaaucucaucagcuaugggccacacugcuuagccucacuuuugugaagaccacgcuguccuugcacuacgcauggaaaacaauggccaugauacugucaaucgucagcuuacucccccugugucuuaguaccacuucucagaagacaaccuggcugccgguguugcucggcucccuggggugcaagccucuaacuauguuccugauuacagaaaacaaaaucuggggaagaaagagcuggccacuuaacgaggguauuauggcuguaggcaucgugucgauacuccugucaucuuugcuaaagaaugacgucccccuggcggggccucucaucgccggaggcaugcugauugcauguuauguuaucagugguuccagcgcugaucuuucucuggaaaaggccgccaaagugagcugggaggaggaagcugagcauuccggggcaucacacaacauuuugguggaaauccaggacgauggaaccaugaagauaaaagacgaggaaagggaugacacgauuacuauccuacugaaggccacccuccuggcgaucaguggcgucuaccccaugagcauuccagcuacacuuuuuguguggcacuucuggcaaaagaaaaagcagcgaucuggcguuuuaugggauaccccuucacccccagagguagagaaagccgugcuggacgacgggauauaucgcauccuccagcggggauugcuggguagaagccaggucggcguggggguuuuucaagaaggaguguuccauacaauguggcacgucacuaggggcgcagugcucauguaccaggguaagcgucuggagccgaguugggccagcgucaaaaaggaucuuauuuccuaugggggaggcuggcgcuuccagggcucuuggaauaccggggaagagguccaggugaucgcuguugagccuggaaagaaccccaaaaaugugcaaacggcaccagguacauuuaagacuucggaaggcgaggucggggccauugcgcuggacuucaaacccggaaccagcggcucaccuaucgugaaccgggaagguaagauaguuggguuguacggaaauggcguggucacaaccuccggcacuuacgugagugcuaucgcccaggcaaaagccucucaggaggggccacuacccgaaauugaggaugagguauuuagaaagaggaaccugaccaucauggaccuccauccuggaagcgguaagacacgacgguauuuaccggcuauugugcgcgaagccaucaaaagaaagcugaggacgcuuguucuggcaccaacucgggucguggcuuccgagauggccgaagcgcucaaaggcaugcccauacgauaccaaaccacagccgugaagucagagcacaccgggaaagaaauugucgauuugaugugccaugcaacuuucacaaugagacugcucucuccuguacgcgugccaaauuauaacaugaucaucauggacgaggcucacuuuaccgaucccgccagcauugcugcaaggggauacaucaguacgcguguuggcaugggugaggccgccgcuauauucaugacugcgacaccuccgggguccguggaagcauuuccccagagcaaugccgucauucaggacgaggaaaaggauaucccagagcggucuuggaacucaggauaugacuggauuaccgauuucccuggcaagaccgugugguuuguucccuccaucaaaaguggcaaugacauagcuaacugucugagaaagaaugggaaaagggugauucagcuuagccgcaagacuuucgacacagaauaccagaaaaccaagaacaacgauugggacuaugucgugacaacugauaucucggagaugggagccaauuuucgagcagacagaguaaucgauccacggaggugccuaaagccugugauucugaaagacggucccgagcgcguuaucuuggccggcccaaugccggucacgguggcuucugcggcccagcguagagggcggauuggaaggaaccagaauaaggaaggcgaucaguacauauacaugggucaaccuuuaaacaaugacgaggaucacgcacauuggaccgaagcuaaaaugcugcucgacaacaucaauacacccgaggggauuaucccagcccuguucgagcccgaacgcgagaaguccgcagccaucgauggcgaauaucgacuuagaggagaggcucggaaaacuuucguggaacugaugaggcgcggcgaccucccugucugguugagcuacaagguugccucagagggguuucaguauagugauagaagguggugcuucgacggagagcggaacaaucaggugcuggaagagaacauggacguagaaauuuggaccaaagagggugaacguaagaagcuacgcccacgauggcuggaugcgagaacauacucugacccccucgcacuuagggaguuuaaagaguucgccgcuggccggcgcuccgugagcggggaucugauauuagaaaucggaaaguugccucagcaccugacccaaagagcccagaaagcucucgacaaucuggucaugcuucauaacucagagcagggcgguaaggcauauaggcacgccauggaggaacugccggauacuauugaaacgaucaugcucuuggcucugauugccguguuaaccgggggcguuacacuauuuuuccugaguggacggggccucgggaaaacuagcaucggacuucugugugugaccuccucuagcgcauugcuguggauggcguccgucgagccacacuggauagccgcuucaaucauucucgaguuuuuccugaugguacuucucauccccgaaccugaccgacagagaacaccccaagauaaucagcuggccuacgugguuauugguuugcuguuuaugaucuuaaccguggcagcuacugagaugggccuacuggaaacaacgaagaaggaccucgggauaggacaugccgcagccgagaaccaccaucacgcugcgaugcuugaugucgaccugcauccagccucugcauggaccuuguaugcuguggccacuacaauuaucaccccuaugaugcgccacaccauugagaauacaacugccaacaucagucugacggcaauagcuaaccaggccgcgauccucaugggccuggauaaagguuggcccauuucgaagauggacaucggggucccacuuuuagcucugggcugcuacagccaagugaauccucucaccuugacagccgcaguucugaugcuaguggcccacuacgcuauuaucggaccgggccugcaggcaaaagccacuagggaagcgcagaagcggaccgcugccgggauaaugaaaaaccccacaguagauggaauuguggcaaucgaccucgacccagucguuuaugaugccaaguucgagaagcagcuuggccaaaucaugcuguugauucuguguaccucccagauccuccugaugcguacuacgugggcuuuaugcgaaucuauaacacuugccaccgguccucugacuacccucugggaggggucacccggaaaauuuuggaauacaacuauugcagugagcauggcuaacaucuucagaggcuccuaccuagccggugcgggccuggccuuuaguuugaugaagucucuagggggaggcaggcgcgggaccggagcacagggcgaaacacucggugagaaauggaagcggcagcuuaaucaacugagcaaaucagaguucaagacguauaagcgauccgggauuaucgaagucgacagaagugaggcuaaagaaggauugaagaggggcgagaccacuaaacaugccgugagccgcgguacagcaaagcugcggugguucguagaaagaaaccucgugaaaccagagggcaagguuauagauuuaggguguggacguggcggguggucuuacuauugcgcuggacugaaaaaggugaccgaggucaagggcuccacuaaaggugggccuggacacgaggagcccaucccgauggccacauacggcuggaaucuugugaagcugcauucaggcaaagacgucuuuuucauuccaccugaaaagugugauacccuacucugcgacaucggggagagcucgcccaacccaacgauugaagagggaaggacccugcggguguugaaaaugguugagcccuggcugcgcgguaaucaguuuuguaucaagauucucaacccuuauaugccgucuguaguggaaacacuugagcagaugcagcgaaagcacggcgggaugcuggucagaaaucccuuaaguaggaacuccacucacgaaauguacugggugagcugcggaaccggcaauaucguuucagccgugaacaugacaucccggaugcuguugaaucgcuucacuauggcgcauagaaaaccaaccuacgagagggaugucgaccucggugcugggacacgacacguggcaguagagccugaaguggccaaccuggauauaauuggacaacggaucgagaauaucaagaacgaacauaaaucuaccuggcacuaugacgaggauaaccccuacaagacuugggcuuaucauggcagcuacgaaguuaaaccuaguggcuccgccagcucuauggucaaugggguggugcgucuacuuacgaagccaugggacgucauucccaugguuacacagauagcaaugaccgacacuaccccuuuuggacagcaaagaguguucaaggagaaaguagauacacgcacgccaaaggccaaaagggguaccgcucagaucauggaggugacugcgaaguggcuguggggcuuucucucacggaacaaaaagcccagaauuuguacacgcgaagaguucaccaggaagguccgaaguaaugccgcaaucggggcuguguuuguugacgaaaaccaguggaacuccccgaaagaggccguggaagaugagcgguucugggaccugguccacagagagagggaauugcacaagcagggaaaaugcgcaacuugcguguauaacaugaugggcaagcgcgagaaaaagcugggugaauuugggaaagccaagggaagccgugcuauuugguacauguggcucggcgcccgguuccuugaguuugaagcgcugggcuucaugaaugaggaucauugguucucuagagagaacucguuaucagggguagaaggagagggucugcacaaguugggcuauauccucagggacauaagcaaaaucccugggggaaauauguacgcagaugacacagccggcugggauacccgcauuacagaagacgaucugcaaaacgaggcuaagaucacugacauuauggagccagaacaugcccuacuugcaaccuccaucuuuaaacugacguaccagaauaagguugugcgaguccagcggcccgcuaaaaacgguaccgugauggaugugauaaguagaagggaccagcgcgggucuggacaagucggcacauauggccucaauacuuucaccaacauggaggcccagcugauuagacagauggaaagcgaggggaucuuuuugccuuccgaauuagagccacccaaucuggcuggacggguuccggacuggcucgagaagcacgguacagaaaggcuucgucgaauggccaucucaggcgaugacugugugguaaagccuauugaugaccgcuucgcaacugcgcugaccgcccuaaacgauauggggaaagugagaaaggacauaccccagugggagccaaguaaaggauggaacgauuggcaacaggucccuuuuugcucucaccauuuccaccagcugaucaugaaggacggccgggaaauugugguucccuguaggaaucaggaugagcucgugggucgcgcuagagucagccaaggggccggaugguccuugcgggaaacggcaugccugggcaaaucauacgcucagauguggcagcuuauguauuuucauaggcgagaccugcgucucgccgcaaacgccaucuguagcgcggugccaguagauuggguucccacaucuagaaccacuugguccauucacgcucaucaccaauggaugacaaccgaggacauguuaaguguguggaaucgcgucuggaucgaggaaaacccuuggauggaggacaagacucacgugagcucgugggaagauguuccauaccugggcaagcgggaggaccaguggugcggguccuugauaggacugaccgccagggcaacaugggccacgaauauccagguggcuauuaaccaggucagacgccucaucgguaaugaaaacuaucuugauuacaugaccucuaugaaacgguucaagaaugagucagacccggagggcgcccugugguga

SEQ ID NO: 14244 - RNA, 9879 nt, Artificial Sequence
  derived and/or modified CDS sequence (opt3) from DENV-1__KU365900__SS-prME
agcgugaccaugcugcucaugcuuaugcccacugcacuggcuuuccacuugacuacgagaggaggggaaccucauaugaucgucuccaagcaggaaagggggaaaucuuuacuguuuaagaccucagccgguguuaauaugugcacacuaauugccauggaccucggagaacugugugaagauacuaugaccuacaaaugcccacggaucacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguggacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggagcacaaauacucguggaaaagcuggggcaaggcgaagauaaucggggccgacgugcagaauacuaccuuuauuaucgauggaccaaacacaccugaaugucccgacgaucagagagcuuggaauauuugggaggucgaggacuauggcuucgguaucuuuacuaccaacauauggcuuaaguugagggauuccuacacacaggugugcgaccaccgucucaugucagcagccauuaaagauaguaaggcuguucaugccgacaugggguauuggaucgaaucugagaaaaaugaaacguggaagcuggcacgggcgagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgccgggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucagaggugaggacgggugcugguacggaauggagauaaggcccguuaaagaaaaggaggaaaaucugguaaagagcaugguaucugcuggcccuggugagguggacuccuuuucacuuggccuguuguguauuaguaucaugaucgaagaggucaugcgcagccgauggucgcggaaaaugcucaugaccgggacucuggccguguucuuucuacugauuaugggacagcucacauggaacgaucugauccgucuuugcauuaugguuggcgcaaaugcuuccgacagaauggggaugggaaccacauauuuggcccugauggcaacuuucaagaugaggccaauguuugccgugggcuuacuccugcgccggcuuaccucuagagagguccugcuacucacgauaggucugagcuugguggcuucaguugaacugcccaacaguuuagaggaacucggggauggacuggcgaugggcaucaugauucuuaaacuguugacagacuuccaaucccaccagcucugggccacccugcuaucucugacuuuuaucaagaccacauucagccuucauuacgcauggaaaacuauggcuauggugcucuccauugucucacuguuuccguugugucugagcaccacgagucagaagacaaccugguuaccuguacuccugggcucucuugggugcaagccacugacuauguucuugaucgccgagaauaaaauauggggaaggaaguccuggccccucaacgaagguaucauggccgugggcauuguuagcauccugcuaucgucacugcuuaaaaacgaugugccucucgcugggccccugauugcaggaggcauguugaucgccuguuaugucauaucugguaguuccgcggacuuaagccuggagaaggcugccgaggugucuugggaagaggaagcagagcacagcggggccucccauaauauucucguagaagugcaggaugacggaacaaugaaaaucaaggaugaggagcgagacgauacccugacuauccuucugaaagcuacauugcuagcagucucaggcguuuacccacugaguauuccugccacccucuuugugugguauuucuggcaaaagaagaaacagcgcagcggcgugcugugggacacgcccucuccaccggaagucgagcgggcggugcuugaugacgggauauacagaaucaugcagaggggauuacugggucguucccagguuggcguagggguguuccaagaaaacgucuuucacacuauguggcacgugacccgcggagcuguucucauguaucagggcaagcgguuggagccuucaugggccagugugaaaaaggaccugauuagcuacggugggggauggagacuccagggcuccuggaauacaggcgaggaaguccaggugaucgcaguagagcccgggaaaaacccaaagaauguccaaaccgcccccggaacauucaagacuccugaaggugaggugggcgcuauugcccuggauuuuaaaccagggaccucuggaucgcccaucguuaacagggaaggcaagauagugggucuuuacgggaauggagucgugacgacaagcggcacuuauguuucagcaaucgcucaggccaaagcgucccaggagggcccucugccggagauugaagacgagguguuccgaaagcggaacuugaccaucauggaucuacauccagggaguggaaaaacacgcagauaccugcccgccauugucagggaagcaaucaagcggaagcuccgaaccuuaauacuggcuccuacuagagugguagccucugagauggcugaagcacuuaaagguaugccaauucgcuaucaaaccacagccguaaagagcgagcacacgggcaaagagaucguugaccugaugugccaugccacuuuuaccaugaggcucuugucccccguccgugugccuaauuacaacaugaucauuauggaugaagcucacuucacagacccgucaucuaucgcggcacggggguauauaagcaccagagugggaaugggcgaggccgcugccauuuuuaugacugcaacacccccagguagugucgaagccuucccucaguccaaugcuguaauccaggaugaggaaagggacauucccgagcgcagcuggaacucuggguacgaguggaucaccgauuuuccaggaaagacggugugguucguuccuucaauaaaauccggcaaugacauugcgaacugucugcgaaagaauggcaagagagugauccagcucagucggaaaacuuuugauacagaauaucaaaagaccaaaaacaacgacugggacuacgucgugaccacugauaucagcgagaugggggccaauuucagggcagaccgcguuauugauccccguagaugccugaagccagugauccuuaaagacggaccggaacgggucauucuagcugguccuaugcccgugacaguagccucggcagcccagaggcgcggccgaauagggagaaaccauaauaaggagggagaucaguacaucuauaugggccagccacugaacaaugacgaggaucacgcucacuggaccgaagccaagauguuguuagacaacauuaauacacccgaggguaucaucccugcgcuguucgaaccagagcgggaaaaaucugcagccauugauggggaguacaggcuccgcggcgaggcuagaaagacuuuuguggaacugaugaggcggggagaccuucccguuuggcuguccuauaaagucgccagcgagggcuuccaauacucagaucguaaguggugcuuugacggggaacgcaacaaucaggugcucgaggaaaacauggauguggagauauggacgaaagagggagaacgaaagaaauugagaccuagguggcuggacgcucggaccuauagugacccgcuagcacugcgcgaguucaaggaauuugccgcugguagaaggucugucuccggcgaucucauccuugagauugggaagcugccacagcauuuaacacagcgggcccaaaaugcauuggacaaccugguuaugcuccacaauagcgaacagggaggccgagcguacagacaugccauggaggagcugcccgauacuaucgaaacccuuaugcugcucgcuuugauugccgugcugacaggugggguaaccuuauucuuucuaucaggccgcggacugggcaaaacaaguaucgggcuccuuugugugauggcaagcuccguccuguuguggauggcuucuguggagccucacuggauagccgcaagcaucauucuggaguucuuucucaugguucugcuuauccccgagccagacaggcagcggacgccucaggauaaccaacucgccuauguggucauuggacuguuguucaugauccugaccguagcugcgaaugagauggguuuacuagaaacaacuaagaaagaccugggcauagggcacguggccguugagaaccaucaccaugcaaccaugcucgauguggaccuucaccccgcuuccgccuggacacuguacgccgucgcaaccacuauuaucacaccaaugaugcgucauacgauugaaaacaccacugcuaauaucucauugacagccauagcgaaccaggcugccauccugaugggacucgauaagggcuggccuauuucuaaaauggacaucggugugccgcugcuugcauuagggugcuacagucaggucaauccccugacccucaccgccgcuguguugaugcugguugcacacuaugccauuaucggcccaggacuacaagcgaaggcuacaagagaggcccagaagaggacugcagccggcauaaugaaaaacccuacgguggaugggauuguagcuaucgaccuggaucccguggucuacgacgccaaguuugaaaaacagcucggacagaucaugcuucugauuuuguguaccucgcaaauccugcucaugcgcacaacuugggcacugugcgagagcauaaccuuagcuacaggcccacuuaccacucugugggaggguuccccugggaaguucuggaauacgacaauugccguuucuauggcgaacaucuuucggggaucauaucucgccggcgcaggucuagcuuucagccugaugaaauccuugggcgggggacgaagaggcaccggggcccagggagaaacucugggcgagaaguggaagaggcagcucaaucagcuuaguaaaucugaguucaacaccuacaagcgcagcgguauuauggagguggaccggucagaagcaaaagaggggcugaagagaggagagacaacuaaacacgcugucucccguggcaccgccaaguugaggugguuuguggaacggaaucugguaaagcccgaggguaaagugaucgaucucggcugugggcgcggaggcuggaguuauuacugcgccggguuaaagaaaguuacagaagugaagggauauacgaaaggcgguccggggcaugaggaaccaauaccuauggcgaccuacggauggaaccuggucaaacuuuacagcggcaaagacguguucuuuauacccccagagaagugugauacucugcuaugcgacauuggcgagucuucccccaauccuacaaucgaagaggggcgaacccucagaguccugaagaugguggaaccgugguugaggggaaaccaauucuguauuaaaauccugaaucccuauaugccaucaguuguagagacucucgagcagaugcagcggaagcacgguggcaugcuugugcgcaacccucugagcagaaauucgacacaugaaauguacugggucucuugcgggaccggaaacauugugagugcuguuaauaugacguccaggauguuacugaaccgauuuaccauggcacaccggaaacccacauaugagaaggauguggacuugggcgccgguacucgucacgucgcuguggaaccugagguagccaaccucgauaucauagggcagagaauugaaaauaucaaacaugagcacaagagcaccuggcauuacgacgaggauaacccauauaagacaugggcauaccacggaucauaugaagugaaacccuccggcucugccagcaguaugguuaauggcgucgugaagcugcuaacuaaaccuugggacgugaucccaauggucacccaaauugcuaugacagauaccacucccuucgggcagcagcgcguuuuuaaggagaaaguggacacgaggacaccgaaggcgaagcggggaaccgcccaaauaauggaaguaacugcaagauggcuuugggguuuccugucccgcaacaaaaagccuaggaucuguacccgagaggaauuuacacggaaagugagaagcaaugcugccauuggcgcagucuucaucgacgagaaccaguggaacucugccaaggaggcuguggaagaugagagguuuugggaccucguucaucgcgaacgugagcugcacaaacaggggaagugcgccacgugcguguacaacaugaugggaaagcgggagaagaaguugggcgaguucgguaaagcgaaggggucaagagcaauuugguacauguggcugggagccagguuucucgaguucgaagcucuuggcuucaugaaugaggaucacugguuuagucgcgaaaacucccugagcggcgucgagggggagggauuacauaaacuggguuauaucuugcgagacauaucuaagaucucgggcgggaauauguacgccgaugacaccgcaggaugggauacucggauuacagaagacgaucuccagaacgaggcuaaaaucaccgacauuauggaaccagagcacgcccugcuagcuaaggccaucuucaaacuuacuuaucaaaauaaagugguaagaguucagaggcccgcaaagaacggcacagugauggaugucauaucacgcagagaccagcgggguagcggacaggugggaaccuacggccugaauacauuuacuaacauggaagcgcaacucauuaggcagauggaguccgagggcaucuucaguccuucugaacuggagaccccaaacuuggccgaacguguguuagauuggcuggggaaauauggagucgagcgacucaagcgcauggcuaucagcggugacgacuguguugugaaacccauugaugacagauuugccacggcacuuaccgcucugaaugauaugggcaagguacggaaggacauaccgcagugggaaccuuccaaaggguggaacgauuggcagcaagugcccuucugcucacaucacuuucaccagcuaaucaugaaggacggaagggagauugucgugccaugucgcaaucaggaugagcugguuggcagagcccgggugagucagggugcaggguggucucucagggaaacagccugcuugggaaaaagcuacgcgcaaauguggcagcugauguauuuccaucgacgugaccuuagacuggcugccaacgcaaucuguuccgccgucccuguggauuggguacccacuucacgcaccacauggagcauucacgcucaucaccaguggaugacuaccgaggacaugcucucuguuuggaaucggguguggaucgaagagaacccauggauggaagauaagacgcauauauccaguugggaggacguccccuacuuaggcaaaagggaggaccaauggugcggcagccugaucggguugacagccagagcaaccugggcuacuaauauucagguggccaucaaccagguucgccggcugauuggaaaugaaaacuaccucgauuauaugacaucgaugaagagguuuaagaaugaguccgacccugaaggugcgcuuugguga

SEQ ID NO: 14245 - RNA, 9879 nt, Artificial Sequence
  derived and/or modified CDS sequence (opt3) from DENV-1__FJ176779__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaguggccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacuacucaagacagaggugaccaacccugccguccugaggaaacuuugcaucgaagcuaagauuucuaauacgaccacagauagccgguguccaacucaaggagaggccacccugguugaagagcaggacgcaaacuucgugugccgccgaacauuuguagauagaggcugggguaauggguguggauuguucggcaaaggcucccuccugacuugcgcuaaguuuaagugcgugaccaaauuagaggggaagaucguccaguacgaaaaccugaaauauucagugauaguuacagugcacaccggagaccagcaucaagucgguaaugagaguacugaacacggcacgacagccaccauuacuccccaggcgccuaccacagagauccagcucaccgacuacggggcccuuacucuggauuguagcccaaggacaggauuggacuucaacgaaauggugcuacugacgaugaaggagaaaucuuggcucguacauaagcagugguuucuggaucuuccgcugcccuggaccuccggcgcaucaacuagccaagagacauggaaucggcaggacuugcucguuaccuucaaaacagcucacgccaagaagcaggaaguggucgugcuggguagucaagagggggcuaugcacacugccuuaaccggcgcaacggaaauucagaccucuggaacaacuaccaucuuugccggccaucugaaaugccgucuaaagauggauaaacucacacugaaggggauguccuaugucauguguacuggaagcuucaaacuugagaaggaaguggcugagacccagcacgguacgguuuuggugcagaucaaguacgagggcacagacgcgccuugcaaaauuccauucucgacccaagaugaaaaggggguaacucagaacggacgccugauaacagcaaaucccaucgucaccgacaaagagaagccugugaacauugaagccgagccacccuuuggcgagucuuauaucguuauaggugugggggaaaaagcucucaagcuguccugguucaagaaaggcucaaguauuggaaagauguuugaggccacugcaagaggcgccaggcggauggcuauccuuggggauaccgccugggacuucggaagcaucgguggcgucuuuacauccguggggaaacugguacaucagauuuucggaacggcauacggcguguuguuuucugguguuagcuggaccaugaagaucgggauuggcguccuccugacuugguuaggacugaauucacgaaguacaucccuaagcaugaccuguauagcggugggccucgugacacuguaccuuggggucaugguucaggcugauucuggaugcgugaucaacuggaaaggccgcgaauugaagugugguucagggauuuucgugacuaaugagguacacaccuggacggaacaauauaaguuucaggccgacaguccgaaaagacugagcgcagccaucggaaaggcuugggaggagggcgucugcgguaucagguccgccacacggcucgaaaacauuauguggaaacagauaucuaacgagcugaaucauaucuuacuggaaaacgacaugaaguucaccgugguugugggcgaugucgcagggauucuugcucagggaaaaaagaugauccgcccucaacccauggagcacaaauacucguggaagaauuggggcaaggccaaaauuaucggggcggacgugcagaacagcacuuuuauaaucgauggaccaaauaccccugaauguuccgacgaucagagagccuggaacauuugggagguugaggacuauggcuucgguaucuuuacaacuaauauuugguugaagcucagggauucauacacccaggugugcgaccaccgucugaugagugcugcaaucaaagauucuaaggccguacaugcugacaugggguauuggauagaaagcgagaaaaacgaaacauggaagcuagcccgggcauccuucauugaggucaagacguguaucuggcccaaaucacacacccuguggagcaauggagugcucgaaucugagaugauuaucccaaagauauacggcggucccaucucccaacauaacuaucgaccuggcuacuucacucagacagcggggccauggcaccugggaaaacuugaguuggauuuugaccugugcgaaggcaccacuguggucguugaugagcacugcgggaauagaggaccgaguuuaaggacaaccacggugacuggcaagauuauccaugaaugguguugccgcagcuguacccuccccccucugcgguucagaggugaggacgggugcugguacggaauggagauuaggccaguaaaagaaaaggaggaaaaccuugugaagucuauggucuccgccggcucaggugagguggacaguuuuagccugggcuugcucuguaucucgauaaugauugaagagguuaugcgcucccgauggucucggaaaaugcugaugacagggacccuagcuguguucuuucugcucaucaugggacagcugacuuggaaugaucuuauccguuugugcauuauggucggcgccaacgcaagcgacagaauggggaugggaacaaccuaucuggcuuuaauggccacauucaagaugaggcccauguuugcagugggccuccuguuccgccggcuuacuucaagagagguucugcuacucaccaucggucugaguuugguggccuccgucgaacugccuaauucuuuagaggaacucggggauggacuggcuaugggcauuaugauacuuaaacuguugacggacuuucaaagccaccagcucugggcgacacugcuauccaugaccuucaucaagacuaccuuuucacugcauuacgccuggaaaacaauggcaaugguacuuagcauugugagucucuucccacuguguuugucuacuaccucccagaagacgacauggcugcccguuuuacucggcagccuggggugcaagccgcuuaccauguuucugaucgcugagaacaaaauuuggggaaggaagucguggccuuugaacgaagguaucauggccgugggcauagucucaauccuccugucuagucuacugaaaaaugaugugccacuugccgggccccucauugcuggaggcaugcugaucgcauguuauguaauuuccgguagcucugccgacuugagcuuagagaaggcggcugagguguccugggaagaggaagccgagcacucaggggcaagucauaacauccuggucgaaguucaggaugacggaacuaugaaaauaaaggaugaggagcgagacgauacacucaccauucugcuuaaagccacucuguuggcugugagcggcguguacccucuaucuauccccgcaacacuguucgucugguauuucuggcaaaagaagaaacagcgcuccggcgugcucugggacaccccaucaccucccaagguugaacgggccguacuggaugacgggaucuacagaauuaugcagaggggacuuuuaggucguagucaggugggcgucgggguguuucaagagaauguuuuccacacgauguggcacgugacucgcggagcgguccugauguaucagggcaaacggcucgaaccaagcugggcuuccgugaagaaagacuugauaucuuacggugggggauggagacugcagggcucguggaacaccggcgaggagguacaggucaucgccguggaaccggggaagaauccuaagaacguucaaacagcacccggaaccuuuaaaacaccagagggugaagugggcgccauugcucucgauuucaagcccgggacuagcggaucaccuaucgucaauagggagggcaaaauugugggucuguacgggaacggaguugugaccacguccggcacauaugucagugccaucgcacaggcuaaggccucucaggaaggcccacuucccgagauagaggacgaaguguuucgaaaacggaaucugacuaucauggauuugcauccugggagcggaaagacccgcagauaccuaccggcgauuguaagggaggccaucaagcggaaaaugcgaacacugauucucgcaccaaccagagugguugcuuccgaaauggccgaggcuuuaaaggguaugcccauccgcuaucaaacuaccgcagucaaaucagaacacacaggcaaggagauaguggaccugaugugccaugccacguucacuaugaggcuucugucuccugugcgugucccaaacuacaauaugauuaucauggaugaggcccacuuuaccgaccccagcaguaucgcugcgcggggguauauuuccacaagaguaggaaugggcgaagcagccgcuaucuucaugaccgccacuccuccggguagcguggaggcauuuccccagucuaacgccguuauacaggaugaagagagggacauuccagaacgcucauggaauuccggguacgaguggaucacagaguucccuggaaaaaccgugugguuuguccccaguauuaaggcuggcaacgauaucgcgaauugucuccgaaagaacggcaaaagagugauacaguugagccggaagacguucgacacugaauaucaaaaaacaaagaacaaugauugggacuacguugugaccaccgacauuucggagaugggggccaacuucagggcagaucgcgucaucgacccacguagaugccugaaaccugugauccucaaggauggacccgaacggguaauucuggcugguccaaugccggugacuguugccucugcagcccagaggcgcggccgaaucgggagaaaucauaacaaggagggagaccaguacauuuauaugggccagccucuuaauaacgaugaggaccacgcucacuggacagaagccaaaaugcuacuggauaauauaaacacccccgaggguaucauuccagcguuguuugaacccgagcgggaaaaguccgcagccaucgacggggaguacagguuacgcggcgaggcuagaaaaacauucgucgaacugaugaggcggggagaucucccuguguggcugagcuauaagguggccucagagggcuuucaauacagugaccgucgcuggugcuucgauggggaacgaaauaaccagguccuugaggaaaauauggacguugagaucuggacuaaagagggagaaagaaagaaacugaggccacgguggcucgaugcucgcacguauucugaccccuuggcacugagagaguuuaaggaauucgccgcugguaggcgguccgugagcggcgaccuaauucuggagauagggaagcucccucagcaucuuacccagcgagcccaaaacgcacuggauaauuuaguaauguugcacaacucagaacagggaggcagagcguaccgccaugccauggaggagcugccggacacaaucgaaacucucaugcugcuugcucugauugccgugcucaccgguggggucacauuguuuuuccugaguggcaaaggauuaggcaagaccagcaucgggcuacugugugugauggcauccucuguucuccuuuggauggcuagcguggagccacacuggauugccgcauccaucauacuggaauuuuucuugaugguccugcucauccccgagccugauaggcagcggacuccccaggacaaucaacuggccuauguagugauuggacuucucuuuaugauccugacgguugcugcgaacgagauggguuugcuggaaaccacaaaaaaggauuuaggcauugggcacguggccgucgagaaccaucaccaugcagcuaugcuagacguggaucugcacccagccucagccuggacucucuacgcagucgcuaccacaaucauaaccccuaugaugcgucauacuauugaaaauacaacggccaacaucucucuuaccgcgauugcuaaucaggccgcaauccugaugggauuggacaaaggcuggcccauaaguaagauggauaucggugugccacugcucgcccuggggugcuacucgcagguuaacccucuuacuuuaacagcugcagugcugaugcucguagcccacuaugcgauuaucggcccgggauugcaagcuaaggccaccagagaggcacagaaaaggaccgccgcuggcauuaugaagaaucccacaaucgacgggauaguggccauugaucuggacccagucguuuacgaugcaaaauucgaaaagcagcuaggacagaucaugcugcucauccuuuguacuagccaaauucuguugaugcgcacgaccugggcucugugcgaguccaucacacucgccacuggcccucugaccacauuaugggaggguucucccgggaaauuuuggaacaccacuauagcggugucaauggccaauauuuuccggggaagcuaucuugcaggcgcuggucuggccuucucccucaugaagagucuaggcgggggacgaagaggcacgggggcacagggagaaacacugggcgagaaguggaaaaggcaguugaaccagcugucuaagagcgaauuuaauaccuacaaacgcucagguaucauggaggucgaccgguccgaagcuaaggaggggcucaaaagaggagagacuaccaagcacgccgugagucguggcacagccaagcuuaggugguucguagaacggaaccuggugaaaccagaggguaagguuauugacuugggcugugggcgcggaggcuggagcuauuacugcgcggggcugaaaaaggugacugaagucaaaggauauaccaagggcgguccugggcaugaggaacccaucccgauggcuacauacggauggaaucucgugaaauuacacucuggcaaggaugucuuuuucauaccaccugagaagugugacacgcugcuuugcgauaucggcgaguccucacccaacccaaccauugaagaggggcgaacucugagagugcuaaaaaugguugaacccuggcucaggggaaaucaauuuuguaucaagauucugaacccuuacaugccgagcguaguggagacauuggagcagaugcagcggaaacaugguggcaugcugguccgcaauccccucucgagaaacucuacccacgaaauguauugggugaguugcgggacuggaaauaucguuuccgcagugaacaugacaagcaggaugcuucugaaccgauucaccauggcccaccggaagccaacguacgagcgugacgucgauuuaggcgcugguaccagacauguggccguagaaccugaggugacaaaucuggacauuaucgggcagcgcauagaaaacauuaaauaugagcacaagucaacuuggcauuacgaugaggacaaucccuauaagaccugggcauaccacggauccuaugaaguuaaaccuucuggcagcgccaguuccauggucaacggcguggugaaguugcucacaaaaccaugggaugucauccccaugguuacucaaaucgcuaugaccgacacaaccccuuuugggcagcagaggguguucaaggagaaaguagauacucggacgccaaaggcgaagagaggaacagcccaaauuauggaagugaccgcacgcuggcuguggagcuuucuaucuaggaauaaaaagccccgaauauguacucgggaggaauucaccagaaaagucaggucaaacgcugccaucggugcaguguuuguugacgagaaucaguggaacagugccaaggaggcuguggaagacgaucgcuucugggaccuuguccaucgugagcgggaacugcacaaacagggcaagugcgccacaugcguguacaauaugauggggaagagagagaaaaagcucggagaauuuggcaaagcgaaggguuccagggcaauuugguacauguggcugggggcccgcuucuuggaguucgaggcucugggauuuaugaacgaagaucacugguucagccgagagaauucucucucgggcguagaaggcgaggggcuucauaaacugggauauaucuuacgggacauuucaaagaucccggguggcaacauguacgccgaugacacggcagggugggauaccagaauaacugaggacgaucugcagaaugaagcuaaaaucacagacauuauggagccugaacacgccuugcucgcuaagagcaucuuuaagcugaccuaucaaaacaaaguugugaggguccagcgcccagccaagaauggaacugugauggaugugauuuccagacgggaccagaggggcaguggucaggucgggacauacggacuaaacaccuucacaaacauggaggcacaacuuauccgucagauggaaucugagggcauauuuagccccaaugagcuggaaacuccuaaccucgcggagcgaguucuggauugguuggaaaaauauggcguggagcgcuuaaagagaauggccauuuccggggacgacuguguagugaaaccaaucgaugaccgguucgcuaccgcccugacggcacucaaugauaugggaaaggucaggaaggacaucccccagugggaaccgucaaaagguuggaacgauuggcagcaagugccuuuuugcagucaucacuuccaccagcuuauuaugaaggacggccgcgagauaguugugcccuguagaaaucaggaugagcuggucgggcgggcuagggugucucagggagccggcuggagccuacgagaaaccgcaugccuggguaaauccuacgcccaaauguggcagcucauguauuuucaucguagagacuugcgccuggcggcuaacgccaucuguucagcaguaccaguugauugggugccuacaagccggacuaccuggucuauucacgcccaucaccaguggaugacaacugaggacaugcuuuccgucuggaauaggguguggaucgaagagaaccccuggauggaagauaagaccagaauuaguagcugggaggacguuccauaccuggggaaacgcgaggaccaauggugcggaucgcucaucggcuuaacggcucgggccacaugggcaaccaauauacagguggcuaucaaccaggucaggcgacugauuggcaaugaaaacuacuccgauuauaugacuucuaugaagagauucaagaaugagucagaacccgagggggccuugugguga

SEQ ID NO: 14246 - RNA, 9879 nt, Artificial Sequence
  derived and/or modified CDS sequence (opt3) from DENV-1__FJ176780__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaaaaagaugauccgcccucaacccauggaguacaaauauucguggaaaagcuggggcaaggcgaagauaaucggggccgacgugcagaauacuaccuuuauuaucgauggaccaaacacaccugaaugucccgacgaucagagagcuuggaauauuugggaggucgaggacuacggcuucgguaucuuuacuaccaacauauggcuuaaguugagggauuccuauacacaggugugcgaccaccgucucaugucagcagccauuaaagauaguaaggcuguucacgccgacaugggguacuggaucgaaucugagaaaaaugaaacguggaagcuggcacgggcgagcuucauugaggugaagaccuguaucuggccaaaaucccauacucuauggucaaacggaguacuggaaagcgagaugauaauccccaagauuuauggcgguccuaucucucaacacaauuaccgaccaggcuacuucacacagaccgccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucuggugaaguccaugguaucugcuggcuccggugagguggacucauuuagucuuggccuguuguguauuagcaucaugaucgaagaggucaugcgcucgcgauggucccggaaaaugcucaugaccgggacucuggccguguucuuucuacugauuaugggacagcucacauggaacgaucugauccgucuuugcauuaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauaggucucucacugguggcuaguguugaauugccaacaucccuggaggaauuaggggauggacucgcgaugggcaucaugauucugaaacuucugaccgacuuucaaucucaucaguugugggccacucuccugagccuaaccuucgugaagacaacuuuuucccugcacuaugcauggaaaaccauggcuaugguccuuucaaucguaagccucuucccccuguguuugaguacgacaucucagaagaccacuuggcugccgguguuacucggcucccuggggugcaagccucuuacaauguuucugauugccgagaacaaaaucuggggaaggcgaagcuggccauugaaugaagguauaauggccguuggcaucgugucgauucuccugucaucucuacugaagaacgaugucccccuugcugggccucucaucgcaggaggcaugcugauugccuguuacgugaucagugguuccagcgcggacuugucuuuagagaaagcugccgagguaagcugggaagaggaagcagagcauuccggggccucacacaacauacugguggaaguccaggaugacggaaccaugaagauuaaagaugaggagcgcgacgauacucucacaauccugcuuaaggcuacccuguuggcaguuaguggcguguauccccuaagcaucccagccacgcuguucgugugguacuucuggcagaaaaagaagcagcggucuggcguccucugggacacuccuucacccccagaaguggagagagcgguucuggaugacgggauuuauaggauaaugcagcguggacuuuuaggucgcagccagguaggcgugggggucuuucaagaaaauguguuccauaccauguggcacguuacacggggagcugugcugauguaccagggcaaaagacucgagccgaguugggccagcgucaagaaagacuugaucuccuacggugggggauggaggcugcagggcucuuggaacaccggcgaggaagugcagguaauugcagucgagccugggaagaaucccaaaaacgugcaaacagccccaggaacuuuuaagacccccgaaggugagguuggcgcuaucgcccucgauuucaagccugggacgucgggaagcccaauugugaaucgagaaggcaaaaucgucggucuguaugggaacggagugguuacaacuucaggcaccuacguguccgcaauagcucaggccaaggcgagucaggagggcccccuuccugagaucgaagacgaggucuuucggaaacgcaaucugacaauuauggauuugcacccggggucuggaaagaccagaagguaucuaccagccaucgugcgggaagcaauuaaacgaaagcugagaacucucaucuuagcucccacccgcguaguggccagcgagauggcugaagcacugaaggguaugccuauaagguaccaaacaacggccguuaaauccgagcauacuggcaaggagauugucgaccuuaugugccacgccaccuucacaaugcgucugcucucaccagugcgggugcccaacuauaauaugaucaucauggaugaagcucauuuuaccgacccuucuagcauugcggcaagaggguacaucaguacuagggucggaaugggcgaggccgcugccauauucaugacagcaaccccgcccgguuccguagaagccuuuccacagagcaacgcugugauucaggaugaggaacgcgacaucccugagcgaucuuggaacucaggguaugaguggauuacggauuuccccggaaaaacuguuugguuugugccauccaucaagaguggcaacgacauagcgaauuguuugaggaaaaauggcaagcgggucauucagcugagcaggaagacauucgauaccgaauaccagaaaaccaagaauaacgacugggacuacgugguuacuacagauaucucggagaugggggccaacuuccgcgcagaccgugugaucgauccuagacggugccucaaacccgucauucugaaggacggaccagaaagggugauccuugcugguccgaugccuguaaccguggccucugcagcccagcgccgaggcagaauugggcggaaucacaacaaagagggagaucaguauauauacaugggccagccccuaaauaacgacgaggaucaugcucacuggacagaagccaagaugcuguuggacaauaucaacacuccagaggguauuauccccgcguuauuugaaccugagagggaaaaguccgcagccaucgauggggaguaucgccugagaggcgaggcuaggaaaacguucguugaacucaugcggcguggagaccugccagucuggcuuagcuacaagguggccucagagggcuaucaauacagugaucgccgauggugcuuugacggggaaagaaauaaccaggugcuggaggaaaauauggaugucgagauuuggaccaaagagggagaaaggaagaaacuccggccccgcugguuggacgcuagaacauauucugacccucuggcacuaagggaguucaaggaauuugccgcuggucggcgauccguuagcggcgaucugauacucgagaucgggaaacuuccgcagcaccugacucagagagcccaaaacgcauuagacaauuuggugaugcugcauaacucagaacagggaggccgcgcguacaggcacgccauggaggagcucccagauaccauugaaacacugaugcuucuggcucucaucgccguauugaccgguggggugacucuguucuuuuuaaguggccggggacuaggcaagacgagcauugggcugcucugugucauggcauccucugugcuucuguggauggcuagcguugagccccauuggaucgccgcauccauaaucuuggaguucuuucugauggugcuccugauuccugagcccgaccgucagagaaccccacaggauaaucaacuugccuacgucguaaucggacuccuguucaugauuuugacaguggcugcgaacgagaugggucuguuagaaacuaccaagaaagaccuaggcaucgggcacguugccguggagaaucaccaucacgcagcuaugcuggaugucgaccuccauccugccucagccuggacacuuuaugcaguggcuaccacuauaauuacacccaugaugaggcacacgaucgaaaacaccacugccaacauuucucugacagcgaucgcuaaucaggccgcaauauugaugggacuggauaagggcuggccaaucaguaaaauggacauuggugucccucuccuggcccuugggugcuacucgcaagugaacccguuaacccugaccgcugcaguucucauguugguggcccauuaugcgaucauuggccccggacugcaagcuaaggccacacgcgaggcacagaaacggacugccgcuggcaucaugaagaauccaacgguagaugggauaguggccauugaccuagauccugucguuuacgacgcaaaguuugaaaaacagcugggacagaucaugcuccuuauccuguguaccagccaaauuuugcugaugcgaacaacuugggcucucugcgaguccaucacccuggccacaggccccuuaaccacucuuugggaggguucuccagggaaguucuggaacacgacaauagcggugucaauggccaauauuuuuagaggaagcuaucuggcaggcgcuggucucgccuucucccuaaugaaaagucugggcgggggaaggcgcggcaccggggcacagggagaaacuuugggcgagaaguggaaacggcagcugaaccagcucucuaagagcgaguucaauaccuacaagagaucagguaucauggaggucgaccguuccgaagcuaaagaggggcuuaagaggggagagacaacuaaacacgccgugagucggggcaccgccaagcugcgcugguuuguagaacgaaacuuggugaaaccugaggguaagguuauugaucugggcugugggagaggaggcuggagcuauuacugcgcggggcucaagaaagugacagaagucaagggauacacgaaaggcggucccgggcacgaggaaccgaucccaauggcuaccuauggauggaauuuagugaagcugcauucuggcaaagacgucuucuuuauaccucccgagaagugugauacucuucugugcgacaucggcgaguccucaccaaaccccacaauugaagaggggaggacccuacgggugcucaaaaugguugaaccuuggcugcgcggaaaucaauucuguaucaagauuuugaacccguacaugcccagcguaguggagacucuggagcagaugcagagaaagcacgguggcaugcucgucaggaauccacuuucgcgaaacucuacacaugaaauguauugggugaguugcgggaccggaaauaucguuuccgcagugaacaugacgagccggaugcuguuaaaucguuuuaccauggcccacagaaaaccuacauacgagcgcgaugucgaccugggcgcugguacuaggcacguggccguagaacccgaggugaccaacuuggauauuaucgggcagcggauagaaaacauuaagcaugagcacaaaucaacauggcauuaugacgaggauaauccuuacaagacuugggcauaucacggauccuacgaaguuaaaccaucuggcagcgccaguuccauggucaacggcguggugaagcuccugaccaagcccugggacgucaucccuaugguuacacaaaucgcuaugaccgauacuacgccauucgggcagcagagaguguuuaaagagaagguagacacacgcacccccaaagcgaagaggggaacugcccaaauuauggaagugaccgcaaaauggcuaugggguuuccuuagccgaaauaagaagccgcggauauguacaagagaggaauuuacgaggaaaguccgcucuaacgcugccaucggcgcaguguucguugacgagaaucaguggaacucagccaaggaggcuguggaagaugagcguuuuugggaccugguccaucgggaaagagagcuccacaaacaggggaagugcgcaaccugcguguacaauaugaugggaaaaagggaaaagaagcugggcgaguucgguaaagcgaaggggagucgcgcaauuugguauaugugguugggagcccgauuucuggaguucgaagcucucggcuucaugaacgaggaucacugguuuucccgggaaaauagccuuucuggcguagagggggagggacugcauaaauuagguuacauccugagagacauuucgaagaucccuggcgggaacauguaugccgaugacacugcaggaugggauacaaggauaaccgaagacgauuugcagaaugaggcucgcaucacugacauuauggaaccagagcacgcccuccuggcuaaaucaaucuucaagcuaacauaccaaaacaaaguugugagaguccagcggcccgccaagaauggcaccgugauggaugugauuagcaggcgugaccagcgagguuccgggcaggucggaacauauggccuuaacacuuuuaccaauauggaagcacaacugauccgccagauggagagugagggcauauucucuccuagcgaacucgagacgccaaaccuggcggaaagaguuuuggauugguuagagaaguacgggguggaacggcugaaaaggauggccauuuccggagacgacuguguagugaagcccaucgaugaccgcuuugcuaccgcccucacagcacuuaacgauauggguaaagucagaaaggacaucccgcagugggagccuucaaaaggcuggaaugauuggcagcaagugcccuucugcagucaucacuuucaccagcugauuaugaaggacgggcgggagauaguugugccauguaggaaccaggaugagcuagucggacgagcucgugugucucagggcgccgguuggagccugagagagacugcaugccucgggaaguccuaugcccaaauguggcaguugauguacuuccaucgccgggaccugaggcuugcggcuaaugccaucuguucagcaguaccuguugauuggauucccaccagcagaacaacuuggucuauccacgcccaucaccaguggaugaccacggaagacaugcuguccguguggaaccgcgucuggauugaggaaaauccauggauggaggauaaaacacauaucaguagcuggggagacgugcccuaccucggcaagcgggaggaccaauggugcggcucguuaauagggcugaccgcuagggccacuugggcaacaaacauccagguugcuauuuaucaggugcgaagauugaucggaaaugaaaacuaccuggauuauaugaccuccaugaaacgguuuaagaaugagucugacccugaaggugcccucugguga

SEQ ID NO: 14247 - RNA, 9879 nt, Artificial Sequence
  derived and/or modified CDS sequence (opt3) from DENV-1__JN205310__SS-prME
agcgugaccguccuguucaugcuccuucccacagcccuggcuuuucacuugacuacguuaggcggggagccucauaugaucguuuccaagcaggaaagaggaaaaucucugcuauucaagaccucagcaggugugaacaugugcacacucauugccauggaccugggcgagcuuugugaagauacuaugaccuacaaaugcccaaggauaacagagaccgaaccggacgauguagacuguuggugcaaugcgacugagacaugggugaccuaugggacguguagucaaacuggagagcaccggcgcgauaagcgaagcgucgcucuggccccccaugugggcuugggucucgaaacccguacagagacuuggauguccucugaaggggcauggaaacagauccagaagguugagaccugggcccugagacacccuggauuuacagugauugcucuguuccucgcacaugccaucggcaccucgauuacgcagaagggcaucauauuuaucuuacugaugcuugucacuccaucaauggcuaugaggugcguggggauuggaaaccgggacuucguagagggucccagcggcgccacauggguugauguggucuuggaacacgggaguugugugaccacuauggcgaaaaauaagccuacacuggacaucgagcuacucaaaaccgaagugacgaacccagcaauucugcgcaagcuuugcaucgaggccaaaauauccaauaccacaacugauucuagaugucccacccaaggagaagcuacacuggucgaggagcaggacacuaacuuuguuugcaggcggaccuucguggaucgcggcugggguaauggguguggauuguuuggcaagggcagccucauuacaugcgccaaguucaaaugcguaaccaagcuggaagggaaaaucgugcaguacgagaacuuaaaguauuccgucauugugacuguucacacgggagaccagcaucaaguggguaaugaaacaaccgagcacggcacuaccgcaaucaucacaccucaggcuccaaccucagaaauucagcugacugauuacggggcccucacaccggacuguaguccccgaacgggacuugacuuuaacgagaugguccuguugaccaugaaagagaagagcuggcuagugcauaaacagugguuccuggaucucccucugccauggacuucuggcgcguccacaucacaagaaaccuggaauagacaggaccuucugguaacauuuaagacugcccacgcaaagaaacaggagguuguggucuuggguagccaagaaggggcuaugcacaccgcccucacgggcgcuaccgagauacagacaaguggaacuaccacaaucuucgccggccaucugaagugcagguuaaaaauggauaagcugacucuaaaaggggugucuuaugucauguguaccggauccuucaagcucgaaaaggagguggcagagacgcagcacgguacaguucuggugcagguaaaauacgaaggcaccgacgcccccugcaagauuccuagcucgucucaagaugagaaaggggucauccagaacggacggcuuauaacugcuaauccaauugugacagacaaggaaaaacccguuaacaucgaggcggagccgccuuuuggcgaauccuauaucguggucggugcaggggagaaggccuugaagcugucaugguucaaaaagggcaguagcauuggaaaaauguuugaagcuaccgcccguggcgcacgcagaauggccauccucggggauacugcuugggacuucggauccauugguggcguguuuaccucuguagggaagcuggugcaucagauauucggaacagccuacggcguucuuuuuagcggugucucauggacgaugaaaaucgggauuggcauccuguugaccuggcucggacugaauaguagguccacuagcuuaucuaugacauguaucgcagugggcauggugacccuguaccuaggggucaugguucaggcggauucaggaugcgugauuaacuggaagggccgggagcucaagugugguagugggauauucgugacaaacgaaguacacacuuggaccgagcaauauaaauuucaggcugacagccccaagcgacuguccgccgcaaucggaaaagccugggaggaaggcgucugcgguauucgcucugcuacgagacuugagaauaucauguggaagcagauuucgaacgaauugaaucauauccugcucgagaacgauaugaaauucacagugguugugggcgacgucagcgggauacuggcccagggaaagaaaaugaucaggccacaaccuauggaacacaaguacuccuggaagucauggggcaaagcaaagauuaucggggcugacgugcagaauaccacuuuuauuaucgauggacccaacaccccagagugucccgacaaucagcgggccuggaacauaugggagguugaagauuauggcuucgguauuuuuacaacuaauaucugguuaaaacugcgcgacaguuucacccaggugugcgaucacagacuuaugucugcggccauuaaggacagcaaagcuguacaugcagauaugggguacuggaucgaguccgaaaagaaggagacauggaaauuggccagggcuucauucauagaagucaagacguguaucuggccuaaaagccacacccucuggucuaacggagugcuggaguccgagaugauuaucccaaagauuuauggcgguccggugagucaacauaauuaccgucccggcuauuuuacucagacagccgggccuuggcaccuaggaaaacuggaacucgacuucgaucugugcgagggcaccacugucguuguggacgaaaacugcgggaaucggggaccaagccuucgaacaaccacgguaacuggcaagaccacacacgagagauguugcaggucuuguaccuugcccccucugcgcuuuaagcgggaggaugguugcugguacgggauggaaaucagaccagugaaagagaaggaagagaacuuagucaaauccauggugucagcaggaaguggcgaaguugacagcuucucgcucggucugcuuuguauauccauuaugaucgaggaggugaugaggucucgcuggagccgaaagaugcugaugacuggcacauuggcggucuuucuccugcuaaccauggggcagucaacauggaaugaucugauccggcucugcacuauggugggagccaacgcuagugacaugaugggcauggggaccacguaccuggcccuuauggcaacauuccguaugagacccauguuugcuguuggauugcuguucaggcgcuuaaccucccgggaaauucuccugcuuacugugggccugucucuagucgccagcguagagcucccgaacucccuggaagaguugggugacgggcuggcaaugggaaucaugauguuaaaacuccugaccgauuuucaaccucaucagcuuugggccacacuguugucacucacuuucgugaagaccacgcugagccuacacuaugcuuggaagacaauggcgaugauucugaguauaguuucucuucucccacuguguuuguccaccacuagccagaaaacaaccuggcugcccguguuacucggcucgcugggcugcaagccucuuacuauguuucugaucacagaaaauaaaauuugggggagaaggucauggcccuugaacgagggaaucauggccauugguaucgucucuauacuccugaguuccccacuaaagaaugacgugccucuggcaggcccccuuaucgcugggggaaugcucauugccuguuacguaaucagcggcucuagcgccgaucuguccuuggagaaagcugcagaagugucaugggaggacgaagccgagcauaguggugcgagccacaacauuuuagucgaaguucaggaugacgggaccaugaagaucaaagaugaggagcgagacgauacgcugacuauacuccugaaggcuacccuucuggugauuucuggaguguauccaauguccaucccggccacauuguucgucugguacuuuuggcaaaagaaaaagcagcgcucaggcgugcuaugggacaccccuagucccccagaaguugagcgggcaguacuggauaauggcaucuauagaauucuccagagggggcugcuuggacguagccaggugggugucggcguguuccaagaagggguuuuccauacaauguggcacgugacucgcggagccgucuuaauguaccagggcaaacggcuggagcccuccugggcuucugugaagaaagaccucauaucguauggugggggauggagauuucagggcagcuggaacaccggcgaggaaguacaggucaucgcaguggagccugggaagaauccaaagaacguucaaacgacacccggaacuuucaaaaccccugaaggugaggugggcgccauugcguuggauuuuaagccggggacaucaggauccaccaucgucaauagggaaggcaaaauugugggucuguacgggaacggaguugugacuaccaguggcacauacgucucugcuaucgcccaggcaaaggccagccaggagggcccacuccccgagauagaagacgagguguuccgaaaacggaaucugacgaucauggaccuucacccuggguccggaaagacucgcagauaucugccagcuauuguaagggaagccaucaagcggaaauugcgaacccuagugcuggcacccacaagaguugucgcuucagagauggccgaagcgcucaaggguaugccuauucgcuaccaaaccacugccgugaaaucugagcauacaggcaaggagaucguggauuuaaugugccacgcaaccuuuacgaugaggcugcuuagcccgguccguguacccaacuauaauaugauaauuauggacgaagcucauuucacugauccagccaguaucgcugcacggggguacaucuccacaagagugggaaugggcgaggccgccgcuauuuuuaugaccgcgaccccucccgguagcguugaagcauucccacagucuaacgccgugauccaggacgaggaaagggauauaccugagcgcucauggaauuccggguaugaguggauuacugacuuucccggaaaaacagucugguucgugccaaguaucaagagcggcaacgauauugcuaacugucugcgaaagaauggcaaaagaguugugcagcucucgcggaagaccuuugacacagaauaccaaaaaacuaagaacaaugauugggacuaugucgugacgaccgauaucucugagaugggggccaacuucagggcagaccgcguaauagacccgcguagaugcuugaaaccugugauucugaaggauggacccgaacggguuauccucgccgguccaaugcccgucacaguggcuuccgcggcccagaggcgcggccgaaucgggagaaauccuaacaaggagggagaccaguacguguacaugggccagccacugaauaacgaugaggaccacgcacauuggacugaagcuaaaaugcuucuagauaauauuaacacccccgaggguaucauuccugcccuguucgaaccggagcgggaaaagagcgcagccauagacggggaguauagguugcgcggcgaggcuagaaaaacauuugucgaauuaaugaggcggggagaucugccaguuuggcucucauacaagguggccagugagggcuuccaauauucugaccgucgcuggugcuuugauggggaacgaaauaaccagguacuggaggaaaauauggacguggagaucuggaccaaagagggagaaagaaagaaacuuaggccccgguggcuggaugcgcgcacuuacuccgacccucucgcauugagagaguucaaggaauuugccgcugguaggcggagcgucucaggcgaucugauucuagagaucgggaagcugccccagcaccucacgcuuaaagcccagaacgcucuggacaauuuagugauguugcacaacagugaacaaggaggcaaggcauaucgacaugccauggaggagcugccagacaccaucgaaacacucaugcugcuugcucugauugccguucucacugguggggugaccuuguucuuucugagcggcagaggauuaggcaaaacauccauagggcuacugugugucauggcaucuagcguacuccuuuggauggcguccguggagccucacuggaucgccgcuucaauuauccuggaauucuuuuugaugguucugcucauucccgagccagaucgccagaggaccccucaggacaaccagcuggccuacguggucaucggacuucucuucaugauacugacuguggcagcuaaugagauggguuugcuggaaacaacgaagaaagauuuaggcaucgggcaugccgcagccgagaaccaccaccaugcugcgaugcuagacgucgaucugcacccggccucugcauggacccucuaugcuguggccacuacaauuaucacccccaugaugcggcauaccauugaaaauacaacugccaacaucagucuuacggcaauagcuaaucacgccgcgauucugaugggauuggacaagggcuggccaaucucgaagauggauauugguguuccucugcucgcucuggggugcuacagccaagugaacccccuuaccuuaacagccgcaguacugaugcucguggcccauuacgcuaucauaggcccaggauugcaggcaaaagccacucgugaggcgcagaagagaaccgcugccggcaucaugaaaaauccuacagucgacgggauuguugcaaucgaucuggaccccguggucuaugaugccaagauugaaaaacaacuaggacagaucaugcugcucauacuuuguaccucccagauucuguugaugaggacuacgugggcucugugcgagucuaucacacucgccaccggcccgcugacuaccuuaugggaggguucaccagggaaguuuuggaacacaacuaucgcagugagcauggcuaauauuuuccgcggauccuaccuugccggcgcgggucuggccuuuagucucaugaagucucuaggcgggggacggcgaggcaccggggcacagggagaaacacugggcgagaaauggaagagacaauugaaccagcugagcaaaucagaauucaauaucuauaagagguccgguauaauugagguagaccgcagugaagcuaaagaggggcucaagcggggagagacgaccaagcacgccgugagcagaggcacugcaaaacuucguugguucguugaaaggaaccuggugaagccugaggguaaagucaucgauuugggcugugggcggggaggcuggucuuacuauugcgcugggcugaagaaagugacagaagucaagggauacaccaaaggcggucccgggcacgaggaaccaauucccauggccacuuauggauggaaucucgugaaguuacauuccggcaaggacguuuuuuucacaccuccggagaaaugugacacccugcuuugcgauaucggcgagucaagccccaacccaacgauagaagaggggcgcacccugcgaguacuaaagaugguggaaccuuggcucagaggaaaucaguuuuguaucaaaauucugaaccccuacaugccuucggucguggagacauuggagcagaugcaaaggaagcacgguggcaugcugguucggaauccacucucucgcaacaguacucaugaaauguacuggguguccugcgggaccggaaacaucgucagcgccgugaauaugacaucaagaaugcuucugaacagguucacuauggcgcaccgaaaacccaccuaugagcgggacguagauuuaggcgcugguacacgucacguggcaguugaaccugaggucgccaaucuggacauuaucgggcagagaauugaaaacaucaagaaugagcauaaguccaccuggcacuacgaugaggacaacccauauaaaacuugggcuuaccauggaucuuaugaagugaagcccagcggcagugccuccagcauggugaauggcgucguucgcuugcucacgaaaccgugggaugugauaccuaugguaacacagauugcaaugaccgacacuaccccauuugggcagcaaaggguguucaaggagaaagucgauacacggacgcccaaggccaagagaggaaccgcucagaucauggaagugacugcgcgcuggcugugggguuuucuaucuaggaacaaaaagccucgaaucuguacacgggaggaauucaccagaaaaguuaggucaaaugccgcaauuggcgcuguguuugucgacgagaaccaguggaauagugccaaggaggcaguggaagaugagcgcuucugggaccuuguacaccgugaacgggagcugcauaaacaagggaagugcgccacuugcguuuacaacaugaugggaagaagggaaaagaaacucggcgaguuugguaaggcuaaagggucccgcgccauaugguauauguggcugggagcgcgauucuuggaguuugaagcacugggcuucaugaaugaggaccacugguucagccgggaaaacucucucucgggcguggagggggagggacaccauaagcuugguuacauccugagagauauuucaaaaaucccaggcgggaauauguacgccgacgauacagcuggaugggacaccaggauuacagaagaugacuuacagaacgaggccaagaucacugauauaauggaacccgagcacgcacuguuggcuaccagcaucuuuaaacucacguaucagaacaaggucgugcgcgugcagagaccggccaagaauggcaccgucauggacguuauuucccggagggaucaacgugguagugggcaggugggaacauacggccugaacacuuucaccaauauggaagcucagcuaauccgacagauggagucugagggcauuuuuagcccuuccgaacuugagacacccaaccuggccgaacgcguauucgacuggcucgagaaacaugggaucgaaagacugaagcggauggcaauaucaggagaugacuguguggucaaaccaauugaugacagguuugcgacugccuugaccgcuuuaaaugacauggguaaggugcgcaaagauaucccucaaugggagcccccaaagggcuggaacgacuggcagcagguucccuucugcagucaccacuuucaucagcugaucaugaaggaugggagagagauuguggucccuugucggaaucaagacgaacucgugggaagggcccgaguaucucagggcgcagguuggagccuucgugagacggcuugccuggggaaauccuaugcccagauguggcagcuaauguacuuccacagacgcgaucugcggcucgcagccaacgcgauauguucagcuguuccaguggacugggucccgacaagcaggaccacuuggucuauccaugcccaccaucaauggaugacaaccgaagauauguuguccguguggaauagaguuuggauugaggaaaaccccuggauggaggacaagacucacgugaguagcugggaggaugucccuuaucugggaaaacgcgaagaccaguggugcggcucgcuuaucggccugaccgcacgggccacaugggcuacgaauauucagguggccaucaaccaaguaaggcgacucauagggaaugagaacuacuuagauuauaugaccuccaugaagagauuuaaaaaugaaucugacccagagggagcacugugguga

SEQ ID NO: 14248 - RNA, 9879 nt, Artificial Sequence
  derived and/or modified CDS sequence (opt3) from DENV-1__HQ332182__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggacaucuuaugugauguguacuggauccuucaaauuggagaaggaagucgcugagacccagcacgguacggugcugguucaggugaaguacgagggcacagaugcgccuugcaaaauaccauucagcacccaagacgaaaaggggguaacucagaacggacgccucaucacagcaaaucccauugucaccgauaaagagaagccugugaacaucgaaacugagccacccuuuggcgagucguauauaguugugggugccggggaaaaagcucugaagcuuucuugguucaagaaaggcuccucaauuggaaagauguuugaggccaccgcaagaggcgccaggcggauggcuauccugggggacacagccugggauuucggaaguaucgguggcgucuuuacgagcguggggaaauugguacaucagguguucggaaccgcauacggcguucucuuuuccggugucucuuggacuaugaagauugggaucggcauucuguuaacauggcugggacuaaauagccgaucaaccagucucuccaugacauguauagcggugggcauggugacucuguaccuuggggucaugguucaggcugacagcggaugcgugaucaacuggaaaggccgcgaauugaagugugguucugggauuuucgugaccaacgagguacacacguggacagaacaauauaaguuucaggccgauucaccgaaaagacugagugcagccaucggaaaggcuugggaggagggcgucugcgguaucaggagcgccacccggcucgaaaauauuauguggaaacagauauccaacgagcugaaucauaucuuacuggaaaacgacaugaaguucacugugguugugggcgacgcaaaugggauucuugcucagggaaaaaagaugauccgcccucaacccauggagcacaaauacucuuggaagucguggggcaaggccaaaauuaucggggcggauauacagaacaccacauuuaucauugacggaccagauacuccugaaugucccgacgaucagagagccuggaauaucugggaggucgaggacuauggcuucgguauuuuuaccacaaacaucugguugaagcucagggauagcuacacgcagaugugcgaccaccgucugauguccgcugcaauaaaagauucaaaggccgugcaugcugacaugggguauuggauugaaagugagaaaaaugaaaccuggaagcuagcccgggcaucuuucaucgagguuaagacuuguacauggccaaaaagccacacccugugguccaacggagugcucgaaucagagaugauuauccccaagauauacggcgguccuaucagccaacauaauuaucgaccaggcuacuucacucagacagcggggccguggcaccugggaaaacuugaguuggauuuugaccugugcgaaggcaccacgguagucguggaugagcacugcgggaacagaggacccucuuuaaggacuaccacagugaccggcaagauuauccaugaaugguguugccgcuccuguacucucccuccacugcgguucagaggugaggacgggugcugguacggaauggagauuaggcccgucaaagaaaaggaggaaaaucuuguucgcaguauggugagcgccggcucuggugagguagacuccuuuucacugggcaucuugugugugaguauaaugauugaagaggucaugcgaagccgguggucgcguaagaugcucaugacagggacccuggcuguguuccuacugcucaucaugggacagcugacauggaacgaucuuaucagauugugcauuaugguuggcgccaaugcauccgacaggauggggaugggaacuaccuaucuggcuuuaauggccacguuuaaaaugcgcccuauguucgcagugggccuccuguuucggagacuuacaucuagggagguccugcuacucaccaucggucugagcuugguggccucaguugaacugccaaacaguuuagaggaacucggggauggacuggcuaugggcauuaugaugcuuaagcuguugacugaguuccaaccccaccagcucuggaccacacugcuaucccugacuuuuauaaaaaccacgcuuucucucgacuacgcguggaagacaaccgccauggcacugagcaucguguccuuguucccgcuguguuuaucaacuacaagccagaaaaccacuuggcucccuguccugcuuggcaguuuugggugcaagccacugacaauguucuugauuaccgaaaacaagaucuggggacgaaaaucuuggcccauuaaugaggguaucauggcuauaggcaucguauccauucuccugagcucgcuacugaagaacgaugugccucuugccgggccccucaucgccggaggcaugcugauugcuuguuauguuaucucagguucuagugcagacuuguccuuagagaaagccgcggaagugagcugggagcaggaagcugagcauucugggacgagccacaauauacuggucgaagugcaagaugacggaacuaugcgcauuaaggaugaggagaaagacgauacccucacaauccugcuuaaggccacccuguuggcaguauccggcguguacccaaugucaaucccugccacacuauuugucugguauuucuggcagaaaaagaagcagcggaguggcguucugugggacacucccagcccaccggaaguggagagagcugugcucgaugacgggauuuacaggauacugcagcguggacuuuuaggucgcucucaagucggcguggggguuuuccaggacggaguauuucauaccauguggcacgugacgcggggcgcaguccugauguaucaggguaaaagacucgaaccuuccugggccucagugaagaaagauuugaucaguuacgggggaggcuggagguuccagggcagcuggaacacaggggaggagguucaagugauugcggucgaacccggaaagaauccaaaaaacgugcagacuacccccgguacauuuaagaccccugagggcgaaguaggggcuaucgcccuggacuucaagccaggaacuuccggcucucccauugucaaucgagaggguaaaaucguggggcucuacggaaacggcguugugaccacaucgggcacguaugucagcgcaauagcccaggcuaaggccucacaagaagggccucugccggagaucgaggaugaaguguuuaaaaagcggaaucuuacuauuauggaccugcacccaggauccgguaaaacccgcagauacuugcccgcaaucguuagggaggcuauuaagcggaagcuacgaacacugauccucgccccuaccagaguggucgcgagugaaauggccgaggcauuaaaaggcaugccaauacgcuaucagacuacagcugugaagucugaacauaccgggagggagauuguagaucugaugugccacgccacguucacuaugcgucuucugagccccgugcggguuccuaacuacaauaugaucaucauggacgaggcucauuuuacagauccggcauccauugccgccagaggauauaucucaaccagggucggcaugggugaagcugcggcaauauucaugaccgccacucccccagggucuguggaggcuuuuccucagagcaacgccgugauucaggacgaagagcgcgauauccccgaacgaaguuggaauuccggauacgacuggauuacagauuucccaggcaaaaccgucugguuuguaccuagcaucaagucuggcaacgacauagcaaauugucucagaaaaaacgggaagcgggugauucaauugucaaggaagacauucgacacugaguaucagaaaacgaagaacaaugauugggacuacguugugaccacagauaucuccgagaugggagccaacuuccgcgcugaccgugucaucgaucccagacggugccugaaaccagugauucucaaggacgguccggaaaggguuauccuggcgggcccuaugcccgugacugucgccagugcagcucagcgccgagggagaauuggacggaaucagaacaaagagggcgaucaauacguguauaugggucagccacuuaauaacgacgaagaucacgcccauuggaccgaggcaaagaugcuacuggacaauauaaacacacccgaggggaucauuccugccuuguuugaaccagagagggaaaagagcgcugccaucgauggcgaguaccgcuuaagaggagaagcgaggaaaaccuucguagagcugaugcggcguggcgaccuccccguguggcugucguauaagguugcaucugagggguuucaguacuccgaucgccgauggugcuucgacggagaaagaaauaaccagguccuugaggaaaauauggacguggagaucuggacuaaagaaggugagaggaagaaacugcggccucgcuggcucgaugccagaacguauagcgacccguuggcucugagggaguuuaaggaauucgccgcuggccggcgaucagugaguggggaucuaauucuggagauaggaaaacucccacaacaccuuacccugagagcacagaacgccuuagacaauuuggucaugcugcacaacucugaacagggcgguaaggcuuaccgccaugccauggaggaacuccccgauacaaucgagacucugaugcuucuggcacucauugcgguuuugaccgggggcgugacacuguuuuucuuauccggaaagggccuagggaaaaccagcaucggacugcucuguguaacugccucaagugugcuucuguggauggcuagcgucgagccucacuggauugccgcauccaucauauuggaauuuuuccugauggugcuccugauccccgagccagacaggcagcggacaccucaagauaaucagcuugcuuauguugugauuggucuccuguuuaugaucuugacggucgccgcaaacgaaaugggccuguuagagaccacuaagcgugaccuagggauuggacauguagccgcugagaaccaccagcacgcgacaaugcuggauguggaccucagacccgccucugcauggacccuuuacgcuguugccaccacagugaucacuccaaugaugaggcauacgauagaaaauaccacagccaacauuagccugacugcaaucgcuaaucaagccgcgauuuugaugggccuggauaaagguuggccuaucuccaagauggacauaggggucccgcuccuggcucuuggcugcuacucacaggugaaccccuuaacccugacagccgcaguccucauguugguggcccacuaugcuaucauuggaccaggccugcaggcaaaagccacccgcgaggcgcagaagcggacugcugccgggaucaugaagaauccuacgguugauggaauuguggcaaucgaccuagaccccguaguguacgaugccaaauucgaaaagcaacugggccagauaaugcuccuuauucugugugcuucucaggucuugcugaugcgaacaaccugggcccucugcgagaguaucacucuggcaaccgguccauuaacaacucuuugggaagggucgccuggaaaauuuuggaacaccacaaucgcuguuagcauggccaauauuuucagaggcuccuaucuggcgggugccggccucgcauucucucuaaugaagucacuggggggaggcaggcgcgggacgggagcucagggcgagaccuugggugagaaauggaagcggcaacugaaccagcucagcaaguccgaauuuaauacuuacaaaagaagugggaucauggagguggaccguucugaagccaaggagggacuuaaaaggggcgaaacaaccaagcaugcagucagccgggguacugcuaaacugcgcugguucguggagcgaaacuugguaaagcccgagggcaaggugauagaucugggguguggaagaggcggguggucauauuacugcgccggacucaaaaagguuacagaagugaaaggcuauaccaagggugggccgggacacgaggaaccaauuccuauggccacguacggcuggaauuuagucaaacugcauuccggcaaggacguguuuuucaugcccccagagaaaugugauacccuucugugcgacaucggggaaaguagccccaacccuacaauugaggagggaaggacucuacggguccucaagaugguggaaccguggcugcgcgguaaucaguuuuguaucaagauauugaaccccuacaugccaucuguuguagagacccuggaacagaugcaaagaaaacacggcgggaugcucgugaggaauccucuuucccgaaacucaacacacgagauguauugggucagcugcggaacuggcaauaucgugucggcgguuaacaugaccucucggaugcuguuaaaccguuucacaauggcucauagaaagcccaccuacgagcgcgauguggaccugggugcagggacuaggcacgucgccguggaaccugagguagcuaauuuggauauuaucggacagcggauugaaaacaucaaaaaugagcauaagaguacguggcacuaugacgaagauaacccauacaaaacaugggccuaucacggcuccuacgaggugaagcccagcggcucagcauccucuaugguuaauggggucgugagacuccugaccaagccuugggacgugauuccaauggucacucagaucgccaugaccgacacaacgcccuuuggacaacagcgcguuuucaaagagaagguggauaccaggacuccgcgagcuaaacgggguacaacccagauaauggaaguaacugcgaaguggcuauggggcuuucuuagcagaaacaaaaagccuaggauuuguacacgcgaggaauucacccguaaggugcggaguaaugccgcagucggggcuguguuuguugacgagaaccaguggaauuccgccaaagaagcaguggaggaugagagauucugggaccugguccauagggaacgcgagcuccacaagcaaggaaaaugcgccacaugcguguauaacaugaugggcaagcgagaaaaaaagcugggugaguuugggaaggcuaaaggaagccgggccaucugguacaugugguugggcgcgagauuccuggaauucgaggcacucggcuuuaugaaugaggaucauugguucucuagggaaaacucacuuagugggguagagggagaaggucugcacaaguuaggcuacauccugcgcgacauuuccaaaauaccagggggaaauauguaugccgaugacacugcuggcugggauaccagaaucacggaggacgauuugcagaacgaggccaagauuaccgacaucauggaacccgagcaugcacuccuggcuacaagcauuuuuaaacuaacuuaccagaauaagguugugcggguccagaggccugccaaaaacgguaccgugauggaugugaucucucgucgagaccaacgcgggucgggacaggucggcacauauggccuuaacacuuucaccaauauggaaguucagcugauaagacagauggagucagaagggaucuuucucccaagcgagcuggagacgcccaacuuggcugaacggguguuagacuggcuggagaagcacggagccgaaaggcucaagcgcauggcaauuuccggugaugacuguguagugaaaccgaucgaugacagauucgcgacagcccuuaccgcucugaaugauaugggcaagguccggaaagacauuccucaaugggagcccaguaagggguggaacgauuggcagcaggugccauuuugcucucaccauuuccaccagcuaaucaugaaagacggaagggaaauaguugugccuugucgaaaucaagaugagcuggucggccgugccagagugagccagggugcaggguggucccuccgcgagacugcuugcuugggaaagucauacgcccagauguggcaacugauguauuuucaucggagggaccuuagacuggcagccaacgcgauuuguagugcuguacccguugauugggugccaacaucucgcaccacuuggagcauccacgcccaccaucaguggaugaccacagaagacaugcucuccgucuggaaucggguguggaucgaggaaaaccccuggauggaggacaagacgcacguuucaagcugggaagaggugccuuacuuaggcaaaagggaggaucaguggugcggcucucugauuggguugaccgcacgagccacuugggcuacaaauauacaggucgccaucaaccaagugagacggcugauuggaaaugaaaacuaucucgacuacaugaccuccaugaagagguucaaaaaugagagugauccagaaggugcacuuugguga

SEQ ID NO: 14249 - RNA, 9879 nt, Artificial Sequence
  derived and/or modified CDS sequence (opt3) from DENV-1__HQ332181__SS-prME
agcgugaccaugcugcucaugcuucugcccacagccuuggcuuuccacuuaacuacgaggggcggggagccucauaugaucgucuccaaacaggaaaggggaaaaucucugcuauuuaagaccucagcugguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucugguccagggaaagaaaaugaucagaccucaacccauggaacacaaguacucuuggaaaucguggggcaaggcuaagauuaucggggccgacauacagaacacuaccuucaucauugauggaccagacacaccugagugucccgauggccagagggcguggaauaucugggagguggaagacuaugguuuugggguuuucacuaccaacauuuggcuuaaauugcgugauagcuacacacagaugugcgaccaccggcucauguccgccgcuaucaaggauucaaaagcagugcaugccgacaugggauauuggauagagagugaaaagaaugagacguggaaacuggcucgagccucuuucauugaaguaaagaccuguacuuggccaaagagccacacacuaugguccaacggcguccuggagucagagaugaucauucccaaaaucuacgguggcccuauaagccaacauaauuauagaccaggguacuuuacccagacugcaggaccguggcaccucggcaagcuggaacuugauuucgacuugugcgaggggacaaccgugguggucgaugaacacugcggaaacaggggccccucucugcgcacgacuaccguuacagguaaaaucauucaugagugguguugccgguccuguaccuuaccuccacucagauuuagaggggaagacggaugcugguacggcauggaaauccgccccgugaaggagaaagaagagaaucugguacgaaguauggugagcgcggguacuggcgaagucgauucuuucucccuugggauucugugugugucaaucaugauagaggagguuaugcggagucguuggagcagaaagauguugaugacaggaacccucgccguguuucugcuacugauuaugggccagcucacauggaacgaccugaucaggcuuugcaucauggucggggcuaaugccucggaccgcaugggaaugggcacuaccuauuuggcacugauggcuacguucaagaugcggccuauguuugccguggguuuacucuucagaaggcugacaucccgagaaguucuucugcuaaccauugggcucucucugguggcaagcgucgaguugccaaacucacuggaagaguuaggagauggccucgccaugggcaucaugaugcugaaacuucugacugaauuucaaccccaccaguuguggaccacacuccugagucuaacuuucguaaagaccgcucugucccuugacuacgcguggaaaacgacagccauggugcucucuauuguuagccuguuuccguugugucuguccaccacuucacagaagacaaccugguuaccugugcuccuggggagcuucggaugcaaaccacuuacuauguuucugauaacagagaacaagaucuggggucgcaagaguuggcccuugaaugagggcauuauggcaaucgggauugucucuauccuccuguccagccuacugaaaaacgaugugccucuugcuggaccccucauagccggcgguaugcugaucgccuguuauguaauuucggggucaucugcugacuugaguuuagaaaaggcagccgagguguccugggaacaggaggcggaacauagcggagcuucucacaauauccuggucgagguucaagaugacggcaccaugaaaauuaaggaugaggaacgggacgauacgcucacuauccugcuuaaagccacccuguuggcagugagcggcguguacccaauguccauaccugccacacuauucgucugguauuucuggcagaagaaaaagcagagaucaggggugcugugggacacccccaguccaccggagguugaaagggcuguacucgauaacggaauuuaccguauccugcagcgcggucuuuuaggccggagccaagugggggucggaguguuucaggacggcguuuuccauacaauguggcacgugacuagaggugcaguccugauguaucaggggaagaggcucgagccuucuugggccuccgugaaaaaggauuugaucucauacggaggcggcuggcgauuucaggggaguuggaauaccggagaggaaguacaagucauugcgguggagcccgguaaaaacccaaagaauguucagacgacacccggcacuuucaaaaccccugaaggggaggugggagcuauagcccuggacuuuaagccaggcacaagcgguucccccaucgucaaccgggaagggaagauugugggacucuacggcaauggcguugugaccacuucugggaccuaugucucggcaaucgcccaggcuaaagccagccaagagggaccucugccggagauugaagacgagguguucaagaaacgcaaccuuacaaucauggaucugcacccagguucaggcaagacgagaagguacuugcccgcaauaguacgggaagcuaucaaacgaaagcuaagaacucugauucucgccccuacccgcgugguugcguccgagauggccgaagcauuaaaggggaugccaaucagguaucagacaaccgcugucaaaagugagcauacuggacgugagauuguggaccugaugugccacgccacauuuaccaugcggcuucugucucccgugagagucccuaauuacaacaugaucauaauggaugaagcucauuucacggacccggcaagcauugccgccaggggcuauaucuccacucgcguagguaugggggaggcugcggcaaucuuuaugacagccacacccccaggaucaguggaggcuuucccucagucuaaugccguuauucaggaugaggaacgagacauccccgagagaagcuggaacaguggcuacgauuggauaaccgacuuuccaggcaagacugugugguucgucccuuccauuaaaagcgggaaugauaucgcaaacugucuccggaagaacggaaaaagggugauucaauugucucgcaagacauucgacaccgaguaucagaagacuaaaaauaacgauugggacuacguugugacuacggacaucucagaaaugggugccaauuuucgugcugauagagucauagacccccggaggugccugaagccagugauucucaaagauggcccggagcgcguaauccuggcggggccuaugcccgugaccguugccuccgcagcucagcgaagaggacggaucggcaggaaccagaauaaggaaggugaccaauacgucuauauggggcagccacuuaacaaugaugaggaccacgcccauuggacagaggcaaaaaugcuacuggauaacauuaauacucccgaaggcaucauuccugccuuguucgagccagaacgcgagaagagugcugccauagacggagaauacagauuaaggggcgaggcgcggaagaccuuuguggagcugaugcgucgcggggaucuccccguguggcugagcuauaaagucgcaucggaaggauuccaguacucugaccgaagauggugcuuugauggugagaggaacaaucagguucuugaagagaacauggacguggaaaucuggacaaaggagggcgagcggaaaaagcugcgcccuagauggcucgaugccaggaccuauuccgacccguuggcucugcgggaguucaaagaguuugccgcugggcgaagaagcguaucaggagaccuaauucuggaaaucggcaagcucccacaacaccuuacucugcgcgcacagaaugccuuagauaacuuggugaugcugcacaauagugagcagggugggaaggcuuacaggcaugccauggaggaacuccccgacacgaucgagacccugaugcuucuggcacucauugcggucuugacaggcggagugacucuguucuuuuuaucuggcaaggggcuaggaaagaccuccauaggucugcucuguguuacagccagcucagcacuucuguggauggccaguguggaaccucacuggaucgcagcuagcauuaucuuggaguucuuucugaugguccuccugauucccgaaccagaucggcagcguaccccucaagacaaccagcuugccuauguagugaucggccuccuguucaugauauugacuguugcagccaacgagauggggcuguuagagacaacgaaaaaggaucuaggaaucggcuacguggcugcggaaaaucaucagcacgccaccaugcuggacgucgaucuccaccccgcauccgcuuggacucuuuacgccguggccacaaccgucauuaccccaaugaugagacauacaaucgagaacacuacggcaaauauuucucugaccgcuaucgccaaccaagcggcuauauugaugggucuggacaaaggguggccuauuagcaagauggauaucggcgugccgcuccuggcccuuggaugcuauucccagguuaaucccuuaacacugacugcagccgugcucauguugguagcucacuacgcaauuaucggcccagggcugcaggccaaagcgaccagggaagcucagaagcgcacagccgcaggaauaaugaagaacccuaccguggacggcaucgucgccauugaucuagaccccguuguguaugaugcuaaauuugagaagcaacugggucagaucaugcuccuuauucuguguacuucacagaucuugcugaugcggacgacaugggcccucugcgaaucuauaacccuggcaacugggccauuaaccacacuuugggagggaaguccuggcaaauucuggaauacuaccauugcugucucgauggccaacaucuuccgagguagcuaccuggcgggcgccgggcucgcauuuucccuaaugaagucucugggaggcgggagaaggggaacaggcgcucagggugagacguugggggaaaaauggaagcgccaacugaaucagcucucaaagagcgaguucaacaccuauaaacgguccggaaucauggaaguggacagaagugaggccaaggaaggccuuaaacguggugagacuacaaagcaugcaguaucuaggggcaccgcuaaacugcggugguuuguggagcgcaauuugguuaagcccgaagggaaggugauugaccugggauguggccgagggggauggagcuacuauugcgccggccucaaaaaggucacugaggugaaagguuacacaaaagggggaccgggccacgaagaaccaaucccuauggccaccuacggcuggaacuuagucaaacugcauucagggaaggauguguucuuuaugcccccagaaaaaugugacacgcuucugugcgauauaggagaguccagucccaauccuaccauugaggaagguagaacacuaaggguucucaagaugguagagccguggcugcggggcaaccaguucuguaucaagauuuugaaucccuauaugccaagcguggucgaaacucuggagcagaugcaacgcaaacacgggggaaugcucgugagaaacccucuuucuagaaauuccacccacgagauguacuggguuucaugcggcacagguaacaucgugagcgcggucaacaugacuucgcgaaugcuguuaaaucgguuuaccauggcucaucguaagcccacauaugaaagagacguggaucugggggcaggaacccgccacguagccguggagccugaaguugcuaacuuggacauaaucggccagaggauugagaauaucaaaaacgaacauaagucuacuuggcacuacgaugaggacaauccauauaaaacgugggccuaccacggcaguuaugaggucaagcccuccgggagcgcaucauccauggugaacggagugguccggcuccugacaaagccuugggauguuauuccaauggugacccagaucgccaugacugacaccacacccuucggucaacagagaguauuuaaagaaaagguggauacgcgcaccccgagggcuaaacgaggcacuacacagauuauggaggucaccgcgaaguggcuauggggguuccuuucucggaauaaaaagccuagaaucuguacuagggaagaguuuacacgcaaggugcguagcaacgccgcaauaggagcuguuuucguggacgaaaaucaguggaacagugccaaagaggcagucgaggacgaacgguuuugggaucuggugcauagagagagggaacuccacaagcaaggcaaaugcgcaaccugcguauacaauaugauggguaagcgcgagaaaaagcugggggaguucggaaaggcuaaaggcucccgagccauuugguacaugugguugggcgcgcgguuccuggaguuugaggcacucggguucaugaacgaagaccauugguuuagcagagaaaauucucuuucaggaguugaaggugagggccugcacaaguuaggguauauccugagggauaucaguaaaauuccaggaggcaacauguacgccgacgauacagcugguugggacacucgcauaaccgaggaugacuugcagaaugaagccaagaucacggauauuauggagcccgaacaugcacuccuggcuaccuccaucuucaaacuaacauaucagaacaagguggucagagugcagcggccugccaaaaacgggacugugauggacgucauuagcaggcgugaucaacgaggaucuggccagguuggcaccuacgggcuuaauacauuuacuaacauggaggugcagcugauccgccagauggaaucggagggaauauuccucccaucagagcuggaaacccccaauuuggcugagagagccuuagacuggcuggaaaagcacggugcagagcggcucaagaggauggcgaucagcggcgaugacuguguagugaaaccgauugacgaucgcuuugccacggcucuuacagcccugaacgacauggggaaggucagaaaagauaucccucaaugggaacccuccaagggauggaaugacuggcaacaggugccauucugcagucaccauuuucaccagcuaauuaugaaagauggccgggagaucguugugccuuguaggaaccaagacgagcuggucggucgagcacgugugucucagggggcuggauggagccucagagaaaccgccugcuugggcaaguccuaugcacagauguggcaacugauguacuuccaucgccgggaucuuaggcuggccgcgaaugcuauauguucagccguacccguugacugggugccaacaaguagaacaaccuggucuauucacgcacaccaucaguggaugacuaccgaggauaugcucagcgucuggaaccgcguguggaucgaagagaaucccuggauggaagacaagacacacguuuccucaugggaggaggugccuuauuuaggcaaacgggaagaucaguggugcgggagccugaucggauugacggccagggcuaccugggccacuaacauucaggucgcaauaaaucaagugcgaagacugaucgguaacgagaauuaccucgacuacaugacaucuaugaagcgguuuaaaaacgaauccgacagugagggcgcucuuugguga

SEQ ID NO: 14250 - RNA, 9879 nt, Artificial Sequence
  derived and/or modified CDS sequence (opt3) from DENV-1__HQ332180__SS-prME
agcgugaccaugcugcucaugcuucugcccacagccuuggcuuuccacuuaacuacgagaggcggggagccucauaugaucauuuccaagcaggaaaggggaaaaucucugcuauuuaagaccucagcaggugucaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagagggucgaaacuugggcucugcggcacccuggauucaccgugaucgcacuguuucucgcccaugcuauuggcacaucgaucacccagaagggcauaaucuucauuuuacugaugcuuguuacgccaucaauggccaugcgcugcguggggaucggaaacagagauuuugucgaggguuugagcggcgcgacuuggguggacguaguucuggagcacgggaguugugugacaaccauggcaaagaauaaacccacucuagauauugaacuccugaagacagaggucaccaacccugccgugcuuaggaaacugugcaucgaagcuaagauauccaauacgaccacagacucucgguguccaacucaaggagaggccaccuugguggaagagcaggaugcaaacuucgucugccgccgaacauuuguugacagaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucagcaucaaguugguaaugagacuacggaacacggcacaauugccaccaucacuccccaggcgccuaccucagagauccagcuuacagacuacggggcccugaccuuggacuguaguccaaggacuggacuagauuucaacgaaauggugcugcucacaaugaaggagaaaagcuggcugguccauaagcagugguuucuugaccugccguugcccuggacgucuggcgcauccaccucacaagagacuuggaaucggcaggaucuccuggugacauucaaaaccgcucacgccaagaagcaggaaguaguuguguuagguagccaagagggggcuaugcacacagcccugacuggcgcaaccgaaauucagacgaguggaaccacaacuauauuugccggccaucuaaaaugccgucucaagauggacaaacugacccuuaaggggaugucuuaugucauguguacaggauccuucaaauuggagaaggaaguggcugagacucagcacgguaccguccuggugcagguuaaguacgagggcacggaugcgccuugcaaaaucccauucagcacacaagacgaaaagggggugacccagaacggacgccucauuacugcaaaucccaucguaacagauaaagagaagccugucaacauagaaaccgagccacccuuuggcgagucguauauugugguuggugccggggaaaaagcucugaagcuuucuugguucaagaaaggcuccucaaucggaaagauguuugaggccacugcaagaggcgccaggcggauggcuauccugggggacaccgccugggauuucggaaguauugguggcguguuuacaagcgucgggaaauuggugcaucagguauucggaacggcauacggcgugcucuuuuccgguguuucuuggaccaugaagaucgggauuggcauacuguuaacuuggcugggacuaaauagccgaucaacaagucucuccaugaccuguaucgcggucggcauggugacacuguaccuuggggcuauggugcaggccgacagcggaugcgucauuaacuggaaaggccgcgaauugaagugugguucugggaucuucguuacuaacgaggugcacaccuggacggaacaauauaaguuucaggcagauucaccgaaaagacugagugccgcuaucggaaaggccugggaggagggcgugugcgguauuaggagcgcaacacggcucgaaaauauaauguggaaacagaucuccaacgagcugaaucauauuuuacuggaaaacgacaugaaguucaccguagucgugggcgacgcuaaugggauccuugcccagggaaaaaagaugauucgcccucaacccauggagcacaaauacucuuggaagucguggggcaaggcgaaaaucauaggggccgauauccagaacacuaccuuuauuaucgacggaccagauacaccugaaugucccgacggccagagagcuuggaauauuugggagguugaggauuaugguuucgggaucuuuacuaccaacauaugguugaagcucagggacagcuacacacagaugugcgaucaccgucugauguccgcagccauuaaagacucaaaggcugugcaugccgauaugggauauuggaucgaaagugagaaaaaugaaacguggaagcuagcacgggcgucuuucauugaggucaagaccuguacuuggccaaaaagccacacacugugguccaacggcgugcucgaaucagagaugaucauacccaagaucuacgguggcccuauuagccaacauaauuaucgaccaggguacuucacccagacugccggaccguggcaccugggcaaacuugaguuggacuuugaucugugcgaagggacaaccguugugguagacgagcacugcggaaacagaggccccucuuuaaggacgacuaccgucacagguaagaucauucaugaaugguguugccgcuccuguacccucccuccacugcgguucagaggggaggauggaugcugguacggcauggagaucaggcccgugaaagaaaaggaggaaaaucuugugcgcaguauggucagcgcugguucuggcgagguugacuccuuuucacuggggauauugugugugaguauuaugaucgaagagguaaugcgaagccgguggucgcguaagaugcucaugacuggaacacuggccguguuccuacugcucaucaugggccagcugaccuggaacgaccuuauuagauugugcaucauggucggggcaaaugcuuccgauaggaugggaaugggcacaacucaccuggccuuaauggcaaccuuuaaaaugcgcccuauguucgccgugggucuccuguuucggagacuuacgucuagggagguucugcuacucacaauugggcugagcuugauggcuucaauggaacugccaaacaguuuagaggaacucggagacggccuggcgaugggcauaaugaugcuuaagcuguugaccgaguuccaaccccaucagcucuggacuacccugcuaucccugacauuugugaaaacuacccuuucucucgauuaugccuggaagacgacagcaaugauccugagcauugucuccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcuauagggaucguuuccauucugcuaagcucgcugcuuaagaacgacgugccucucgccggaccccugaucgccggcgguauguugauugcuuguuacgucaucucagggucuagugcagauuuaucccuggagaaagccgcggaaguaagcugggagcaggaagcugagcacucuggagccagccauaauauacucguggaaguucaagacgauggcaccaugaagauuaaagacgaggagcgcgaugacacgcugacuauccuucugaaggcaaccuugcuagccguguccggcgucuauccaaugucaaucccugcuacacuguuugugugguacuucuggcagaaaaagaagcagcggagugggguacucugggauacccccagcccaccggaaguggagagagcaguccuggacgauggaauuuauaggauacuucagcgugguuuacugggccgcucucaaguuggggugggaguguuccaggacggcgucuuucacacaauguggcacgugacucggggugccguucucauguaccaggggaaaagauuggaaccuuccugggcgucaguaaagaaagaccugaucaguuauggaggcggcuggagguuccaggggagcuggaacaccggagaggaggugcaagucauugcuguggaacccgguaagaauccaaaaaacguucagacgacacccggcacuuuuaagaccccugagggggaagugggagccaucgcacucgauuucaagccaggcacauccgguucucccauugucaaucgagaggggaaaaucgugggacuguacggcaacggcguagucaccacuucggggaccuacgugagcgccauagcucaggccaaggcaucacaagaaggaccucuuccggagaucgaggacgaaguuuuuaaaaagcggaaucugacaauuauggauuugcauccagguuccggcaaaacgcgcagauaucuacccgcuaucgugagggaggccauuaagcggaagcugcgaacucucaucuuagcgccuaccagagucguggccagugaaauggcagaggcucugaaagggaugccaauacgcuaccagacaaccgccguuaagucugaacacacuggaagggagauuguggaccuuaugugccaugcuacauucaccaugcgucugcucagccccguccgggugccuaacuauaauaugaucaucauggaugaggcacacuuuacggacccggccuccauugccgcuagaggcuacaucucaacuaggguagguaugggggaagcggcagccauauucaugacagcuacccccccaggaucuguggaggccuuuccucagagcaacgcaguuauucaggaugaagagcgcgacauccccgaacgaaguuggaauuccggcuaugauuggauuaccgacuucccaggcaaaacugucugguuugugccuagcaucaagucugggaacgauauagccaauuguuugagaaaaaacggaaagcgggugauucaacugucaaggaagacauucgacaccgaguaccagaaaacaaagaacaaugacugggauuaugucguaacuacggacaucuccgagaugggugcuaacuuccgcgcggaucgugugaucgaccccagacggugccucaaaccaguuauucugaaggauggcccggaaagggugauccuugccgggccuaugcccgucaccguggcaagugcugcccagcgccgaggaagaauuggccggaaucagaacaaagagggugaccaauacguuuacauggggcagccacuaaauaacgaugaagaccaugcacacuggacagaggccaagaugcuguuggauaauauaaacacucccgagggcaucauuccugcuuuauuugaaccagagagggaaaagagcgccgcgaucgacggagaguaucgccugagaggcgaagcaaggaaaaccuucguggagcucaugcggcguggggaucugcccgucuggcuuucguacaagguggccucugagggauuucaguauuccgaccgccgauggugcuucgauggugaaagaaauaaccagguacuggaggaaaauauggacguggagaucuggacaaaagaaggcgagaggaagaaacuccggccucgcugguuggacgcuagaaccuacagcgauccgcuggcccuaagggaguuuaaggaauucgcugcagggcggcgaucaguuaguggagaccugauucucgagauaggcaaacuuccacaacaccugacuuuaagagcccagaacgcuuuggauaaucuggucaugcuccauaacucugaacagggugggaaggccuaucgccacgcaauggaggaacugcccgacacgaucgagacccuuaugcugcucgcguugauugccgugcugacaggcggagugacuuuauuuuuccuauccggcaaggggcugggaaaaaccagcaucggucuccuuugugucacagcuucaagugcccuguuguggauggcaagcguugagccucauuggauugcugccuccaucauacuggaauuuuuccucauggugcugcuuauccccgagccagauaggcagcggaccccucaagacaaucagcucgcauacguagugauuggccuguuguuuaugauccugacugucgccgcuaacgaaaugggguuacuagagacaacgaagaaagaucugggaauuggcuauguggcggccgagaaccaccagcacgcaaccaugcucgacguugaucuucgucccgcuucugccuggacucuguacgccguggcaacaaccgucaucaccccaaugaugagacauacaauagaaaauacuacggcuaacauuagcuugaccgccaucgcgaaucaagcugccauucugaugggucucgacaagggguggccuaucuccaaaauggauauaggcguaccgcugcuugcauuaggaugcuacucacaggugaacccccugacacucacugccgcuguuuugaugcugguggcacacuaugccaucauuggcccagggcuacaggcgaaggcuaccagggaggcccagaagcgcacagcagccggaaucaugaaaaauccuaccgucgacggcauuguggcuaucgaucuggaccccgucguguacgacgccaaguucgaaaaacaacucggucagauaaugcuucugauuuuguguacuucucagauccugcucaugcggacgacaugggcacugugcgagaguaucaccuuagcuacugggccacuuaccacacugugggaaggaucgccuggcaaguuuuggaacacuaccauugccguuagcauggcgaauaucuuccgagguuccuaucucgccggcgcagggcuagcuuucucucugaugaaaucauugggaggcgggagaaggggaacaggcgcccagggugagacgcugggggagaaguggaagcgccaacucaaccagcuuagcaaauccgaauuuaauaccuacaagcggaguggaauaauggagguggauagaucugaagcaaaagagggccugaagcguggugaaacuacaaaacaugcuguaagcaggggcaccgccaaguugcggugguucguggagcgcaaccuggucaagcccgaggggaaaguuauugaccucggauguggccgagggggauggucauauuacugcgccggcuuaaagaaagugacugaagucaaggguuauacaaaagggggaccgggccacgaggaaccaaucccuauggcgaccuacggcuggaaucuggugaagcuucauuccgggaaagauguauuuuucaugcccccagagaagugugacacgcugcuaugcgauauuggagaaaguagccccaacccuaccaucgaggaggguagaacacucagggugcugaagaugguugaaccgugguugaaaggcaaucaguuuuguauaaagauccugaaccccuacaugccaucuguggucgagacucucgaacagaugcaacggaaacacgggggaaugcuugugcgcaauccucuguccagaaacucaacccacgagauguauugggucagcugcggcacagguaauauugugucggcuguuaacaugacuucuaggauguuacugaaccgauucaccauggcacaucggaagcccacauacgagcgugacguagauuugggggccggaaccagacacguggcugucgaaccugagguggccaaucucgacaucauuggccagcgcaucgaaaacauuaaaaaugagcauaagaguacuuggcacuaugaugaagacaacccauacaagacgugggcauaucacggcuccuacgagguuaaacccagcgggucagccuccucuauggugaauggagucgugaggcugcuaacaaagccuugggauguaaucccaauggugacccagauagcuaugacugacaccacacccuuuggucaacagcggguuuucaaagagaaggucgacacgagaaccccgcgcgcgaaaaggggcacuacacagauuauggaagugaccgccaaguggcuuuggggguuucugagccgaaacaagaaaccucggaucuguacuagagaggaauucacaaggaaggugcgcaguaaugcagcuaucggagccgucuuuguugaugagaaccaguggaauuccgcaaaagaagccguggaggacgagcguuucugggaucucguacaucgggaaagagagcugcacaagcaaggcaaaugcgcuaccugcguguauaacaugauggguaagagggaaaagaaauugggggaguuuggaaaggccaaaggcagccgcgcgauuugguacauguggcugggcgcacgauuccucgaauucgaggcccuuggguuuaugaaugaggaccauugguucucucgggaaaacucacugaguggagucgagggugaaggcuuacacaagcugggguacauauugagagauaucuccaaaauuccaggaggcaauauguaugcugacgauacagccgguugggacacuaggaucaccgaggaugaccuccagaacgaggcaaagauuacggauaucauggaacccgagcaugcucugcuagccaccagcauauuuaaacuuacauaccagaauaaggugguucgcgugcagagaccugcuaagaacgggacugucauggacgugaucucucggagggaucaacguggaucgggccagguaggcaccuaugggcugaacacauucacuaauauggaaguucagcucauucgacagauggagucagaaggaaucuuucugccaagcgaguuggagacccccaacuuagccgaacgcgugcuggacuggcucgagaaacacggugcagaaagacuuaagcggauggcgauuuccggcgacgauugugucgugaaaccgaucgacgauagguucgccacggcucugacagcccuaaaugacauggggaaggugcgcaaagauauaccucaaugggagcccaguaagggauggaacgacuggcagcaggucccauuuugcucucaccauuuccaccagcugauuaugaaggauggcagagaaaucguugugccuugucggaaucaagacgagcucguagguagggcacgagugagccagggggcuggaugguccuugcgugagaccgccugccugggcaaaucauacgcacagauguggcaacuuauguauuuucauagacgcgaucugcggcucgccgcgaacgcuaucuguagugccguccccguggacuggguuccaacuucuaggacaaccuggagcauucacgcacaccaucaguggaugacuaccgaagauauguuauccguguggaauagagucuggauagaggaaaaccccuggauggaggacaagacacacgugucaagcugggaagagguaccuuaccugggcaaacgcgaggaccaguggugcgggucuuugaucggacugacggcccgggcuaccugggccacuaauauucagguugcaaucaaccaagugaggcgacucauugguaaugaaaacuaucuugauuacaugacauccaugaagagauucaaaaaugagagugacccagaaggcgcucugugguga

SEQ ID NO: 14251 - RNA, 9879 nt, Artificial Sequence
  derived and/or modified CDS sequence (opt3) from DENV-1__HQ332179__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugcuaguauaaugauugaagaggugaugcgaagccgguggucgcguaagaugcucaugacuggaacacuggccgucuuccuacugcucaucaugggccagcugaccuggaacgaccuuaucagauugugcauuauggugggggcaaaugcuuccgauaggaugggaaugggcacaacuuaucuggccuuaauggcaaccuuuaaaaugcgcccuauguucgccguuggucuccuguuucggagacuuacgucuagggaggugcugcuacucacaaucgggcugagcuuggucgcuucaguggaacugccaaacaguuuagaggaacucggagacggccuggcgaugggcauuaugaugcuuaagcuguugaccgaguuccaaccccaccagcucuggacuacccugcuaucccugacauuuguuaaaacuacccuuucucucgauuacgccuggaagacgacagcaauggugcugagcauagucuccuuguucccgcuguguuuaucaaccacuagccagaaaacaaccuggcucccuguacugcuugggaguuuuggaugcaagccacugacuauguucuugaucacagaaaacaagauuuggggucgaaaaucuuggccccucaaugagggcaucauggcuauugggaucguguccauacugcuaagcucgcugcuuaagaacgacguuccucucgccggaccccugaucgccggcgguauguugauugcuuguuaugugaucucagggucuagugcagauuuacugcucgagaaagccgcggaagucuccugggagcaggaagcugagcauagcggagccucucacaauauucugguggaaguacaagacgauggcaccaugaagaucaaagacgaggagcgcgaugacacgcuuacuauacuguugaaggcaacccuacuggccgugagcggcgucuacccaauguccauuccugcuacacucuuuguuugguauuucuggcagaaaaagaagcagcggucaggggugcugugggauacccccaguccaccggaaguggagagagcaguccuugacgauggaaucuacaggaucuuacagcguggucugcucggccgcagccaaguggggguuggaguauuccaggacggcguguuucauacaauguggcacgucacucggggugccguguugauguaucaggggaaaagacuggaaccuucuugggcguccguuaagaaagaccucauuucauacggaggcggcuggagguuccaggggaguuggaacaccggagaggaggugcaagucauagcuguggaacccgguaagaauccaaaaaacguacagacgacacccggcacuuuuaagaccccugagggggaagucggagccaucgcacuggauuucaagccaggcacaagcgguucccccauugugaaucgagaggggaaaaucguuggacuuuacggcaacggcguggucaccacuucugggaccuaugugucggccauugcucaggccaaggcaagccaagaaggaccucugccggagaucgaggacgaaguuuuuaaaaagcggaauuugacaauaauggaucuacacccagguucaggcaaaacgcgcagauaccugcccgcuaucgugagggaggccauuaagcggaagcuccgaacuuuaauccuggcgccuaccagagucguggccuccgaaauggcagaggcucuuaaagggaugccaauucgcuaucagacaaccgccguaaagagugaacauacuggaagggagaucguggaccugaugugccacgcuacauucaccaugcgucucuugucucccguucgggucccuaacuacaauaugauaauuauggaugaggcacauuuuacggacccggccagcaucgccgcuagaggcuauaucuccacuaggguggguaugggggaagcggcagccauuuucaugacagcuacccccccaggaucaguggaggccuuuccucagucuaacgcagucauccaggaugaagagcgcgacauacccgaacgaagcuggaauaguggcuacgauuggauuaccgacuucccaggcaaaacuguaugguuugugccuuccaucaagagcgggaacgauauugccaauugucugagaaaaaacggaaagcggguuauccaacucucuaggaagacauucgacaccgaguaucagaaaacaaagaacaaugacugggauuacguggucacuacggacauaucagagaugggugcuaacuuccgcgcggaucgugugauugaccccagacggugccugaaaccaguuauccuuaaggauggcccggaaagggugauccuagccgggccuaugcccgucaccguggcauccgcugcccagcgccgaggaagaauuggccggaaucagaacaaagagggugaccaauacguauauauggggcagccacugaauaacgaugaagaccacgcacauuggacagaggccaagauguuguuagauaauaucaacacucccgagggcauuauaccugcucuguuugaaccagagagggaaaagagugccgcgaucgacggagaguaccgccucagaggcgaagcaaggaaaaccuucguggagcugaugcggcguggggaucuucccguuuggcugagcuauaaggucgccucggagggauuucaguacucugaccgccgauggugcuucgauggugaaagaaauaaccaggugcucgaggaaaauauggacguggagauuuggacaaaagaaggcgagaggaagaaauugcggccucgcuggcuggacgcuagaaccuauuccgauccgcuagcccugagggaguuuaaggaauucgcugcagggcggcgaagcgucucaggagaccucauccuugagaucggcaaacugccacaacacuuaacuuugagagcccagaacgcucuggauaaucucguuaugcugcacaacagugaacagggugggaaggccuaccgccaugcaauggaggaacuucccgacacgauugagacccugaugcucuuggcgcugauagccguguuaacaggcggaguaacucuauuuuuccugucuggcaaggggcucggaaaaaccuccaucggucuucugugugugacagcuagcucagccuugcuguggauggcaugcgucgagccucacuggauugcugccaguaucauucucgaauuuuuccugauggugcuucucauccccgagccagauaggcagcggaccccucaagacaaucagcuggcauauguugugauaggcuugcuguuuaugaucuuaacugucgccgcuaacgaaauggggcuacuggagacaacgaagaaagaucucggaauuggcuacguagcggccgagaaccaucagcacgcaaccaugcuugacguggaucugcgucccgcuagcgccuggacuuuguacgccguugcaacaaccgugaucaccccaaugaugagacacacaauugaaaauacuacggcuaacaucucccugaccgccauagcgaaucaagcugccauucucaugggucuggacaagggguggccuaucucuaaaauggauauuggcgucccgcuuuuagcacugggauguuauagccaggugaacccccucacauugacugccgcuguccugaugcuaguggcacauuacgccaucauaggcccagggcugcaggcgaaggcuaccagggaggcccagaagcgcacagcagccggaaucaugaaaaauccuaccguugacggcauuguggcuaucgaucucgaccccguaguguaugacgccaaguucgaaaaacaacuuggucagauuaugcuguugauccugugcacuucccagauacuccugaugcggacgacaugggcauuaugugagucaauuacccuugcuacugggccacugaccacacucugggaaggaucuccuggcaaguuuuggaacacuaccaucgccgucaguauggcgaauaucuuccgagguucguaccuagccggcgcagggcuggcuuucagcuugaugaaaucccugggaggcgggagaaggggaacaggcgcccagggugagacgcucggggagaaguggaagcgccaacuuaaccagcugucuaaaucagaauuuaauaccuauaagcggagcggaauuauggagguugauagauccgaagcaaaagagggcuugaagcguggugaaacuacaaaacacgcugugaguaggggcaccgccaagcugcggugguucgucgagcgcaaccucgugaagcccgaggggaaaguaaucgacuuaggaugcggccgagggggauggucuuacuauugugccggccugaagaaagugacugaaguuaaggguuacacaaaagggggaccgggccaugaggaaccaauaccuauggcgaccuacggcuggaaucuugugaagcugcacagcgggaaagaugucuuuuucaugcccccagagaagugcgacacgcuacucugugauauuggagaaucaucccccaacccuaccaucgaggaggguagaacacugaggguguugaagauggucgaaccguggcugaaaggcaaucaguuuugcauuaagauccucaaccccuauaugccaagugugguugagacucuugaacagaugcaacggaaacaugggggaaugcugguacgcaauccuuuaagcagaaacucuacccacgagauguacuggguguccuguggcacagguaauauagucucagcugugaacaugacuagcaggaugcuguugaaccgauucaccauggcacaccggaagcccacauaugagcgugacguugaucucggggccggaaccagacauguggcugucgaaccugagguggccaaucuggacaucauuggccagcgcaucgaaaacauuaaaaaugagcacaagucgacuuggcauuacgaugaagacaacccauauaagacgugggcauaccacggcucuuaugagguaaaacccaguggguccgccagcucaauggugaauggaguugucaggcuacuuacaaagccuugggaugugaucccaauggugacccagauugcuaugacugacaccacacccuuuggucaacagcgggucuucaaagagaagguugacacgagaaccccgcgcgcgaaaaggggcacuacacagaucauggaagugaccgccaaguggcuguggggguuucucucccgaaacaagaaaccucggauaugcacuagagaggaauucacaaggaagguacgcucuaaugcagcuauuggagccguguuugucgaugagaaccaguggaauagcgcaaaagaagccguggaggacgagcguuucugggaucugguucaccgggaaagagaguugcauaagcaaggcaaaugcgcuaccuguguguacaacaugauggguaagagggaaaagaaacugggggaguuuggaaaggccaaaggcagucgcgcgaucugguacauguggcucggcgcacgauuccuugaauucgaggcccugggguuuaugaaugaggaccacugguucucccgggaaaacagcuuaucuggagucgagggugaaggccugcauaaguugggguauauccucagagauauuucaaaaauaccaggaggcaauauguacgcugacgauacagccgguugggacacuaggaucaccgaggaugaccugcagaacgaggcaaagauuacggauaucauggaacccgagcacgcucuacuugccaccaguauuuuuaaacugacauaucagaauaaggugguacgcguucagagaccugcuaagaacgggacugugauggacgucaucucccggagggaucaacguggaagcggccaggugggcaccuacgggcucaacacauucacuaauauggaagugcagcugauacgacagauggagucugaaggaaucuuuuugccaucggaguuagagacccccaaccuggccgaacgcguccucgacuggcuugagaaacauggugcagaaagacugaagcggauggcgauuucaggcgacgauugcguugugaaaccgaucgacgauagguucgccacggcucuaacagcccugaaugacauggggaagguacgcaaagauauuccucaaugggagcccagcaagggauggaacgacuggcagcaggugccauuuuguucccaccacuuccaucagcucaucaugaaggauggcagagaaauagucgugccuugccggaaucaagacgaguugguugguagggcacgagugagucagggggcuggauggucucugcgugagaccgccugucuuggcaaaagcuaugcacagauguggcaacugauguacuuucacagacgcgaucuccgguuagccgcgaacgcuauuugcuccgccguccccguggacuggguaccaacuucaaggacaaccuggaguauccaugcacaccaccaguggaugacuaccgaagauaugcugucuguuuggaauagaguguggaucgaggaaaaccccuggauggaggacaagacacaugucagcuccugggaagaggugccuuauuugggcaaacgcgaggaccaguggugugggucacugauuggacucacggcccgggcuaccugggccacuaauauacagguugcaaucaaccaagugaggcgacuuauugguaaugaaaacuaccuggauuacaugacaagcaugaagagauucaaaaaugagucugacccagaaggcgcucuaugguga

SEQ ID NO: 14252 - RNA, 9879 nt, Artificial Sequence
  derived and/or modified CDS sequence (opt3) from DENV-1__KR919820__SS-prME
accguggucgcacugcucaugcuucugcccaugguuuucagcuuucacuugacuacuagaggcggggaaccucauaugaucgugaacaagcaggaaaggggaaaguccuuacuguucaagacgucugguggcauuaauaugugcacccuaauagcuauggaccucggggaucugugugaggacacaaugacuuacaaaugcccacggaucaccgaagcggagccggaugacguggauuguuggugcaacgccacagacaccugggugacuuauggaauuuguucacccacaggcgaacaccgccgagagaagcguagugucgcgcuugcuccucaugugggucugggguuggagaccagagccgaaacguggaugagcuccgagggagcauggaaacaaauccagaggguugaaacuugggcccuccggcacccaggcuuuaccgugauugcucuguuccuggcacauaucauaggcacaucuaucacucagaagggggucauuuuuauccucuuaaugcuggugacccccucgauggccaugcgcugcgugggaguugguaauagagauuucguggagggccuuucaggggcuacaugggucgacgugguguuggagcacggaagcugugucaccacgauggccaagaacaaaccuacucuggauauugaacuacucaagacagagguuaguaauccagcggugcugaggaaacuuugcaucgaagcacggauauccaacaccacuacagacucucgcugucccacccagggcgaggccagccuguccgaagaacaagauacgaauuuuguaugccgaagaaccuugguggacagggguugggggaacggauguggccucuucggcaaggggucacugauuacaugcgcuaaauuugagugcuuaacuaagauggaaggaaagaucguccaguacgagaaucugaaauauagugugauuguuaccgugcacacaggugaucagcaucaggucggcaacgaaacuaccgggcacggaacaaccgccacuaucacgccucaagcaccaacaagcgagauccagcucaccgacuacggcgcucuuacucuggacuguucuccgcggaccgguuuggauuucaaugaaauggugcuacugacaaugaaggagaaauccuggcucguacauaagcagugguuucuggaccuuccccugccuugggccucaggggcgagcaguccacaggagaccuggaaccgucaagauuugcucguuacuuucaaaacagcccacgcaaagaaacaggaaguggucgugcugggcucucaggagggagcuaugcacacggccuuaaccggcgcuacugaaauucaaacauccgggaccacaacuauauuugccggacaucugaagugccgccuaaagauggacaaacucacccugaaggguaugagcuaugucauguguacgggcucguucaaacuuaagaaagagguggcagaaacccagcacgggacaguuuuggugcagguagaguacgagggaacugaugcccccugcaagaucccuuucaccacacaggacgaaaagggcgucauucaaaaugguagacugaucacugcuaacccaauagugaccgauaaagagaagcccguuaauauugaagcggagccgccuuuuggggagucuuauauggugaucggcgucggagacaaagcacucaagcuguccugguucaaaaagggcucaagucuugggaagauguuugaagccacggcuaggggagcccggcgaauggcaauccugggugauacagccugggacuucggcagcguagggggaguauuuaccuccaugggcaaauuggugcaucagauuuucgguacugcuuacgggguucucuuuucuggcgucagcuggacaaugaagaucggaauuggccuguuacugaccuggcuagggcucaacucacgcaguacuucccugagcaugaccuguauagccgugggaaucauuacacuuuacuugggcgugaugguccaggcagauacggguugcguugugaacuggaaagggagagagcugaaguguggaucuggcaucuucgugaccaaugaaguacacacuuggacagagcaguauaaauuucaagcggacucacccaagaggcucagugcugccaucgguaaggcaugggaagacggcgucugcgggauucggagcgccacccgccuggagaacauaauguggaaacagaucgcuaaugaguuaaacuacauucugcuugaaaaugauaugaaguucacagugguugugggagacgucaaaggcaucuugacucaggggaagaaaggaauuagaccacagccuauggagcauaaguauuccuggaaaucuuggggcaaggccaagaucauaggugcagaugugcaaaacaccacguuuaucauugacgggcccgauacaccagaaugucccgacucgcagagggcuuggaauaucugggagguugaagauuacggauucggcauuuuuaccacuaacaucuggcucaaacugcgugacagcuauacccaggugugcgaucaccggcuaauguccgccgcgauaaaggacucacgagccguacacgcugauauggguuacuggauugagagugagaaaaaugaaacauggaagcugucuagagccagcuucaucgaggucaaaacuuguaccuggccuaagucccauacacucuggucaaacggcgugcuggaaagcgagaugauuaucccaaagauauaugggggaccgaucucucagcacaauuacaggcccggcuacuucacgcaaaccgccgggccuuggcaucuuggaaaauuggaacuggacuuugauuuaugcgagggcacuacaguggucguugacgagcagugcgguaaccgcgggccaucccuccggaccacuacagugaccggaaagauuauccacgaaugguguugcagaaguuguacgcugcccccucuuagguucaaaggcgaggacgguugcugguauggcauggaaauucgcccaguaaaggagaaagaggaaaaucugguaaagagcauggucucugcuggguccggaaagguggauaacuuuucauugggccuccuguguaucaguauaaugguugaggaagugaugcgaagccgguggucggggaaaaugcuaaugacuggaaccauggccgucuuccugcuccuggugaugggccagcuuacauggaaugacuugauucguguuugcaucauggugggugcacacgcgcuggauuccauggggaugggaaccacuuacuuagcccucauggcuacauuuaagaucagacccaugcuggccgucggccuucuguucaggaaacuaaccucucgcgagauucuccuguugacaaucggccugagcuuaauuacuccgguagaacucccuaacucaauagaggagcugggggacggacuugcaauggguaucaugaugcugaaguugcucaccgauuuucaaccauaucagcugugggcuacgcuacugagucuuacauucgugaaaaccacucucucccugcauuacgccuggaagaccgcagccaugguuuugucuauugugagccuguuaccccucugucuguccacaacuucacagaagaccacguggcuuccuauccuguugggcagccucgggugcaaaccccugacaauguuucuaauuagugaaaacaagaucuggggacggagaucuuggccaauaaaugagggcaucauggcugucgguauuguguccauccugaugagcucgcuucucaaaaacgacguaccucuggcggggcccuugauugccggaggcauguuaguggcauguuaugucaucucaggcucuagugcugaucugacccucgaaaagacugccgagguuuccugggaagaggaggccgaacacagcgggacagcucauaauauacugguggaggugcaggacgauggaaccaugaaaauuaaggacgaagagagggaagauacucuuacaauccuguugaaagcagcccuacuggcgcucucuggugucuacccaaugagcaucccggcuacccuguucgugugguauuuuuggcaaaagaagaaacagcgauccggcguucuuugggacauuccuucacccccagagguagagaaggccguguuagaugacgggauauaccgcauccugcagcggggagucuucggcagaagucagguggguguugggguguuucaagaaggagucuuccacacgauguggcaugugacuaggggcgcaguacucaccuaccagggcaaacguuuggagcccagcugggccucugucaagaaagaccugauuuccuaugggggagguuggcgccuccagggcucauggaacgugggggaagagguucaggugaucgcugucgagccuggaaagaauccaaagaacgugcaaacaguucccggcaccuucaaaacacacgaaggugaggugggggcaauugcccuggauuuuaagccuggaacaaguggcagcccgaucgucaaucgggacggcaaagugguagggcuuuacggaaacggugugguuaccacguccggcacauaugucucugcgauagcucagucgaaggugagccaggaagggccacugcccgagaucgaagaugagguguucaaaaagaagaauuugacuauuauggaccuacacccuggaucaggcaaaaccagaagguaccugccagccaucguccgagaguccauuaagcggcgccucagaacauuaauccuggcacccaccaggguaguggccagugaaauggcugaggcccuuaaaggucugccuauacgguaucaaacuaccgcaguucgaaacgaacauacagggagagagauuguggaucucaugugccacgcuacguuuacuaugcgcuugcugucuccggucagggugcccaauuacaacaugaucaucauggacgaagcccauuucaccgauccagcgagcauugccgcacguggauauaucuccacacggguuggcaugggcgaggcugccgcuauauuuaugaccgcaacuccucccgggucagccgaggccuucccacagucuaauagcgugauuuacgacgaagagaaggauaucccugaaagaaguuggaacuccggauacgacuggauuacagauuuucaggguaaaaccgucugguucgugcccagcaucaagacgggcaaugacauagcuaacugucucaggaagaacgggaaacgcguaauucagcugucucgaaagacuuuugacacagaguaucagaagaccaaaaauucagauugggacuucgugguuaccacugauaucuccgaaaugggagcgaacuuuagagcagaccgggucaucgauccaaggcgcugccuuaaaccggugauucuacgugacggcccugagagagugauccuggccggucccaugccagucacaguugcuagugccgcacagcggagggggcgcauuggccgaaaucagagcaaggagggagaucaguacauauauaugggccaacccuugaacaaugacgaagaucacgcccauuggaccgaggcuaagauguuacuggacaacaucaauacaccugaagggauuaucccagcacucuucgagcccgagagagaaaaaucggccgcaaucgauggagaguaccggcugaggggugaagcucgcaagacuuucguggagcuuaugagaaggggcgaccugccuguauggcucucuuauaaaguggccuccgaagggauucaguacgcagaucggaaguggugcuuugacggagagcguaacaaucagauauuggaggaaaacauggacgucgagaucuggacgaaagaaggcgagcgcaagaaacugcgaccgagauggcuagaugccaggaccuauagcgacccacuggcucuccgggaguucaaggaguuugccgcgggucgcagaucagugaguggggaucuuauucuggagaucggcaaguuaccccaccacuugacacagagggcacaaaaugcccuggacaaccucguuaugcugcauaauucugaacagggaggccgggcuuaccgacacgccauggaggaacuuccugauacuauugagacccugaugcucuuggcuaugaucgcaacacugaccgggggaguggccuuauucuuucuauccgguaaaggccuggggaagacuagcauaggacuccuuugugucauggcuucaaguacgcuguuguggauggccagcguagaaccccauuggaucgcagcguccauugugcuggaguucuuucucaugguucugcuuaucccagagccugacagacagcgcacaccccaagauaaccaacucgccuacguggucauuggccuguuggugcugaucuuaaccgucgcugccaaugaaaugggucuacuggagacuaccaaaaaggaccucgggauaggcucugcagcugccgaaauucagcaccacacaaccauccuugauguggaccugcauccagcaagcgccuggacuuuguaugcuguugcgacaacggugauuaccccuaugcugaggcacacuaucgagaacacaaccgccaacaugucccucaccgcaauagcuaaucaggccgccauccugaugggacuugauaaaggcuggccgauuucaaagauggacaucgggguacccuuacuggcacucggaugcuacucucaagugaacccaaugacauugacugcugccguccugaugcuaguugcgcauuaugcuauuaucggcccuggucugcaggccaaggcaacgcgggaugcccagaaacguaccgcugcagggauaaugaagaaucccacaguggacggaauugucgccaucgaccucgauccagugguauacgacacuaaauucgagaagcagcuuggccaaaucaugcuguugauucuguguaccagucagauccuccugaugagaacaaccugggcguuuugcgaaucgauaacuuuagcuacggguccucuuacaacccugugggagggcagccccgggaaauucuggaacacuaccauugccguguccauggcaaauaucuuuaggggaucuuaucucgccggcgcugggcuagccuucucacugaugaaauccuugggaggcaaccgccgggguacaggggcacagggagaaacucugggcgagaaguggaaacgacagcucaaucaacuuagcaagcuggaauuuaacaccuacaaaagaagugguauuauggagguugauaggacagaggcuaaggaaggcuugaaacgcggggagacgacccggcacgccgugucuagaggaacugcgaagcugcguugguucgucgaaaggaaucucgugaagccggagggcaaagucaucgacuuaggguguggacggggcgguuggagcuauuacugcgccgggcugaagaaagugacagaaguuaagggauacaccaaaggcggcccagggcaugaggagccuauacccauggcaacuuauggauggaaccuuguaaagcugcacucagguaaagauguguucuuuaucccacccgaaaagugugacacacuacucugcgauauuggcgaguccaguccuaauccgaccaucgaagaggggcgcacgcugcgagucuugaagaugguggaacccuggcugagaggaaaccaguucuguauuaaaguucucaauccauacaugccuagcguggucgagacccuugagaggaugcagcggaagcacggcgguaugcuggugcgcaaccccuuaucuagaaauuccacacaugaaauguauuggguaucaugcgggacuggaaacaucgugagcgcuguuaauaugaccucgaggaugcuguugaaccgauuuacaaugacucaccggaaaccuaccuacgagaaggacgucgaucucggcgccggcacacgucauguggcaguggaaccagaggucgcuaaccuggacauuaucgggcagagaauagagaauauuaaaaacgaacacaagucuaccuggcacuaugaugaggacaaucccuacaagacuugggccuaucauggaaguuacgaaguuaaaccuuccgguagcgccucauccauggugaacggcguagugcgccuacuuacgaagccaugggacgucauccccauggugacacaaaucgcgaugaccgauacuaccccguucgggcagcagaggguuuuuaaagagaagguggacacacggacgccuaaagcuaagagaggaaccgcacaagucauggaaauuacugccggcuggcuguggaaguuccucucucgcaaaaagaaaccaaggauauguacacgagaggaguuuacccggaaggugagaagcaaugcugccaucggugcaguauucguugaugaaaaccaguggaauagugccaaagaggcuguggacgaugaaagguuuugggaccuggucaaccgcgagcgugaauugcacaagcaggggaagugcgcgacuugcguguacaauaugaugggaaaacgggagaagaaacugggcgaguucggcaaggccaaaggguccagagcaauuugguauauguggcucggagcuagguuucuugaguucgaggcccuggguuuuaugaacgaagaucauugguucagccgcgacaauucuuuaucaggcguggagggggaaggacugcacaaguugggcuacauccuccgagauauugcacggauccccggugggaacauguaugccgacgauacagcuggaugggacaccagaauaacagaggaggaucugcagaaugaagccagggucacugagcuaauggaaccugaccaugcgcaacuugcaaccaguaucuuccgccugacguaccagaacaaaguugugagaguacagcggccaggcaagaauggcaccgugauggacgucauuuccaggcgugaucagcgagggagcggacaaguggguacauauggccucaacacuuuuaccaacauggaggcccagcugauccgccagauggagucugaagggguuuucucgcccucagaguuggaaacaccgaauuuagcuaacagagugcuggacuggcucgagaaguacggagucgaacggcuuaaaaggauggccauuagcggcgaugacugugugguaaagccuaucgaugaccgcuuugcaacugcucugaccgcccuaaaugauauggguaaaguuagaaaggacauaccccagugggagccaucccggggguggaacgauuggcaacaggugccuuucugcagucaccacuuucaucagcugauuaugaaagacggaagggagaucgucgugcccugucgaaaucaggaugaacucguuggccgugcuagagugucucaaggcgccggguggagcuugcgcgagacggcaugccugggaaaguccuaugcgcagauguggcagcuuauguacuuccaccggagggaccugagacucgccgcuaacgccaucuguucagcagucccaguggacuggguacccacaagucgcaccacuuggucuauucaugcucaccaccaauggaugacaaccgaagauauguuaagcguguggaaucgggucuggauagaggaaaacccuuggauggaggacaagacucauguuaccuccugggaggaugugccauaccuggguaaaagggaagaccaguggugcggcucauugaucgggcugagcgcccgagcaacaugggccauuaauauccaggucgcgauuaaccaggugagaaagcucaucggaaaugagcacuaucaagauuacaugacgucuaugcggagguuuaaaaacgaauccgagccggaaggcgcucuuugguga

SEQ ID NO: 14253 - RNA, 9879 nt, Artificial Sequence
  derived and/or modified CDS sequence (opt3) from DENV-1__DQ285561__SS-prME
agcgugaccaugcugcucaugcuucugcccacagccuugacuuuccacuuaacgaccagaggcggggagccucauaugaucgucggaaagcaggaaagggguaaaucccugcuauuuaagacaucugcuggcguuaacaugugcacucucauugcaauggaccugggggagcuuugugaugacaccaugacauacaaaugcccacggauaaccgaaacugagccggaugacguggauuguuggugcaaugccacagaaaccuggguaacguauggaacuuguucacaaaccggcgagcaccgccgagacaagcguaguguggcgcuggcuccccaugucgguuuggggcucgagacaagaacugaaaccuggaugagcuccgagggagccuggaggcagauccagaaaguggaaacaugggcacugcggcacccuggcuucaccguuauugcccuguuucucgcucaugcaaucggcacgucuauuacucagaaggggaucauauucaucuuacugaugcuugugacaccaucgauggccaugcgcugcgucggaauugguaacagagauuuuguggagggcuugucaggggcuaccuggguagacguugugcuggagcacggaagcugugucacuacaauggccaaggauaaacccacccuagacaucgaacuccugaagacggaggugaccaauccugcggugcuuaggaaacugugcauugaagcaaagaucaguaacacaacuaccgauucccgguguccaacacaaggcgaggccacuuuggucgaagagcaggacaccaauuucguuugccgccgaacauuuguggauagagguugggggaacggauguggccucuucggcaaagggucucugauaaccugcgcuaaguuuaagugcguaacuaaauuagagggaaagauugugcaguacgaaaaucugaaauauagcgucaucgugacgguucacacaggugaccagcaucaagugggcaacgagaccacugaacacgggaccauugccacaaucaccccccaggcaccuacuuccgagauccagcucacagacuacggagcucuuacgcuggauuguucaccaaggaccggcuuggacuucaaugaaaugguccuacugacuaugaaggagaaaaguuggcucgugcauaagcagugguuucuggaucuuccgcugcccuggacaagcggugccucuaccucccaagagauuuggaaccggcaggacuugcucguaacauucaaaacugcgcacgccaagaagcaggaaguugugguccuggggucacaagagggcgcaaugcacaccgcuuuaacgggagccaccgaaauacagacaagcggcacuaccacaaucuuugcugggcaucugaaaugccgucuaaagauggauaaacucacucugaagggaauuaguuaugugauguguaccgguucuuucaaacuugagaaggaagucgccgagacgcagcacggcacaguguugguucaggugaaguacgaggggaccgacgcaccuugcaaaaucccauucuccagccaagaugaaaagggaguaacucagaauggccgccuggucacagccaaccccauagugaccgacaaagagaagccuguuaauauugaagcugagccacccuuuggugagucguauaucguggucggggcgggcgaaaaagcacucaagcugucuugguucaagaaaggauccucaaucggcaagauguuugaggccacugcuagaggggccaggcggauggcaauucuuggagauaccgccugggacuucgguaguaucggcgggguguuuacaagcguaggaaaacuggugcaucagauuuucggcacggcuuacgguguuuuguuuuccggggucucuuggaccaugaagauaggcaucggaauucuccugacuugguuaggccugaacagccgaucaacaagucuauccaugaccuguaucgccguggggaugaucacacucuaccugggagugaugguccaggcagauagcggcugcguuauuaauuggaaaggucgcgaacuuaagugugggucuggaauauucgugacuaacgaggugcacaccuggacggaacaauauaaguuucaggcggacucaccgaaaagauugagugcugccaucggcaaggcaugggaggaggguguaugcggcauuaggagcgccacacggcuggaaaacaucauguggaaacagauuuccaaugagcucaaccauauccuguuagaaaaugacaugaaguucaccgucgugguuggggaugugucuggaauacuggcucagggcaaaaagucgauccgcccucaacccauggagcacaaauacagcuggaaguccugggggaaggccaaaauuaucggagcagacguccagaacacuaccuuuauuaucgauggcccaaauacaccugaaugucccgacgaucagagagcuuggaacauaugggagguggaggacuaugguuucgggauuuuuacuaccaauaucuggcuuaaguugagggauucauacacacagguuugcgaccaccgucucaugagugccgcgauuaaagauucuaaggccgugcaugcugacaugggauauuggaucgaaagcgagaaaaacgaaacguggaagcuggcacgggccuccuucauagagguaaagaccuguaucuggccaaaaucacacacucuauggagcaauggcguccuggaaucugagaugauuauccccaagauuuacgguggcccuaucucccaacauaacuaucgaccaggguacuucacacagaccgcuggaccguggcaccucggcaaacuggagcuugauuuugacuugugcgaagggacuacagugguggucgaugagcacugcggaaauagaggccccagucugaggaccacgacuguuaccgguaagauaauucaugaaugguguugccgcagcuguacauuaccuccacuccgguucaaaggggaggacggaugcugguacggcauggagaucagacccgugaaggaaaaggaggaaaaccugguaaaaucuaugguguccgccgguucaggcgaggucgacaguuuuagccuugggcuguuguguaucucgauuaugaucgaagaggugaugaggucccgcuggucucgaaagaugcucaugaccggaacucuggcaguuuuccuacugcucacaaugggccagcugaccuggaaugaucuuauucgguugugcauaauggugggggcgaacgccagcgacaauaugggaaugggcacaacuuaucuggcuuuaauggccaccuuucguaugagaccuauguucgcagucggucuccuguuuaggcgccuuacgucacgggaggugcugcuacucacaguugggcugaguuugguggcuuccgucgaacugccaaacucuuuagaggaacucggagauggccuggccaugggcaucaugauucuuaaacuguugaccgacuuccaaagccaccagcucugggcaacucugcuaucccugaccuuuguaaagacaacuuucucacuucauuacgccuggaaaaccauggcuaugauccucagcauugugagucuguuucccuugugucugucuacgacaucccagaagaccacuugguuaccgguucuccuggggagccuuggaugcaagccucugacaauguucuugaucaccgagaacaaaauaugggguagaaagucguggccacucaaugaaggcaucauggcgguggggauugucucaauccugcuaucuagucugcuuaaaaacgaugugccccucgccggaccucugauugcaggcgguauguugaucgcuuguuauguaauauccgggagcucugccgacuuaagccuggagaaggccgcugagguguccugggaagaggaagcagagcacucaggagccagucauaauauucucgucgaaauccaggaugacggcacuaugaaaaucaaggaugaggagagggacgauacaauuaccauacugcuuaaagcgacgcuguuggcuaucagcggcguuuaccccaugucuauuccagccacucuauuugugugguauuucuggcaaaagaagaaacagcgauccggggugcugugggacaccccuucacccccagaagucgagcgcgcagugcucgaugacggaaucuaccggauucugcagagaggucuuuuaggcaggagucagguugggguaggaguguuccaagaaggcgucuuucacacaauguggcacgugacccguggugccguucugauguaucaggggaagcgccucgagccgagcugggcuuccgugaaaaaggacuugaucucuuacggaggcggcuggcgguuccaggggucguggaacacaggagaggaaguccaggugauagcaguagagccugguaaaaaucccaagaacguccaaacugccccaggcaccuuuaagacgagcgaaggggaggugggagcgaucgcucuggauuucaaacccggcacaucagguuccccuauuguuaauagagaagggaagaucgugggacucuacggcaacggcgucgugacuaccagugggacauauguuucugccauugcacaggccaaagcuagccaggagggaccacugcccgagaucgaagacgagguguuuaggaagcgaaaucuuaccauaauggaucugcauccugguuccggcaaaacucggcgcuacuugccggccauugucagagaagcaaucaagaggaagcuacggacccuggugcucgcuccaacacgaguaguggccucagagauggcggaagccuuaaaagggaugcccaucagauaucaaacgacugcaguuaagucugagcacaccggacgcgagauugucgaccugaugugccaugcuacauucaccaugaggcuucugagcccugugcgugugccaaacuacaauaugaucauaauggaugaagcccacuuuacugaccccgcuaguauugcagcccggggcuauaucuccacaagagucgguaugggggaggccgcugcgauuuucaugaccgcaacgccuccgggaagcguagaagccuuuccccagucuaacgcugugauccaggaugaggaaaaagacauaccagagaggucauggaauuccggcuacgauuggauuacuggcuucccugggaagacaguuugguuugugcccaguaucaaaagcggaaacgacaucgccaauugucuccgcaagaacgguaagcgagucauucaguugucgagaaaaaccuucgauaccgaguaucaaaagacuaaaaacaaugacugggacuacgugguuacaaccgauaucucugaaaugggcgcaaacuuccgggccgacagggugauugauccacgccguugccugaagccugucauacucaaagacgggcccgagagagugauccuggcuggaccaaugccgguaacaguggcguccgccgcacagcggaggggccgcauuggucgaaaucagaacaaggaaggggaucaguacaucuauaugggccaaccucuuaauaacgacgaggaucaugcucacuggacugaggccaagaugcuacuggacaauaucaacacgcccgaaggaauuauaccagcauuguuugagcccgaaagagagaaaagcgccgcuaucgauggcgaauaccgguuaaggggggaggcccgcaagaccuucguugagcugaugagaaggggagaccucccugucuggcugucauauaaaguggcgagugaagguuuucaguacucugaucggcguuggugcuucgacggcgagcgcaauaaccaggugcuugaagagaauauggaugucgaaauuuggacaaaggagggggagcgaaaaaagcugagaccaagguggcucgacgcacggacuuauuccgaccccuuggcccugcgcgaauuuaaagaguucgcugccggaagaaggagcguuucaggcgaucuaauccuggaaauugguaagcucccucagcaccuuacccaacgggcucagaacgcacuggacaauuuagugauguugcauaacagugagcaggggggcaaggccuaccgacacgcuauggaagagcugccggauacaaucgagacccucaugcugcuugcccugauagcaguacucacuggaggcgugacguuguuuuuccugagcgggagaggauuagguaaaaccuccaucggccuacugugugucaugucuagcuccgcgcuccuuuggauggccucaguggaaccacauuggauugcugccucuaucauucuggaguuuuucuugaugguucugcucauccccgaaccugaccgccagaggacaccccaagauaaucagcuggcauauguggucauagggcuucucuuuaugauucugacuguagcugccaacgagaugggauugcuggagaccacaaagaaagacuuaggcaucggucacgcagccgcugaaaaccaccaucacgcggccaugcuagauguggaccugcauccagcaagugcuuggacccucuacgccguugccacuacaauuaucacgccuaugaugcggcacaccauagagaauacuacagcaaacaucucgcuuaccgcuauugccaaucaggcggcuauccugaugggguuggauaagggcuggcccauuagcaaaauggacaucggagugccacugcucgcccugggcugcuacucccaagucaacccucuuaccuuaacagcagccgugcugaugcucgucgcucauuaugcaauaauugggccgggauugcaggccaaggcgacucgugaagcucagaagagaacggccgcaggcaucaugaaaaaucccaccguggaugguaucguugccauugaccuggauccagugguauacgacgcuaaguucgagaaacagcuagggcaaaucaugcugcucauacuuuguacaucucagauucuguugaugaggacuaccugggcccugugcgaaucaaucacacucgcaaccggaccucugacuacguuaugggagggcagccccgguaaguuuuggaacacaaccauugcuguguccauggccaauaucuuccgcggcaguuaucuugcgggggccggacuggcauucucucucaugaaaagccuaggcgggggacggcgaggcacuggugcucagggggagacccugggagaaaaguggaagagacaguugaaccaacugucaaaauccgaguuuaauauauacaagaggaguggcaucgucgaaguugaccgcagcgaggccaaagaaggucucaagcggggcgagacaauuaaacacgcagugucuagagggacugcuaagcuucguugguucgucgagaggaaccuggugaagccagaaggaaaaguaaucgauuugggcugugggcggggaggcugguccuauuacugcgccggucugaagaaagugaccgagguuaagggguauacaaaaggaggcccuggccacgaagagcccauuccgauggccacguacggguggaaucucgugaaguuauacucaggaaaagacgucuuuuucaucccaccugaaaagugugauacccugcuuugcgacauuggugagagcucgcccaacccaacuaucgaggaaggccgcacacugcgagugcuaaagauggucgagcccuggcucagagggaaucaguuuuguauaaaaauucugaacccuuauaugccgucugugguugaaaccuuggagcagaugcagaggaagcauggaggcaugcugguacggaauccccucagucgcaacuccacucacgagauguacugggugagcugcgguacagggaauaucgucucagcggugaacaugaccuccagaaugcuucugaacagguucacgauggcucaucgaaaaccaaccuaugaacgggauguugacuuaggagcaggcacacgucacguggccgucgagccugaaguggcuaaucuggauaucauuggccaaagaauagagaacaucaagaaugaacacaaaucuacuuggcauuacgacgaggauaaccccuauaagaccugggccuaccacgggagcuaugagguaaagccuaguggauccgcaagcucuauggugaaugguguuguccgcuugcucacaaaaccaugggacgugauucccauggugacucagaucgccaugaccgauacaaccccuuuuggccagcaaagggucuucaaggaaaaaguugacacucggacgccaaaggcuaaaagagggacagcgcagauuauggaggugaccgccaaguggcuguggggauuucuaucacgcaacaagaaacccaggaucuguacucgagaagaguucacccggaagguaagaaguaaugcagcuauaggcgccguguuugucgacgaaaaccaguggaauuccgcaaaagaggccguggaggaugaaagguucugggaccuuguucgccgugagcgggaacugcauaagcaggguaaaugcgcuacaugcguguacaacaugauggggaagagagagaagaaacucggagaauuuggcaaggccaaaggcagcagggcgaucugguacauguggcugggggcacgcuucuuggaguucgaggcccugggauuuaugaaugaagaucacugguucucucgagagaacucgcucucaggugucgaaggcgaggggcuucauaagcugggauauauuuuacgggacaucagcaaaauuccgggcgguaauauguacgcugaugacacggccgggugggauaccagaaucacugaggacgaucugcaaaacgaagcaaagauaacagacauuauggagccugaacacgcuuugcucgccaccuccaucuuuaaacugacuuaucagaauaaggugguaaggguucagcgcccagcuaagaacggaacagugauggaugucaucaguagacgggaccagaggggcucuggccaaguggggaccuacggacuaaacacauucacuaauaugggugcccagcuuauucgucagauggagagcgaaggcauauuuucccccucagagcuggagaccccuaaccucgcagggcgagugcuggauugguuggaaaaacacggaaucgagcgcuuaagacggauggcgauuaguggcgacgacugugucguuaagccaaucgaugacagguucgccacggcucugaccgcccucaaugauauggguaaagugcgcaaggacauuccccagugggaaccgucuaaaggguggaacgauuggcaacagguaccuuuuugcagccaucacuuccaucagcuuaucaugaaggacggaagagagauagugguccccugucggaaucaggaugaacuggugggcagggcacgaguuucccaaggcgcuggguggucacuacgugagacagccugccugggaaagagcuaugcacagauguggcagcucauguacuuucacagacgcgacuugcggcuggccgcgaacgcuaucuguucugccgugccagucgauugggugccuacuuccaggaccacauggaguauucacgcacaucaccaauggaugacuaccgaggacaugcuuagcguauggaauagaguuuggaucgaagagaaccccuggauggaagauaaaacgcaugugucguccugggaggacgucccauaucuggguaagcgcgaagaccaguggugcggcucucucauuggguuaacagcccgggcuaccugggccacuaauauccagguggcaauuaaccagguuaggcgacugauaggaaaugagaacuacuuggauuacaugacaucaaugaaaagauucaagaaugagagcgaccccgaaggcgcucugugguga

SEQ ID NO: 14254 - RNA, 9879 nt, Artificial Sequence
  derived and/or modified CDS sequence (opt3) from DENV-1__DQ285562__SS-prME
agcgugaccaugcugcucaugcuucugcccacugcauuggcuuuccacuuaacuacgagaggaggggagccucauaugaucgucuccaagcaggaaagaggaaaaucucuguuguuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuggcaccccaugucggcuugggucucgagacuagaaccgaaacauggauguccucugagggggccuggaggcagauccagaaaguggaaacuugggcucugcggcacccuggauucaccguuauugcacuguuucucgcccauacaaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccaaggagaggcuacauuggucgaagaacaagaugccaacuucguuugccgccgaacuuuuguggacagaggcugggguaauggguguggacucuucggcaaaggcagccuguuaaccugcgcaaaguuuaagugcguaacaaaacuggaggggaagauagugcaguacgaaaaccucaaauauuccgucauugugaccguucacacuggagaucagcaucaaguggguaaugagacgacagaacacggcaccaucgcuacuauuacuccccaagccccuacaucagagauccagcuuaccgacuacggggcgcugacuuuggacuguaguccaaggacaggacuagauuucaacgaaaugguccugcucacgaugaaggagaaaagcuggcuggugcauaagcagugguuucuugaccugccguugcccuggaccucuggcgccuccacuucacaagagacauggaaucggcaggaucuccugguaaccuucaaaacagcacacgcuaagaagcaggaaguuguggucuuagguagccaagagggggccaugcacacugcucugaccggcgccacggaaauccagaccaguggaacaacuaccauuuuugcaggccaucuaaaaugccgucucaagauggacaaacugacacuuaagggggugucuuaugucauguguacuggauccuucaaauuggagaaggaaguggccgagacccagcacgguacgguucuggugcagguaaaguacgagggcacagaugcuccuugcaaaauaccauucagcacccaagacgaaaagggggucacucagaacggacgccucaucacagcgaaucccauugugaccgauaaagagaagccuguuaacaucgaaacugagccacccuuuggcgagucguauauagugauuggugcaggggaaaaagcccugaaacuuucuugguucaagaaaggcuccucaaucggaaagauguuugaggcuaccgccagaggcgcaaggcggauggccauccugggggacacagcuugggauuucggaaguauugguggcgucuuuacgagcguggggaaauugguacaucagguguucggaaccgccuacggcguucucuuuuccggugucucuuggacuaugaagaucgggauuggcauacuguuaacauggcugggacuaaauagccgaucaaccagucucuccaugacauguaucguggugggcauggucacucuguaccuugggguuauggugcaggcagacagcggaugcgugauuaacuggaaaggccgcgaauugaagugugguucugggaucuucguaaccaacgagguccacacguggacagaacaauauaaguuucaggcggauucaccgaaaagacugagugcugccaucggaaaggcaugggaggagggcgugugcgguauuaggagcgccacccggcucgaaaauauaauguggaaacagaucuccaacgagcugaaucauauuuuacuggaaaacgacaugaaguucacuguuguggucggcgacgcuaaugggauccuuacccagggcaagaaaaugauucgcccucaacccauggagcacaaauacucuuggaagucguggggcaaggccaaaaucauaggggcagauauccagaacacaacuuuuauuaucgacggaccagauaccccugaaugucccgacgaucagagagcuuggaauauuugggagguggaggacuauggcuucgguaucuuuacaacgaacauaugguugaagcucagggauagcuacacccagaugugcgaccaccgucugauguccgccgcgauuaaagauucaaaggccguucaugcugacaugggguauuggaucgaaagugagaaaaaugaaacuuggaagcuagcacgggccucuuucauugaggugaagacauguaucuggccacgaagccacacccugugguccaacggaguacucgaaucagagaugauaauccccaaaauuuacggcgguccuaucagccaacauaauuauagaccaggcuacuucacucagacagcugggccguggcaccugggaaaacuugaguuggauuuugaccugugcgaaggcaccacggucgugguggaugagcacugcgggaacaggggacccucuuuacgcacuaccacagucaccggcaaaauuauccaugaaugguguugccgguccuguacucucccuccacugagauucaagggugaggacgggugcugguacggaauggagauaaggcccguuaaagaaaaggaggaaaaucuugugcgcaguaugguaagcgccggcucuggugagguggacuccuuuucacugggcuugcucugugucaguauuaugguggaagagguuaugcgaagccgguggucgcguaagaugcugaugacagggacccuagcaguguucuuucugcucaucaugggacagcugacauggaacgaucuuaucagauugugcauuauggucggcgcgaauguguccgacaggauggggaugggaacuaccuaucuggccuuaauggcuacguucaaaaugcgcccuauguuugccguuggccuccuguuccggagacuuacaucuagggaggugcugcuacucaccaucggucugagcuuggucgcaucaguagaacugccaaacaguuuagaggaacucggggauggacuggcuaugggcauuaugaugcuuaagcuguugacugacuuucaaucccaccagcucuggaccacacugcuaucucugacuuucauaaaaaccacgcuuagccucgauuacgccuggaagacaaucgcaauggugcuguccauuguuucauuguuuccccuguguuuaagcaccacaagucagaaaacaaccuggcucccggugcugcuuggcucuuucgggugcaagccucugacuauguuuuugaucacagagaacaagauuuggggacgaaaauccuggccacucaaugaagguaucauggccgucggcauagugagcauccugcuaucgucacugcuuaagaacgacguaccccucgcugggccucugauugcgggaggcauguugaucaccuguuaugugauuucugguaguuccgccgauuuaagccuggagaaagcagcugaggucucuugggaagaggaagccgagcauagcggggccucccacaauauccucguugaagugcaggacgauggaacgaugaagauaaaagacgaggagcgcgaugacacucugaccauucuucugaaggcuacauugcuagcagugucaggcgucuaccccaugaguaucccagccacccuguucgugugguauuucuggcagaagaagaagcagcggagcggcguucucugggauacaccuucucccccagaaguagagagagcggugcuggacgacgggaucuacaggauucuucagcguggauuacugggucgcucccaggucggcguggggguuuuucaagauggaguguuccauacuauguggcacgucacccggggcgcugugcucauguaucaggguaaaagauuggaaccgucaugggccaguguaaagaaagaccugauaagcuacgggggaggcuggagguuucagggcuccuggaacacgggggaggagguccaggugaucgcaguugaaccuggaaagaaucccaaaaacgugcaaacaacuccagguaccuucaagacacccgagggcgaagucggggccauugcucucgauuuuaagccuggaaccucuggcucgccaaucgugaaucgagaggguaaaauuguugggcuguacggaaacggcguggucacuaccagcggcacauaugugucagcaaucgcccaggcgaaggcuucccaggaagggccccuuccugagauagaggacgaaguauucaaaaagcggaaucugacgaucauggauuugcacccgggaagugguaaaacucgcagauaccuaccagccauugugagggaggcaaucaagcggaagcugcgaacccucauuuuagcccccacaagaguugucgcuucugaaauggccgaggcacugaaaggcaugccuauccgcuaucaaaccacugcuguaaagagcgaacauacagggagggagauaguggaccuuaugugccacgccaccuuuacgaugcgucugcucuccccaguccggguacccaacuacaauaugauuaucauggaugaggcgcauuucacugacccugccucaaucgcagcuagaggauauauuucuacaagggugggcaugggugaagccgcugcaaucuuuaugaccgccaccccgcccgggagcguugaggccuucccacagaguaacgcugugauacaggaugaagaacgcgacauuccugaacgauccuggaauagcggauacgauuggaucacugacuuucccggcaaaacagucugguucgugccaucuauuaagucaggcaacgacaucgcgaauuguuugaggaagaacgggaagcggguuauacagcuguccaggaagaccuucgauacagaguaucagaagacuaagaacaaugacugggauuacguggucacgaccgacauuagugagaugggagcaaacuuucgcgccgaucgugugaucgacccuagacggugccucaaacccguaauccugaaggaugguccagaaagggugauucuugcuggcccgaugccuguuacagucgccagcgcagcccagcgccgagggagaaucggacggaaucagaacaaagagggcgaccaguacauuuauaugggucaaccccuaaauaacgaugaagaccacgcucauuggacugaggcgaagaugcuguuggauaauauaaacaccccagaggggaucauucccgccuuauucgaaccugagagggaaaagucggcagcuaucgacggcgaguaccgccugagaggagaagccaggaaaacauuuguggagcucaugcggcguggcgaucugccaguguggcuuucuuauaaggucgcauccgagggguuccaguacagcgaccgccgauggugcuuugacggagaaagaaauaaccagguucuggaggaaaauauggauguggagaucuggaccaaagaaggugagaggaagaaacuccggccccgcugguuggacgccagaacuuauucagauccucuggcucuaagggaguucaaggaauuugccgcgggccggcgaaguguaucuggggaccugauucucgagauaggaaaacuuccgcagcaccugacguuaagagcacaaaacgccuuggauaaucuggugaugcuccacaacuccgaacagggcgguaaggcuuaccgccaugccauggaggaacugccagacaccaucgagacacuuaugcugcucgcuuugauugcaguccugacugggggcgugaccuuauucuuucuaagcggaaagggccuggggaaaacaucaaucggacuccuuuguguuauggccaguagcgugcuguuguggauggcuuccgucgagccccacuggauugccgcaucuaucauacuggaguucuuucucaugguacugcuuaucccugagcccgauaggcagcggaccccacaggacaaucaacucgcguaugugguuauuggucuguuguucaugauccugacuguggccgcuaacgaaaugggcuuacuagagacaacgaagaaagaucuggggauuggacaugccgucgcagagaaccaccaccaugcuaccaugcucgacaucgaucuucacccugccagcgcauggacucuguacgccguggcuacaaccauaauuacccccaugaugcgucauacaaucgaaaauacuacggcgaacauuuccuugaccgccaucgcaaaucaggcugccauacugaugggccucgacaaggguuggccaaucucaaaaauggauauuggggucccucugcuugccuuaggcugcuacucucaggugaacccgcugacacucacugcagcuguuuugaugcugguggcccacuaugcgaucauuggacccggccuacaagcuaaggccaccagagaggcacagaagaggacagccgcugggaucaugaaaaauccaaccguagacggaauaguggcaauugaccuggauccugucguuuacgacgccaaguuugaaaaacagcucggccagaucaugcuucugaucuuguguaccagucaaauucugcucaugcgcacgacaugggcgcugugcgagucgaucaccuuagcuacugguccccuuaccacacugugggaagggagcccaggaaaguucuggaacacuaccauagccguguccauggcaaauauuuuccggggcucuuaucucgccggugcuggccuagccuuuucacugaugaaaagccuagggggaggccgaagagggacaggagcacagggcgagacgcugggugagaaguggaagaggcagcucaaccagcuuuccaagagugaguucaauaccuacaagcgcucugggaucauggaggucgaucggagcgaagcuaaagagggacugaagagaggcgaaacuacaaaacaugccgugucacgugguaccgcgaaguugaggugguuuguagagcggaaccuggugaagccugagggcaaaguuauugaccucggguguggacgcggcgggugguccuauuacugcgccggauuaaagaaagugacugaagucaagggcuauacaaaaggugggcccggacacgaggaaccgaucccaauggcaaccuacggcuggaaucuggugaaacuucacaguggcaaagaugucuucuuuacgccucccgagaagugugacacccugcuaugcgauauaggggaaagcucuccaaaccccacaaucgaggagggacgaacucucagagugcugaagaugguugaaccuugguugagggguaaucaauucuguauuaaaauccugaacccguacaugcccuccguaguggagacccucgaacagaugcagcggaagcauggcgggaugcuuguccgcaauccacugucaagaaacagcacacacgagauguauugggugucgugcggaacuggcaauauuguuucugcugugaacaugaccaguaggauguuacugaaccgauuuacaauggcccaucggaaaccuaccuacgagcgugacgucgauuugggugcagggacuagacacguggcuguagaacccgagaucgccaaucucgacauuaucggacagcgcauagaaaacauuaagaaugagcacaaauccacguggcauuaugaugaagacaacccuuacaagacaugggccuaucacggcagcuacgaggugaagccaucaggcuccgcgucuagcaugguuaauggggucgugaggcugcuaaccaaacccugggacgugaucccuauggucacucaaaucgcuaugaccgauacaacgccauucggacagcagcggguuuuuaaggagaaaguggacaccagaacuccccgcccgaagagggguacagcacaaauuauggaaguaaccgccaaauggcuuuggggcuuccugagucgaaacaagaagccucggauauguacuagagaggaauuuacaaggaaagugcgcuccaaugcugccaucggggcagucuucguggaugagaaccaguggaauagcgccaaggaagcuguugaggacgagcguuuuugggaucucgugcaucgggaaagagagcugcacaaacagggaaagugcgcgaccugcgucuauaacaugaugggcaaaagggaaaagaaguugggugaguucgggaaagccaagggaucucgcgcaauuugguacauguggcugggcgcucgauuccucgaauuugaggcccuuggcuucaugaaugaggaccauugguuuucacgggaaaacagucuguccgggguggagggagaagguuuacacaaacugggcuacaucuugagagauauuagcaagaucccagggggaaauguauaugcagacgauacagccggcugggacacuaggauaaccgaggaugaccuccagaacgaggcuaaaaucacggauauuauggaacccgagcacgcccugcuagcgaccucuaucuucaaacuuacauaccaaaauaaaguugugcgcguccagagaccugcaaagucggguacugugauggacauuaucucacggagggaccagcgugggagcggacaggugggcaccuauggccugaacacauuuacuaacauggaaguccaacucauacgacagauggaguccgaagggauuuucaguccaucugagcuggagaauagcaacuuggccgaacgcguuuuagauuggcuggagaagcauggaguggaaagacucaaacggauggcuaucuccggugacgauuguguagugaagcccaccgacgauagguuugccacggcacuuacagcucugaaugacaugggcaaaguccgcaaggauaucccgcagugggagccuucaaaaggguggaacgacuggcagcaagugcccuucugcagucaccauuuucaccagcuaauuaugaaggauggaagagaaauaguugugccaugucggaaucaggacgagcuggucggcagggcccgagugucucagggugcuggguggagccuccgugagaccgccugcuugggaaaguccuacgcacaaauguggcagcugauguauuuccacagacgcgaucuucggcuggcggccaacgcuaucuguucagccguaccuguugacugggugcccacuagcaggacaaccuggucuauucaugcacaccaucaguggaugacuaccgaagacaugcucuccgucuggaauagaguguggaucgaggaaaacccauggauggaggauaaaacacacguuaguagcugggaagacgugcccuacuuaggcaagcgcgaggaucaauggugcggcucgcugauuggguugacggcucgggccaccugggcaacuaauauccaggucgccauaaaacaggugaggcgacugaucggaaacgagaauuaucucgacuacaugacauccaugaagagauuuaaaaacgaaucugauccugagggugcgcuuugguga

SEQ ID NO: 14255 - RNA, 9879 nt, Artificial Sequence
  derived and/or modified CDS sequence (opt3) from DENV-1__DQ285558__SS-prME
agcgugaccaugcugcucaugcuucugcccacagccuugacuuuccacuuaacgacccgaggcggggagccucauaugaucgucggaaagcaggaaagggguaaaucccugcuauuuaagacaucugcuggcguuaauaugugcacucucauugcaauggaccugggggagcuuugugaugacaccaugacauacaaaugcccacggauuaccgaaacugagccggaugacguggauuguuggugcaaugccacagaaaccuggguaacguauggaacuuguucacaaaccggcgagcaccgccgagacaagcguaguguggcgcuggcuccccaugucgguuuggggcucgagacaaggacugaaaccuggaugagcuccgagggagccuggaggcagauccagaaaguggaaacaugggcacugcggcacccuggcuucaccguuauugcccuguuucucgcucaugcaaucggcacgucuauuacucagaaggggaucauauucaucuuacugaugcuugugacaccaucgauggccaugcgcugcgucggaauugguaacagagauuuuguggagggcuugucaggggcuaccuggguagacguugugcuggagcacggaagcugugucacuacaauggccaaggauaaacccacccuagacaucgaacuccugaagacggaggugaccaauccugcggugcuuaggaaacugugcauugaagcaaagaucaguaacacaacuaccgauucccgguguccaacacaaggcgaggccacuuuggucgaagaacaggacaccaauuucguuugccgccgaacauuuguggaucgggguugggggaacggauguggccucuucggcaaagggucucugauaaccugcgcuaaguuuaagugcguaacuaaauuagagggaaagauugugcaguacgaaaaucugaaauauagcgucaucgugacgguucacacaggugaccagcaucaagugggcaacgagaccacugaacacgggaccauugccacaaucacaccccaggcaccuacuuccgagauccagcucacagacuacggagcucuuacgcuggauuguucaccaaggaccggcuuggacuucaaugaaaugguccuacugacuaugaaggagaaaaguuggcucgugcauaagcagugguuucuggaucuuccgcugcccuggacaagcggugccucuaccucccaagagacauggaaccggcaggacuugcucguaacuuucaaaaccgcgcacgccaagaagcaggaaguugugguccuggggucacaagagggcgcaaugcacacggcuuuaaccggagccacagaaauucagacuagcggcaccacaacuauauuugcugggcaucugaaaugccgucuaaagauggauaaacucacccugaagggaaucaguuaugugauguguacggguucuuucaaacuugagaaggaagucgccgagacacagcacggcaccguguugguucaggugaaguacgaggggacugacgcaccuugcaaaauuccauucuccagccaagaugaaaagggaguaacacagaauggccgccuggucaccgccaaccccaucgugacugacaaagagaagccuguuaauauagaagcugagccacccuuuggugagucguauauuguggucggggcgggcgaaaaagcacucaagcugucuugguucaagaaaggauccucaaucggcaagauguuugaggccaccgcuagaggggccaggcggauggcaauccuuggagauacagccugggacuucgguaguauuggcgggguguuuacgagcguaggaaaacuggugcaucagaucuucggcaccgcuuacgguguuuuguuuuccggggucucuuggacuaugaagauuggcauaggaauccuccugacaugguuaggccugaacagccgaucaaccagucuauccaugacauguauugccguggggcucaucacucuguaccuuggagugaugguccaggcagauagcggcugcguuaucaauuggaaaggucgcgaauugaagugugggucuggaauuuucgugaccaacgaggugcacacguggacagaacaauauaaguuucaggcggacucaccgaaaagacugagugcugccauaggcaaggcaugggaggaggguguaugcggcaucaggagcgccacccggcucgaaaacauuauguggaaacagaucuccaaugagcugaaccauauuuuacuggaaaaugacaugaaguucacugucgugguuggggaugugucuggaauccuugcucagggcaaaaagucgauacgcccucaacccauggagcacaaauacagcuggaaguccugggggaaggccaaaaucauuggagcagacguccagaacaccacauuuaucauugauggcccaaauacuccugaaugucccgacgaucagagagcuuggaacaucugggagguggaggacuaugguuucgggauauuuaccacaaauauuugguugaagcucagggauucauacacgcagguuugcgaccaccgucugaugagugccgcgaucaaagauucuaaggccgugcaugcugacaugggauauuggauugaaagcgagaaaaacgaaaccuggaagcuagcacgggccuccuucaucgagguaaagacuuguauauggccaaaaucacacacacuguggagcaauggcguccucgaaucugagaugaucauucccaagaucuacgguggcccuauuucccaacauaacuaucgaccaggguacuucacccagacugcuggaccguggcaccugggcaaacuugaguuggauuuugaccugugcgaagggacaaccgugguggucgaugagcacugcggaaauagaggccccaguuuaaggacgacuaccguuacagguaagaucauacaugaaugguguugccgcagcuguacccucccuccacugcgguucaaaggggaggacggaugcugguacggcauggagauuagacccgugaaggaaaaggaggaaaaccuuguaaaaucuaugguguccgccgguucaggcgaggucgacaguuuuagccugggguugcucuguaucucgaucaugauugaagaggugaugaggucccgcuggucucgaaagaugcugaugacuggaacacuagcaguuuuccugcuccugaccaugggccagcuuacauggaaugauuugauccggcugugcauuauggugggggcgaacgccagcgacaauaugggaaugggcacuaccuauuuagcucucauggccacguuucguaugagaccuauguucgcagucggucugcuuuuuaggcgccugacaucacgggaggugcuacuccugaccguuggguugagucugguggcuuccgucgaauuaccaaacucucucgaggaacugggagauggccuugccaugggcauaaugauccugaaauugcucacugacuuccaaagccaccagcugugggcaacccuacugucccuuacauuuguaaagacuaccuucucacuccauuacgccuggaaaacgauggcuaugauucugagcaucgugaguuuguuuccccuguguuuaucuacaaccucccagaagacuacauggcucccgguucugcuugggagccugggaugcaagccuuugaccauguuccucauuacugagaacaaaaucugggguagaaagucguggccacugaaugaaggcauaauggcgguggggaucgucucaauucuacugucuagucuucucaaaaacgaugugccccuggccggaccuuugaucgcaggcgguauguuaauugcuuguuauguaaucuccgggagcucugccgaccugagccucgagaaggccgcugagguguccugggaagaggaagcagagcacucaggagccagucauaauauacuggucgaaauucaggaugacggcacaaugaaaaucaaggaugaggagagggacgauaccaucacgauucuucugaaagcgacuuugcuagcuauaagcggcguuuaccccaugucuaucccagccacccuguuugugugguauuucuggcaaaagaagaaacagcgauccggggugcucugggacacaccuucacccccagaagucgagcgcgcagugcuggaugacggaauuuaccggauccuucagagagguuuacugggcaggagucagguugggguaggaguguuccaagaaggcgucuuucacaccauguggcacgugacacguggugccguucucauguaucaggggaagcgcuuggagccgagcugggcuuccgugaaaaaggaccugauuucuuacggaggcggcuggcgguuccaggggucguggaacacuggagaggaaguccaggugaucgcaguagagccugguaaaaaucccaagaacguccaaaccgccccaggcacguuuaagacaagcgaaggggaggugggagcgauagcucucgauuucaaacccggcacuucagguuccccuaucguuaauagagaagggaagauugugggacuguacggcaacggcgucgugaccacaagugggaccuauguuucugccaucgcacaggccaaagcuagccaggagggaccacuucccgagauugaagacgagguguuuaggaagcgaaaucugacuaucauggauuugcauccugguuccggcaaaacccggcgcuaccuaccggccauagucagagaagcaauuaagaggaagcugcggacacucguguuagcuccaacgcgaguaguggccucagagauggcggaagcccugaaagggaugcccaucagauaucaaacuaccgcaguuaagucugagcacacaggacgcgagaucgucgaccuuaugugccaugcuaccuucacuaugaggcugcucagcccugugcgugugccaaacuacaauaugauuaucauggaugaagcccacuuuacagaccccgcuaguauagcagcccggggcuauauuuccaccagagucgguaugggggaggccgcugcgaucuucaugacggcaacuccuccgggaagcguagaagccuuuccccagucuaacgcugugauucaggaugaggaaaaagacaucccagagaggucauggaacuccggcuacgauuggauaacagacuucccuggcaagaccguuugguuugugcccaguauuaaaagcgggaacgauaucgccaauuguuugcgcaagaacggaaagcgagucauccagcugucgagaaaaaccuucgacacugaguaucaaaagaccaagaauaaugacugggauuacgugguuaccacagacauuucugaaaugggugcaaacuuccgggccgauagggugaucgacccacgccguugccucaagccugucauucugaaagauggccccgagagagugauacuugcugggccaaugccgguaacuguggcguccgccgcacagcggaggggacgcaucggccgaaaucagaacaaggaaggugaccaguacauuuauauggggcaaccucuaaauaacgaugaggaccaugcucacuggacggaggccaagaugcuguuggauaauaucaacacccccgaaggcaucauuccagcauuauuugagcccgaaagagagaaaagcgccgcuauagacggagaauaccggcugaggggcgaggcccgcaagacauucguugagcucaugagaagaggggaucugccugucuggcuuucauauaaaguggcgagugaaggauuucaguacucugaccggcguuggugcuucgauggugagcgcaauaaccaggugcuggaagagaauauggacgucgaaaucuggacuaaggagggcgagaggaaaaagcucagaccaagaugguuggacgcacggaccuauuccgauccccuggcccuacgcgaauuuaaagaguucgcugccgggagaaggagcguuucaggagaccugauucucgaaaucggcaaacuuccucagcaccugacacaacgggcucagaacgcauuagauaauuuggugaugcugcauaacagugagcagggugggaaggccuaccgacacgcuauggaggaacucccggacaccauugagacucugaugcuucuggcccucaucgcaguauugacgggcggagugacccuguuuuucuuaagcggcagagggcuaggaaaaacauccauaggucugcucugugucaugucuagcuccgcgcuucuguggauggccucaguggaaccacauuggaucgcugccucuauuaucuuggaguuuuuccugaugguucuccugauucccgaaccugaucgccagaggacuccccaagacaaucagcuugcauauguggucaucggccuccuguuuaugauauugaccguagcugccaacgagauggggcuguuagagacaaccaagaaagaucuaggaauuggccacgcagccgcugaaaaccaccaucacgcggccaugcuggacguggaucuccauccagcaagugcuuggacucuuuacgccguugccacaacgaucauuaccccuaugaugcggcacacuaucgagaauacaaccgcaaacauaucgcugaccgcuaucgccaaucaggcggcuauuuugaugggucuggacaagggguggcccaucagcaaaauggauauuggcgugccacuccuggcccuuggaugcuacucccaagucaacccuuuaacacugacugcagccgugcucauguuggucgcucauuaugcaaucauaggcccggggcugcaggccaaggcgacgcgugaagcucagaagagaaccgccgcaggaauuaugaaaaaucccacaguggacggcaucguugccaucgaucuagacccagugguauacgacgcuaaguucgagaaacagcugggucaaauuaugcuccuuauccuguguacuucucagauauugcugaugaggaccacaugggcccucugcgaaucaauuacccuggcaacugggccuuuaacgacacuuugggagggaagccccggcaaguuuuggaacaccacuaucgcuguguccauggccaauauuuuccgcgguaguuaucuggcgggcgccgggcucgcauucucucuaaugaaaagccugggaggcgggcggcgaggaaccggcgcucagggugagacauugggggaaaaguggaagagacagcugaaccaacucucaaaauccgaguuuaauaucuacaagaggaguggaauagucgaaguugaucgcagcgaggccaaagaaggccuuaagcggggugagacuaucaaacacgcagugucuagaggcaccgcuaagcugcguugguucgucgagaggaacuuggugaagccagaagggaaaguaauugaccugggauguggcagaggcgggugguccuauuacugcgccgggcucaagaaagugacagagguuaaggguuauacgaaagggggaccuggccacgaggaacccaucccgauggccaccuacggcuggaauuuagugaagcuguacucagggaaagaugucuuuuucauuccaccugaaaagugugacacucuucugugcgauaucggagagagcucgcccaacccaacaauugaggaaggucgcacccuacgagugcucaagauggucgagcccuggcugagaggcaaucaguuuuguaucaaaauauugaacccuuauaugccgucugugguugaaacucuggagcagaugcagaggaagcaugggggaaugcucguacggaauccccuuagucgcaacuccacacacgagauguacugggugagcugcggcaccgguaauauugucucagcggugaacaugacguccagaaugcuguuaaacagguucaccauggcucaucgaaaaccaacauaugaacgggacguugaucugggggcaggaacucgucacguggccgucgagccugaaguggcuaauuuggacaucaucggccaaagaauugagaacauaaagaaugaacacaaaucuaccuggcauuacgaugaggacaaccccuauaagacaugggccuaccacggcagcuaugagguaaagccuaguggguccgcaagcucuauggugaauggaguuguccgccuccugacuaaaccaugggaugugauccccauggugacccagauugccaugacagacaccacuccuuuuggucagcaaagggucuucaaggaaaaaguugacacgcggacaccaaaggcuaaaagaggcaccgcgcagaucauggaggugacugccaaguggcuauggggguuucuuucacgcaacaagaaacccaggauuuguacccgagaagaguucacacggaagguaagaaguaaugcagcuaucggagccguguuugucgaugaaaaccaguggaacuccgcaaaagaggccguggaggacgaaagguucugggaucugguucgccgugagcgggaacuccauaagcagggcaaaugcgcuacgugcguguacaacaugauggguaagagagagaagaaacugggggaauuuggaaaggccaaaggcagcagggcgauaugguacaugugguugggcgcacgcuuccuggaguucgaggcccucggguuuaugaaugaagaccacugguucucucgagagaacucgcuuucaggagucgaaggugagggccugcauaaguuaggguauauccugcgggauauuagcaaaaucccgggaggcaauauguacgcugacgauaccgccgguugggacacuagaauuacagaggaugacuugcaaaacgaagcaaagaucaccgauauaauggagccugaacacgcucuccuggccacuuccauuuuuaaacuaacauaucagaauaaggugguaaggguucagcgcccagcuaagaacgggaccgugauggacgucaucaguagacgggaucagaggggaucuggccaagugggcacauacgggcuuaacacuuucaccaauaugggagcccagcugauccgucagauggagagcgaagguauauuuucccccucagagcucgagacgccuaaccuggcaggccgaguguuggacugguuagaaaaacacgggauagagcgccugagacggauggcgaucaguggagacgauugugucguuaagccaauugacgauagguucgccaccgcucucacagcccuuaaugacaugggcaaagugcgcaaggauaucccccagugggaaccgucuaaagguuggaacgacuggcaacagguaccuuuuugcagccaucacuuccaucagcugauuaugaaggaugggagagagaucgugguccccugucggaaucaggacgagcuagugggaagggcacgaguuucccaaggcgcuggcuggucacugcgugagacugccugccucggaaagagcuaugcacagauguggcaguugauguacuuucacagacgcgaucugcggcuugccgcgaacgcuauauguucugccgugccagucgacugggugccuaccuccaggacaacuuggaguauccacgcacaucaccaauggaugaccacggaggauaugcugagcguauggaauagaguuuggauugaagagaaccccuggauggaagacaaaacacaugugucguccugggaggacgucccauaucucggaaagcgcgaagaucaguggugcgguucuuuaaucggccugaccgcccgggcuacuugggccacaaauauucagguggcaaucaaccagguuaggcgauugauugggaaugagaacuaccuggacuacaugaccucaaugaaaagauucaagaaugagagcgaucccgaaggagcucucugguga

SEQ ID NO: 14256 - RNA, 9879 nt, Artificial Sequence
  derived and/or modified CDS sequence (opt3) from DENV-1__DQ285559__SS-prME
agcgugaccaugcugcucaugcuucugcccacagccuugacuuuccacuuaacgaccagaggcggggagccucauaugaucgucuccaagcaggaaaggggaaagucucugcuauuuaagacaucaguuggugugaauaugugcacucucauugcuauggaccugggcgagcuuugugaagauaccaugacauacaaaugcccacggaucaccgaggccgaaccggacgauguagacuguuggugcaaugccacugauacaugggugaccuaugggacguguagucaaacuggagagcaccgccgagacaagcguagcgucgcgcuggcuccccaugugggcuugggucucgagaccagaacagaaacuuggauguccucugagggggccuggaaacagauccagaagguugaaaccugggcacugaggcacccuggauucacagugauugcccuguuucucgcucaugcaaucggcaccucgauuacgcagaagggcaucauauucaucuuacugaugcuugucacuccaucaauggccaugcggugcguggggauuggaaaccgcgauuuuguagaggguuugagcggcgcuacauggguugacgugguccuggagcacgggaguugugugaccacuauggccaaaaauaagcccacacuagauaucgaacuccugaaaaccgaggugacgaacccugcgguccuuagaaagcugugcauugaagcaaaaaucuccaauaccacaacugacucuagguguccaacccaaggagaggccacauugguugaggaacaagaugcuaacuucgugugccggcgcacuuuuguagaccgaggcugggguaauggguguggacucuucggcaagggcagccuguuaaccugcgccaaguuuaaaugcgugacaaagcuggaggggaaaauaguccaguacgaaaaccucaaguauuccgugauuguuaccgugcacacuggagaucagcaucaagucgguaaugagacgacagaacacggcaccaucgcaacuauuaccccacaagcuccuacaucagagauccagcuuaucgacuacggggcccugaccuuggacuguaguccaagaacuggacuagauuucaacgaaauggugcugcucacaaugaaaggcaagagcuggcugguacauaaacagugguuucuugaccugccguugcccuggacgucuggugcguccaccucacaagagacuuggaauaggcaggaucuccugguuacauucaagaccgcccacgcaaagaaacaggagguggucguguuagggagccaagaaggcgcuaugcacacagcccugacuggagcuaccgagauucagacgaguggcaccacaacuauauuugccgggcaucuaaagugccggcucaaaauggacaagcugacccuuaaaggaaugucuuaugucauguguacagguuccuucaaguuggaaaaggagguggcagaaacucagcacggcaccguucuggugcagguaaaauacgaggggacggaugccccuugcaagaucccauucagcacacaagacgagaaaggagucacccagaacggccgucucauuacugcuaaucccaucgugacagauaaggaaaaaccuguuaacauagagaccgaaccacccuuuggugagucguauauuguggucggggcgggcgagaaggcacugaaacuuucuugguucaaaaagggauccucaaucggcaaaauguuugaagccacugcucgcggggccagaaggauggcaauccugggagacaccgccugggauuucgguaguauuggcgggguguuuacaagcguaggaaaguugacgcaucagguguucggcaccgcuuacgguguucucuuuuccggggucucuuggacuaugaaaaucggcauuggaauacuguuaacauggcugggccuaaauagccggucaaccagucucuccaugacauguaucgccguggggauggugacucuguaccuuggagucaugguucaggcagacagcggcugcgugauuaacuggaagggucgagaguugaagugugggucuggaaucuucgugaccaacgaaguacacacguggacagagcaauauaaauuucaggcggauucaccgaagaaacugagugcugccaucggcaaggcaugggaagagggugucugcggcauucgcagcgccaccagacucgagaauauaauguggaaacagaucuccaacgaacugaauuacauuuuacuggagaacgacaugaaguucacugugguugugggggacgcuaauggaauccuugcccagggcaaaaagaugauuaggccucaacccauggaacauaaguauucuuggaaaucgugggggaaggcaaaaaucauaggagcugauauccagaacaccacauuuauuaucgacggcccagauacuccugagugucccgacgaucagcgggccuggaauauuugggaagucgaggacuacgguuucgggaucuuuaccacaaacauaugguugaagcuccgcgauagcuauacgcagaugugcgaccacagacugauguccgcggccauuaaagauucaaaggcugugcacgcagacaugggauacuggaucgagagugaaaagaaugagaccuggaaacuagccagggcuucuuucauugaaguuaagacuuguaucuggccaaaaagccauacacugugguccaacggcgugcucgagucagaaaugauaauccccaagauuuaugguggcccuaucagccaacacaauuaccguccaggguacuucacccagacugccggaccguggcaucugggcaaacuugaguuggauuuugaccugugcgaggggacaaccguagucguggaugaacacugcggaaaccggggccccucuuuacgaacgacuaccgugacagguaagauuauccacgagugguguugcagauccuguacccucccuccacugagguuccgcggggaagacggaugcugguauggcauggagauacggcccgucaaggagaaagaagagaaucuuguuagaaguauggugagcgcagguucuggcgaaguagacuccuuuucacuggggauuuugugugugaguauccucaucgaggaagucaugaggagcaaguggucgcgcaaaaugcugaugacuggaacacuagcgguguuccugcuccugauuaugggccagcuuaccuggaacgauuugacacgacugugcaucaugguuggggccaaugcuuccgaccggaugggaaugggcacuaccuacuuagcccucauggcaacguuuaagaugcguccuauguucgcugugggucugcuuuuuagaaggcugacaucucgcgagguccuacuccugaccauuggguugagccugguggccucaguugaguuaccaaacagucucgaggaacugggagauggccuugcaaugggcauaaugauccugaaauugcucacugacuuccaaccccaucagcuguggaccacacuacugucccuuacuuuuauuaagaccacgcucucucuggauuaugccuggaagacaauggcuaugaccuugagcaucgugucccuguucccguuaugucucucaacuacaagccagaaaaccacuuggcugccuguccuucuggggaguuuuggaugcaagccauugacaauguuccucauuaccgaaaacaaaaucuggggucggaagucuuggcccauaaaugagggcaucauggcgguagggauuguguccauccugcuaagcucgcugcuuaaaaacgacguuccucucgccggaccccugauugcaggcgguauguugaucgcuuguuacgugauaucagggucuagugccgauuuaucccuggaaaaggccgcugaggucagcugggaggaagaggcagaacacucuggaacgagccauaauauucucguggagguacaggacgauggcacuaugaaaaucaaggacgaagagagagaugacacccugacaauccuucugaaggccaccuugcuagcgguguccggcgucuauccaaugucaauuccugcuacacuguuuguuugguacuucuggcagaagaagaaacagaggaguggggugcucugggauacucccagcccaccggagguggaacgagccguccuggacgacggaauauaucgcauccuucagcgggguuuacugggcagaucucagguggggguuggaguauuccaagauggcguguuucacaccauguggcaugucacgaggggugcagugcucauguaccaggggaaacguuuggagccuuccugggccucaguuaaaaaggaccugauuaguuacggaggcggcuggcgcuuccaggggagcuggaacacaggagaagaggugcaggucaucgcuguggagcccgguaagaaucccaagaauguacaaacuacccccggcacauuuaagaccccugaaggggaggucggagcaauugcccucgauuucaaaccaggcacuuccgguucucccaucgugaaucgggaagggaagauaguuggacuguauggcaacggcguggucaccacaucggggacguacgugagcgcgaucgcucaggccaaagcaucacaggagggaccucuuccggaaauugaggacgagguuuuuaagaagagaaaucugacuaucauggauuugcacccagguuccggcaaaaccaggcgauaucuacccgccauugugcgggaagcuaucaagcgcaaacugagaacacucauauuagccccuaccagggucguggcaagugagauggcugaagcccugaaggggaugccaauucgguaccaaacuacagcgguaaaaucugagcacaccggacgagaaaucguggaccuuaugugccaugccacguucacuaugagacugcucagccccguucgcgucccuaacuauaauaugaucauuauggaugaggcacacuuuacagacccggcuuccaucgccgcuaggggcuacauaucaacccguguggguaugggggaggcagccgccauuuucaugaccgcuacucccccaggaucuguggaagcguuuccucagagcaacgcagucauccaggaugaggaaaaggacauucccgagcggaguuggaacuccggcuaugauuggaucacagacuucccaggcaagaccguaugguuugugccuagcauaaaaucugggaacgacauugccaauuguuugagaaagaacggaaaaaggguuauccagcugucacgcaagacauucgauacugaauaccagaagacgaagaacaaugacugggauuacguggucaccacagacaucuccgagaugggugcuaacuuccgagccgauagagugauugacccccggaggugccucaagccaguuauccugaaagauggcccggagcgcgugauucuugcagggccuaugcccgucacuguggccagugcugcgcagcguagaggacggauaggcaggaaucagaacaaggaaggugaccaguauguauacauggggcaaccacuaaauaacgaugaggaccaugcccacuggaccgaagcaaaaaugcuguuggauaauaucaacacacccgagggcauuaucccugcuuuauuugagccagaacgcgaaaagagcgccgcaaucgacggagaauaucgacugagaggcgaggcccggaaaaccuucguggaacucaugaggcgcggggaucugcccguuuggcuuucguacaaggucgcuucugagggauuucaguauuccgacagaagguggugcuucgacggugagcggaauaaccaggugcuggaagagaauauggauguggaaauuuggacuaaagagggcgaacguaagaagcuccgcccucgaugguuggacgccagaacguacagcgauccgcuggcgcuaagggaguuuaaagaguucgcagccgggcggcgcucagucaguggagaccugauacucgaaaucggcaaacuuccacagcaucugaccuuaagagcucaaaacgccuuggauaaucugguuaugcuccacaacucugagcagggugggaaggcuuauaggcacgcaauggaggaacugcccgacacaauugaaacucuuaugcugcucgccuugaucgcugugcugaccggcggaguaacauuauuuuuccuauccggcaaggggcugggaaaaaccagcauuggucuccuuugugugauggccucaagugcacuguuguggauggcgagcgucgagccucauuggaucgccgcuuccauaauccuggaguuuuuccucauggugcugcuuauucccgaaccagaucggcagcgaacuccucaggacaaucaacucgccuacguugugaucggccuguuguuuaugauucugacagucgcagcuaacgagaugggguuacuagaaacgaccaagaaggaucugggaaucggccacguagccgcagagaaccaucaccacgccacuaugcucgacguggaucuuagacccgcuucugcguggacacuguacgccguugcaaccaccgugauaacaccaaugaugcgccauacuauugagaauacgaccgcuaacaucagcuugacagccauugccaaucaggcagcuauccugaugggucucgacaaaggguggccuauauccaagauggauaucggcgucccgcugcuugccuuaggaugcuauucacaggugaacccccugacucucaccgcggcugucuugaugcugguggcccacuacgcaauuaucggcccagggcuacaagccaaagcuacaagggaagcacagaagcggaccgccgcgggaauuaugaaaaauccuacuguugacggcaucguggcuauagaccuggaucccguaguguaugacgccaaguucgagaagcagcucggucagauuaugcuucugaucuuguguacgucucaaauccugcucaugcguacaaccugggcacugugcgaaaguauuacuuuagccaccgggccacuuacaacucugugggagggaucgccuggcaaauuuuggaacaccacaaucgcugucagcauggccaauauauucagagguuccuaccucgcaggcgcugggcuagccuucucucugaugaagucauugggaggcgggaggcgcggaacgggcgcgcagggugaaacccugggggagaaauggaagcggcagcucaaccagcuuagcaaauccgaguuuaauacuuauaagcgaaguggaauuauggaaguugauagaucugaggccaaggaaggccugaaaaggggugagacaaccaagcaugcagugagccgcggcacugcuaaauugcggugguucgucgaaagaaaccuggugaagcccgaggggaaaguaaucgaccucggauguggccgugggggauggucauacuauugcgccggcuuaaagaaagugacagagguuaaggguuacaccaaagggggaccgggccacgaggagccaauuccuauggcaacguacggcuggaaucuggugaaacuucauuccgggaaggaugucuuuuucauacccccagaaaaaugugacacccugcuaugcgauauaggagagaguagccccaacccuacaaucgaagaggguaggacucuccgggugcugaagauggucgagccgugguugaaaggcaaucaauuuuguauuaagauccugaaccccuauaugccaucugugguugaaacccucgagcagaugcagcgcaagcacgggggaaugcuuguacgaaauccucuguccagaaacucaacacacgaaauguacugggugagcugcggcacugguaauauugucucggcugugaacaugaccucuaggauguuacugaaccgguucacaauggcccaucgcaaacccaccuaugagagagacguugauuugggggccggaacuaggcacguggcggucgagccugaaguggcuaaucucgacaucauuggccagcgaaucgagaacauaaagaaugaacauaaaaguacguggcacuacgaugaggacaacccauauaagacaugggcauaccacggcuccuaugaaguaaaacccagcgggucagccuccucuauggugaauggaguuguccggcugcuaaccaagccuugggacgugauuccaauggugacucaaaucgcuaugaccgauacaacgcccuuuggucagcagcgugucuucaaggagaaaguugacaccagaacuccgcgcgccaagaggggcacagcacaaaucauggaggugaccgccaaauggcuuuggggguuucugagccggaacaagaaaccuagaauuuguacucgcgaagaguucacaaggaagguacgaaguaaugcugcgauaggagccguguuugucgaugaaaaccaguggaacuccgcaaaggaggcuguggaagacgagcgguucugggaucucguucauagagagagggaacugcacaaacagggcaagugcgcaaccugcguguacaacaugauggguaaacgcgagaagaaauugggggaauuuggaaaggcaaaaggcagccgugccaucugguacauguggcugggcgcucgguuccucgaguucgaagcccuuggguuuaugaaugaggaccauugguucucuagagagaacucacugaguggagucgaaggugagggcuuacacaagcugggguauauuuugagggauaucuccaagauuccaggaggcaauauguacgcggacgauacagcagguugggacacucgcaucaccgaagaugaccuccagaacgaggccaaaauaacggauaucauggagcccgaacaugcucugcuagccaccgcaauuuuuaaacuuacauaucaaaauaaagugguacgaguucagcggccugcuaagagcgggacugugauggacgucaucucuagaagggaccagcgcggaucgggccaggugggcaccuacgggcugaacacauucacuaacauggaggcccaacucauuagacagauggaaucagagggaaucuuucugccaagcgaauuggagacccccaauuuagcuaaacgggugcuggauuggcucgagaaguauggugccgaaaggcuuaagcguauggcaauauccggcgacgauugugucguuaaaccgauugacgaucgauucgcgaaggcccugacggcucuaaacgacauggggaaagugcgcaaggauaucccucagugggagcccaguaaaggauggaaugacuggcagcaaguaccauuuugcucucaccacuuccaucagcugaucaugaaggauggcagagaaauuguggucccuugucggaaccaggacgagcucguggguagggcccgcguuagccagggggcaggaugguccuugagagaaacagcuugccugggcaagucauacgcccaaauguggcagcuuauguauuuucaccggagggaucugcgacucgcagccaaugcgauauguagugcugugcccgucgacugggugccaaccucucguacuacauggagcauccaugcccaccaccaguggaugaccacugaggacauguuauccguauggaacagaguuuggauugaggaaaaucccuggauggaggauaaaacccaugugucaagcugggaagaggucccuuaccugggcaagcgcgaagaccaauggugcgggucuuugaucggacugacagcacgggccacgugggcuaccaacauucagguggccaucaaucagguuaggagacucauagguaacgagaauuaccuugauuauauggcauccaugaaacgcuucaagaacgagagugacccagaaggcgcucugugguga

SEQ ID NO: 14257 - RNA, 9879 nt, Artificial Sequence
  derived and/or modified CDS sequence (opt3) from DENV-1__AF311956__SS-prME
agcgugaccaugcugcucaugcuucugccaacugcauuggcuuuccacuuaacuacgagaggaggggagccucauaugaucgucuccaagcaagaaaggggaaaaucucugcuguuuaagaccucagccgguguuaacaugugcacacucauugccauggaccugggcgagcuuugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucggacgagcuugggaggagggcgucugcgguaucaggagcgccacccggcucgaaaauauuauguggaaacagauauccaacgagcugaaucauaucuuacuggaaaacgacauuaaguucacugugguugugggcaaugcaaacgggauccuugcucagggcaaaaagaugauucgcccucaacccauggagcacaaauacucuuggaagucguggggcaaggccaaaaucauaggggcggacauccagaauaccacauuuauuaucgauggaccagacacuccugaaugucccgaugagcagagagccuggaacauuugggaggucgaagacuauggcuucgguaucuuuaccacaaauauaugguugaagcucagggauagcuacacgcagaugugcgaccaccgucugauguccgcugcaauuaaagauucaaaggccgugcaugcugacaugggguauuggaucgagagugagaaaaacgagaccuggaagcuagcccgggcaucuuucauugaaguuaagacuuguaucuggccaaaaagccacacacugugguccaauggagugcucgagucagagaugauaauccccaagauguacggcgguccuauuagccaacauaacuaucgaccaggcuacuucacccagacugcggggccguggcaccugggaaaacuugaauuggauuuugaccugugcgagggcacaaccguagucguggaugaacacugcgggucuagaggacccuccuuaaggacgacuaccgugacaggcaagaucauucaugagugguguugccgcaguuguacccucccuccacugcgguucagaggugaggacgggugcugguacggaauggaaaucaggcccgucaaagagaaggaagagaaucuuguucgcagcauggugucugccggcuccggugaaguagauucauuuagucugggcauauugugugugagcauuaugaucgaggaggucaugcgaucgcgguggucccguaagaugcucaugacugggacacuggcuguguuccuacugcucaucaugggacagcugaccuggaacgaccuuauuagauugugcaucaugguuggcgccaaugcaucugacaaaauggggaugggaacaacuuaucuggcuuuaauggccaccuuuaagaugaggccuauguucgcagugggccuccuguuucgccggcuuacgagcagagaaguccugcuacucacaauuggucugucauugguggccaguguugagcugccaaacuccuuagaggaacucggggauggacuggcuaugggcauaaugaugcuuaaacuguugaccgaguuccaaccccaccagcucuggacuacccugcuaucucugacauuuaucaagacuacccuuagccucgacuacgcguggaaaacgacagccauggugcuguccauugucucauuguucccgcuguguuuaagcaccacaagucagaagacaaccuggcucccuguacugcuuggcucuuuugggugcaagccacugacuauguucuugaucacagagaacgagauuuggggaaggaaauccuggccccucaaugaagguaucauggcaauaggcaucgugagcauucugcuaucgucacugcuuaagaacgauguuccucucgcugggccccugaucgccggaggcauguugauugccuguuaugugaucucugguaguuccgcugacuuaagccuggagaaagcagccgaagucucuugggaggaagaggcggagcauagcgggaccucccacaauauacucguggaaguacaggaugacggaacgaugaagauuaaagaugaggaacgagacgauacucugaccauccuucugaaggcuacauugcuagccgugucaggcgucuacccaaugaguaucccugcaacccuguuuguuugguauuucuggcagaaaaagaagcagcgcagcggcgugcucugggacacacccucuccaccggagguggagcgggccguccuggaugacgggauuuacagaauacuucagaggggauuacugggucguucccaggugggcguugggguauuccaagauggaguguuucauacuauguggcacgucacccgcggcgcugugcucauguaucaggguaaacgguuggaaccuucaugggcaaguguuaagaaagaccugaucagcuacgggggaggcuggagauuccagggcuccuggaacacgggggaggaagugcaggucauugccguggagcccggaaagaaucccaaaaacguacaaacaacucccgguaccuuuaagacaccugaaggcgaggucggggcgaucgcucucgacuucaagccaggaaccucuggcucgcccauugugaauagggaggguaaaaucguugggcuguacggaaacggcguggucacuaccagcggcacauaugugucagccauagcacaggccaaggcuucccaggaagggccucuuccggagaucgaagaugagguuuuuaaaaagcgaaaucugacgauuauggacuugcacccaggaagugguaaaacucggcgcuaccuacccgccaucgugagagaagcaauuaagaggaagcugcggacccucaucuuagcuccuacacgagucguggccucugagauggcggaggcccugaaaggcaugccaauaagauaucaaaccacugcaguaaagagcgaacauacagggcgcgagauuguggaucuuaugugccacgcuaccuucacgaugaggcugcucucccccguucgugucccuaacuacaauaugaucaucauggacgaagcccauuuuacugauccggcuucaauugcagcccggggauauaucucuacaagagugggcaugggugaggccgcugcgauauucaugaccgcaacacccccagggagcguggaagccuuuccucagaguaacgcugucauucaggacgaggagagggauauccccgaacgcuccuggaauagcggauacgacuggauuacugauuucccaggcaaaacaguaugguuugugccuucuaucaagucaggcaacgacauagccaauuguuugcggaaaaacgggaagagaguuauucagcuguccagaaagaccuucgauacagaguaucagaaaacuaagaacaaugacugggacuacguggucacgaccgauaucagugaaaugggagcaaacuucagggccgaccgcgugaucgauccccguagaugccucaaaccaguuauucugaaggacgguccggagcgggugauccuugcuggcccuaugcccgucacaguggcgagcgccgcacagaggcgcgggcgaauuggaagaaaucagaacaaagagggcgaucaguacguauauaugggucaaccacuaaauaacgacgaagaucacgcucauuggacugaggccaagaugcuguuggacaauauaaacacccccgaagggaucauuccugcauuauuugagccagaacgggagaagucggccgcuaucgauggcgaguacaggcugcgcggagaagccagaaaaacauucguggagcucaugaggcggggcgaccugcccguuuggcuuucuuauaaggucgcguccgaaggguuucaguacagcgaucgucgcuggugcuucgacggagagcgaaauaaccaggugcuggaagagaauauggauguggagaucuggaccaaagaaggugagagaaagaaacucaggccucggugguuggacgcacgcacuuauucagacccgcuggcccuaagagaauuuaaggaguucgcugccggcaggcggagugucucuggggaucugauucucgaaauaggaaaacuuccacagcaccugacguuacgagcucaaaacgcauuggacaaucugguuaugcuccacaacuccgagcagggcgguaaggccuacagacaugcuauggaggaacugcccgauaccaucgagacacuuaugcugcucgccuugauugcagugcugacugggggcguaaccuuauuuuuccuaagcggaaagggccuggggaaaacaucaaucggacuccuuugugugaccgcgaguagcgcccuguuguggauggcuuccgucgaaccucacuggauugccgcaucuaucauacuggaguuuuuccucauggugcugcuuauccccgagccagaccgccagaggacuccucaggauaaucaacucgcuuauguugugauuggucuguuguuuaugauccugacagucgccgcaaacgaaaugggcuuacuagagacgaccaagaaagaccuggggauuggacauguagccgcugaaaaccaccagcacgcgacuauccucgauguggaccuucaucccgccagcgcauggacacuguacgcuguugccaccaccgugauaacaccaaugaugcggcacacuauugagaauacgaccgccaacaucuccuugacagcaauugcuaaucaggccgcgauccugaugggccucgauaaggguuggccuauaucaaaaauggaccugggggucccgcuuuuagcucugggcugcuacucucaagugaacccccucacuuugaccgccgcaguccugaugcuaguggcccauuaugcuaucauuggaccaggccugcaggcaaaggccacacgugaagcgcagaagagaaccgcugccgggaucaugaaaaauccuacuguugauggaauuguggcaaucgaccucgaucccguaguguacgacgccaaguucgagaaacagcuuggccaaauaaugcuguugauucuguguacgagucagauccuccugaugaggacaaccugggcuuuaugcgagucgaucacucuugccaccgguccacugacaacucucugggaagggagcccuggaaaguuuuggaacaccacaauugcagucuccauggcuaauaucuuccgcggcucuuaucuagccggugcgggccuggccuucucauugaugaaaagccuagggggaggccggcgagggacgggagcacagggcgagacccucggugaaaaguggaagagacagcuuaaccaacuguccaaaagugaguuuaauacuuacaagaggucugggauaauggaaguugaccgcagcgaggcuaaagagggauugaagcggggcgaaacaaccaaacacgccgugucaagagguacugcaaagcugcguugguucgucgagaggaaccucgugaagcccgaaggcaaaguaauugauuuaggguguggacggggcgggugguccuauuacugcgcuggacugaagaaagugacagagguuaagggcuauaccaaaggugggccgggacaugaagaaccaaucccuauggccacguacggcuggaaucuugugaagcugcacaguggcaaagacgucuuuuucaugcccccagagaagugugauacccuacucugcgacauuggggaaagcucucccaacccuacaaucgaggaaggacgcacucugcgaguguugaagauggucgagccguggcugagagguaaucaguuuuguauaaaaauccucaaccccuacaugccauccgugguugagacccuugaacagaugcagaggaagcacggcgggaugcugguacggaauccuuuaucacgcaacagcacacaugagauguauugggugucgugcggaacuggcaauauugucucugccgugaacaugaccaguagaaugcuguugaacagguucacaauggcgcaccgaaaacccaccuacgaacgggauguugaccucggugcugggacucgucauguggcagucgagccugaaguggccaaucuggauaucauuggacaaagaaucgagaacauuaagaaugagcacaaauccacguggcacuaugacgaagauaacccauacaagacaugggcuuaucauggcagcuacgagguaaagcccucaggcuccgccucuagcauggugaaugggguuguccgccuacuuaccaaaccuugggacgugaucccaauggugacucagauagcaaugaccgauacaacgcccuuuggacagcaaagggucuucaaggaaaaaguugacacccggacuccgagagccaagcgcgguacagcucagauuauggaggugaccgcgaaauggcuguggggcuuucucaguaggaacaagaagccucgaaucuguacucgggaagaguucacaagaaaaguaagguccaaugccgcaaucggggcuguguuugucgacgagaaccaguggaauagcgccaaggaagcaguggaggaugaacgcuucugggaccugguucaccgugagcgggaauugcauaaacagggaaagugcgcaaccugcguguauaacaugaugggcaaaagagagaagaagcugggugaguuugggaaagcuaagggaucuagggccauuugguacauguggcucggcgcgcgcuuccuugaguucgaggcacugggcuuuaugaaugaagaucacugguucucacgagagaacaguuuauccggggucgagggagaaggucugcauaaauugggcuacauacuccgggacaucagcaagauuccagggggaaauauguaugccgaugacacagcuggcugggauacuagaaucaccgaggacgaucugcaaaacgaagccaaaauuacggacaucauggagcccgaacacgcacuacuugcuaccucuauauuuaagcugacauaccagaauaaagugguaaggguucagcgcccugccaagaacgguacugugauggaugucaucucgagacgggaccagagggggucaggacaagugggcaccuauggccucaacacauucacuaauauggaggugcagcugauucgucagauggagagcgaagggaucuuuuucccauccgaguuggaaagucccaacuuagcugagcgaguccuggauuggcucgaaaagcacggagccgagcgccuuaaaagaauggcaauuucuggugacgacuguguugugaagccgaucgaugaccgguuugcgaccgcccugauagcucuaaaugauaugggcaaaguaaggaaggacauuccucagugggagcccagcaaaggguggaacgauuggcaacaggugccauucugcucccaucacuuucaucagcugaucaugaaggacggacgcgaaaucgucgugccuuguagaaaucaggaugagcucguuggccgggccagggugucacaaggugcaggguggaguuugcgagaaacggcuugccugggaaagucuuacgcccagauguggcagcuuauguauuuccaccguagagaccugcgccucgcagccaacgcgauuuguagcgcuguccccguggauuggguaccaacaucccggaccacuuggucaauacacgcccaucaccaauggaugacaaccgaggacauguuaagcguuuggaauaggguguggaucgaagagaaccccuggauggaggauaaaacucaugucucuuccugggaagaggugccuuaccugggcaagagagaagaccaguggugcggcaguuugauugggcugaccgcacgcgccacaugggcuacgaauauccagguugccauuaaccaggugcggaggcucaucggaaaugagaacuaucuugacuacaugaccagcaugaaacgauuuaagaaugagucggauccagaaggugcacugugguga

SEQ ID NO: 14258 - RNA, 9879 nt, Artificial Sequence
  derived and/or modified CDS sequence (opt3) from DENV-1__AF311958__SS-prME
agcgugaccaugcugcucaugcuucugccaacagccuuggcuuuccacuuaacuacgagaggaggggagccucauaugaucgucuccaagcaagaaaggggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauuuucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacgggacccugacuuuggacuguaguccaagaacaggacuagauuucaacgaaaugguccugcucacgaugaaagaaaagagcuggcuggugcauaaacagugguuucuugaccugccguugcccuggaccucuggcgccuccacuucacaagagacauggaauaggcaggaucuccugguaaccuucaagacagcacacgcuaagaaacaggaaguuguggucuuagguagccaagagggggccaugcacacugcucugaccggcgccacggaaauccagaccaguggaacaacuaccauuuuugcaggccaucuaaagugccggcucaaaauggacaagcugacacuuaaagggacuucuuaugugauguguaccggauccuucaaguuggagaaggaagucgccgagacgcagcacgguacagugcugguucaggugaaauacgagggcaccgaugcuccuugcaagauaccauucagcacucaagacgaaaaagggguaacacagaacggacgucucaucaccgcgaaucccauugucacugauaaggagaaaccugugaacaucgaaaccgagccacccuuuggcgagucguauauaguugugggugcaggggaaaaggcccugaaacuuucuugguucaaaaagggcuccucaauuggaaaaauguuugaggcuacagcccgcggcgcaagaaggauggccauccugggggacacggcuugggauuucggaaguaucgguggcgucuuuaccagcguggggaaguugguacaucagguguucggaacugccuacggcguucucuuuuccggugucucuuggacaaugaaaauugggaucggcauucuguuaaccuggcugggacuaaauagccggucaacaagucucuccaugacuuguauagcagugggcauggugacccuguaccuuggggucaugguucaggcggacagcggaugcgugaucaacuggaagggccgagaauugaagugugguucugggauuuucgugacgaacgagguacacacauggaccgaacaauauaaauuucaggcugauucaccgaagcgccugagugccgcaaucggacgagcaugggaggagggcgucugcgguaucaggagcgcuacucggcucgaaaauauuauguggaaacagauauccaacgagcugaaucauaucuuacuggaaaacgacauuaaguucaccgugguugugggcaaugccaacgggauccuugcacagggcaaaaagaugauucgcccucaacccauggagcacaaauacucuuggaagucguggggcaaggcuaaaaucauaggggccgacauccagaauacaacuuuuauuaucgauggaccagacaccccugaaugucccgaugagcagagagcguggaacauuugggaggucgaagacuauggcuucgguaucuuuacaacgaauauaugguugaagcucagggauagcuacacccagaugugcgaccaccgucugauguccgccgcuauuaaagauucaaaggcagugcaugccgacaugggguauuggaucgagagugagaaaaacgagacuuggaagcuagcucgggccucuuucauugaaguuaagacauguaucuggccaaaaagccacacccugugguccaauggagugcucgagucagagaugauaauccccaagauguacggcgguccuauuagccaacauaacuaucgaccaggcuacuucacucagacagcagggccguggcaccugggaaaacuugaauuggauuuugaccugugcgagggcaccacgguagucguggaugaacacugcgggucuagaggacccuccuuaaggacuaccacagugaccggcaagaucauucaugagugguguugccgcaguuguacucucccuccacugcgguucagaggugaggacgggugcugguacggaauggaaaucaggcccgucaaagagaaggaagagaaucuuguucgcagcauggugucugcgggcuccggugaaguagauucauuuagucugggcauauugugugugagcauuaugaucgaggaggucaugcgaucgcgguggucccguaagaugcucaugacagggacccuggccguguuccuacugcucaucaugggacagcugacauggaacgaccuuauuagauugugcaucaugguuggcgcuaaugccucugacaaaauggggaugggaacuaccuaucuggcauuaauggcuacguuuaagaugaggccuauguucgccgugggccuccuguuucgccggcuuacaagcagagaaguccugcuacucaccauuggucugucauugguggcaaguguugagcugccaaacuccuuagaggaacucggggauggacuggccaugggcauaaugaugcuuaaacuguugacugaguuccaaccccaccagcucuggaccacacugcuaucucugacuuuuaucaagaccacgcuuagccucgacuacgcuuggaaaacaaccgcgauggugcuguccauugucucauuguucccgcuguguuuaagcacuacaagucagaagaccacuuggcucccuguacugcuuggcucuuuugggugcaagccacugacaauguucuugaucaccgaguaugagauuuggggaaggaaauccuggccccucaacgaagguaucauggccauaggcaucgugagcauucugcuaucgucacugcuuaagaaugauguuccucucgcagggccccugaucgcuggaggcauguugauugccuguuacgugaucucugguaguuccgccgacuuaagccuggagaaagcugcagaagucucuugggaggaagaggccgagcauagcgggacgucccacaacauacucguggaaguacaggaugacggaacuaugaagauuaaagaugaggaacgagacgauacccugacaauccuucugaaggcgaccuugcuagcugugucaggcgucuauccaaugaguaucccugccacacuguuuguuugguacuucuggcagaaaaagaagcagcgcagcggcgugcucugggacacucccucuccaccggagguggagcgggcaguccuggaugacgggauuuauagaauacuucagaggggauuacugggucguucccaggugggcguugggguauuccaagauggaguguuucauaccauguggcacgucacgcgcggcgccgugcucauguaccaggguaaacgguuggaaccuucaugggcuaguguuaagaaagaccugaucagcuacgggggaggcuggagauuccagggcuccuggaauacaggggaggaagugcaggucauugcaguggagcccggaaagaaccccaaaaauguacaaacuacccccgguacauuuaagaccccugaaggcgaggucggggccaucgcgcucgacuucaagccaggaacuucuggcucgcccauugugaacagggaggguaaaaucguugggcuguauggaaauggcguggucaccacaagcggcacguacgugucagcuauagcccaggcaaaggccucccaggaagaaccucuuccggaaaucgaggaugaaguuuuuaaaaagcgaaaccugacuauuauggacuugcacccagggaguggaaaaacccggcgcuaucuacccgcuaucgugagagaggccauuaagaggaagcugcggacacucaucuuagcaccuacccgagucguggcuucugagauggccgaagcgcugaaagguaugccaauaagauaccaaacuacagccguaaagagcgagcauaccggccgcgaaauuguggaucuuaugugccacgcaacguucacuaugaggcugcucucccccguucgugucccuaauuauaacaugaucaucauggacgaggcucauuuuacagauccggccucaauugcugcacggggguacaucucuaccagagugggaaugggcgaagccgccgcuauauucaugaccgcgacucccccagguagcguggaggcauuuccucagaguaaugccgucauucaggacgaggaaagggauauccccgagcgcuccuggaacagcggguaugacuggauuacagauuucccaggaaaaaccguaugguuugugccuucuaucaagucaggcaaugacauagcuaacuguuugcggaaaaauggcaagagaguuauucagcuguccagaaagacauucgauacugaauaccagaaaacgaagaacaacgacugggacuacguggucaccacagauaucagugagaugggggccaauuucagggcagaccgcgugaucgauccccguagaugccucaaaccaguuauucugaaggacggaccggagcgggugauccuugccgguccuaugcccgucacuguggcuagcgcggcccagaggcgcggccgaauugggagaaaccagaauaaagaaggagaucaguauguauacaugggccaaccacuaaacaaugacgaggaucacgcacauuggaccgaagcuaagaugcuguuggacaacauaaauacacccgaggguaucauuccugccuuauuugaaccagagcgggagaagucggcagccaucgauggggaauauaggcugcgcggcgaggcuagaaaaaccuucguggaacucaugaggcggggagaccugcccguuuggcuuucuuacaaggucgccuccgagggcuuucaguauagcgaucgucgcuggugcuucgacggggaacgaaacaaucaggugcuggaggagaacauggauguggaaaucuggacuaaagagggagaaagaaagaaacucaggccucggugguuggacgcgcgcacguacucagacccgcuggcacuaagagaguuuaaggaguucgccgcugguaggcggagugucucuggcgaucugauucucgagauagggaaacuuccacagcaccugaccuuacgagcccaaaaugcuuuggacaaccugguuaugcuccacaauuccgagcagggaggcaaggcauauagacaugccauggaggaacugcccgauacaaucgaaacucuuaugcugcucgcuuugauugccgugcugaccggugggguaacauuauuuuuccuaagcggcaagggacugggcaaaaccucaaucgggcuccuuugugugacugcaaguagcgcgcuguuguggauggccuccgucgagccucacuggauugcugccucuaucauacuggaguuuuuccucauggugcugcuuauccccgaaccagaccgccagaggacaccucaggauaaccaacucgcauacguugugauuggacuguuguuuaugauccugacggucgcugccaaugagauggguuuacuagaaaccacuaagaaagaccugggcauugggcauguagcagccgagaaccaccagcacgcuacaaugcucgauguggaccuucaucccgcgagcgccuggacccuguacgcaguugcuaccacagugaucacuccaaugaugcggcacacgauagaaaacaccacagccaauauuuccuugacugccaucgcaaaccaggcugccauucugaugggacucgauaagggcuggccuaucucaaaaauggaccugggugucccgcuuuuagcgcuggggugcuauucucaagugaauccccucaccuugacagcugccguccugaugcuaguggcacauuacgccauaaucggcccaggacugcaggcuaaggcaacccgugaggcccagaagagaacugcggcuggcauuaugaaaaacccuacgguugaugggaucguggccauugaccucgaucccguaguguaugacgcaaaguucgagaaacagcuuggacaaaucaugcuguugauacuguguacaagucagauucuccugaugaggaccacuugggccuuaugcgaaucgaucacccuugcuacaggcccacugacuacccucugggaggguagcccugggaaguuuuggaauacaacgaucgccgucuccauggcaaacauuuuccgcggaucuuaccuagcuggcgccggucuggcguucucauugaugaaaagccugggcgggggacggcgaggcaccggggcccagggagaaacucucggcgagaaguggaagagacagcuuaaucaacuguccaaaagugaauuuaacacauauaagaggucugguaucauggagguugaccgcagcgaggcaaaagaaggguugaagcggggagagaccacuaaacacgcugugucaagaggcgccgcaaagcugcguugguucgucgaaaggaaucucgugaagcccgaggguaaaguaauagauuuaggcugugggcggggaggcugguccuacuauugcgcugggcugaagaaagugacagaaguuaagggauacaccaaaggcgguccggggcaugaggagccaauuccuauggccacguacggauggaaccuugugaagcugcacaguggcaaagacgucuuuuucaugcccccagaaaagugugauacccuacucugcgacaucggcgagagcucucccaauccuacaauugaagaggggcgcacucugcgaguguugaagauggucgagccguggcugagaggaaaccaguuuuguaucaaaauacucaaucccuauaugccauccgugguugaaacccuugagcagaugcagaggaagcacgguggcaugcugguacggaacccuuuaucacgcaauagcacacaugaaauguacugggugucgugcgggacuggaaacaucgucucugccgugaauaugaccaguagaaugcuguugaacagguucacaauggcgcaccgaaaacccaccuaugagcgggauguugaccucggcgcugguacucgucauguggcagucgaaccugagguggccaaccuggauauuaucgggcaaagaauugagaauaucaagaacgaacacaaauccacguggcacuacgacgaggauaauccauauaagacaugggcuuaccauggaagcuaugaaguaaagcccucaggcuccgccucuagcauggugaacggcguuguccgccuacuuaccaaaccuugggacgugauuccaauggugacucagaucgcaaugaccgauacaacgcccuuugggcagcaaagggucuucaaggagaaaguugacacccggacuccgagagccaagcgcggaacagcucagauaauggaagugaccgcgaaauggcugugggguuuucucaguaggaauaagaagccucgaauuuguacucgggaggaguucacaagaaaaguaagguccaacgccgcaaucggcgcuguguuugucgacgaaaaucaguggaacagcgccaaggaggcaguggaagaugagcgcuucugggaccugguucaccgugaacgggaguugcauaaacaggggaagugcgcaaccugcguguacaauaugaugggaaaaagagagaagaagcugggcgaauuugguaaagcuaaggggucuagggccaucugguacauguggcucggagcgcgcuuccuugaguucgaagcacugggcuuuaugaacgaggaucacugguucucacgagagaauaguuuauccggcgucgaaggggagggacugcauaaauuggguuauauucuccgggacauaagcaagaucccaggcgggaacauguacgccgaugacacagcuggaugggauacuagaauuaccgaagacgaucugcaaaaugaggccaaaaucacggacauuauggaacccgagcacgcacuacuugcuaccucuaucuuuaagcugacauaucagaacaaagugguaaggguucagcgcccugccaagaauggcacugugauggaugucauaucgagacgggaccagagggguucagggcaagugggaaccuacggccucaacacauucacuaacauggaggugcagcugauccgucagauggaaagcgagggcauauuuuucccauccgaauuggagagucccaauuuagcugaacgaguccuggauuggcucgagaagcacggggccgagcgccuuaaaagaauggcaaucucuggagacgacuguguugugaagccgauugaugaccgguuugcgaccgcccugaucgcucuaaacgauauggguaaaguaaggaaggacauaccucagugggaacccagcaaaggcuggaaugauuggcaacaggugccauucugcucccaucacuuucaucagcugauuaugaaggacgggcgcgagaucgucgugccuuguagaaaccaggaugaacucguuggacgggccagggugucacaaggcgcagguuggaguuugcgagagacggcuugccuggggaagucuuaugcccagauguggcagcuuauguacuuccaccguagagaccugcgccucgcagccaaugcgaucuguagcgcuguccccguggauuggguaccaacaucccggaccacuuggucaauucacgcccaucaccaauggaugacaaccgaagacauguuaagcguuuggaacaggguguggauagaggagaaucccuggauggaagauaaaacucaugucucuuccugggaggaagugccuuaucugggaaagagagaggaccaguggugcggcaguuugaucggccugaccgcacgcgccacaugggcuacgaacauucagguugccaucaaucaggugcggaggcucauugggaacgagaauuaccuugacuacaugaccagcaugaaacgauuuaagaacgaaucggauccagagggagcacugugguga

SEQ ID NO: 14259 - RNA, 9879 nt, Artificial Sequence
  derived and/or modified CDS sequence (opt3) from DENV-1__AF311957__SS-prME
agcgugaccaugcugcucaugcuucugcccacagcauuggcuuuccacuuaacuacgagaggaggggagccucauaugaucgucuccaagcaagaaaggggaaaaucucugcuauuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggacaucuuaugugauguguacuggauccuucaaguuggagaaggaagucgcugagacccagcacgguacggugcugguucaggugaaauacgagggcacagaugcgccuugcaagauaccauucagcacccaagacgaaaaagggguaacucagaacggacgucucaucacagcaaaucccauugucaccgauaaggagaaaccugugaacaucgaaacugagccacccuuuggcgagucguauauaguugugggugccggggaaaaggcucugaaacuuucuugguucaaaaagggcuccucaauuggaaaaauguuugaggccaccgcacgcggcgccagaaggauggcuauccugggggacacagccugggauuucggaaguaucgguggcgucuuuacgagcguggggaaguugguacaucagguguucggaaccgcauacggcguucucuuuuccggugucucuuggacuaugaaaauugggaucggcauucuguuaacauggcugggacuaaauagccggucaaccagucucuccaugacauguauagcggugggcauggugacucuguaccuuggggucaugguucaggcugacagcggaugcgugaucaacuggaagggccgagaauugaagugugguucugggauuuucgugaccaacgagguacacacguggacagaacaauauaaauuucaggccgauucaccgaagcgccugagugcagccaucgggcgagcuugggaggagggcgucugcgguaucaggagcgccacccggcucgaaaauauuauguggaaacagauauccaacgagcugaaucauaucuuacuggaaaacgacauuaaguucacugugguugugggcaaugcaaacgggauccuugcucagggcaaaaagaugauucgcccucaacccauggagcacaaauacucuuggaagucguggggcaaggccaaaaucauaggggcggacauccagaauaccacauuuauuaucgauggaccagacacuccugaaugucccgaugagcagagagccuggaacauuugggaggucgaagacuauggcuucgguaucuuuaccacaaauauaugguugaagcucagggauagcuacacgcagaugugcgaccaccgucugauguccgcugcaauuaaagauucaaaggccgugcaugcugacaugggguauuggaucgagagugagaaaaaugagaccuggaagcuagcccgggcaucuuucauugaaguuaagacuuguaucuggccaaaaagccacacacugugguccaauggagugcucgagucagagaugauaauccccaagauguacggcgguccuauuagccaacauaacuaucgaccaggcuacuucacccagacugcggggccguggcaccugggaaaacuugaauuggauuuugaccugugcgagggcacaaccguagucguggaugaacacugcgggucuagaggacccuccuuaaggacgacuaccgugacaggcaagaucauucaugagugguguugccgcaguuguacccucccuccacugcgguucagaggugaggacgggugcugguacggaauggaaaucaggcccgucaaagagaaggaagagaaucuuguucgcagcauggugucugccggcuccggugaaguagauucauuuagucugggcauauugugugugagcauuaugaucgaggaggucaugcgaucgcgguggucccguaagaugcucaugacugggacacuggcuguguuccuacugcucaucaugggacagcugaccuggaacgaccuuauuagauugugcaucaugguuggcgccaaugcaucugacaaaauggggaugggaacaacuuaucuggcuuuaauggccaccuuuaagaugaggccuauguucgcagugggccuccuguuucgccggcuuacgagcagagaaguccugcuacucacaauuggucugucauugguggccaguguugagcugccaaacuccuuagaggaacucggggauggacuggcuaugggcauaaugaugcuuaaacuguugaccgaguuccaaccccaccagcucuggacuacccugcuaucucugacauuuaucaagacuacccuuagccucgacuacgcguggaaaacgacagccaccgugcuguccauugucucauuguucccgcuguguuuaagcacuacaagucagaagaccacuuggcucccuguacugcuuggcucuuuugggugcaagccacugacaauguucuugaucaccgagaacgagauuuggggaaggaaauccuggccccucaaugaagguaucauggcaauaggcaucgugagcauucugcuaucgucacugcuuaagaacgauguuccucucgcugggccccugaucgccggaggcauguugauugccuguuaugugaucucugguaguuccgcugacuuaagccuggagaaagcagccgaagucucuugggaggaagaggcggagcauagcgggacgucccacaauauacucguggaaguacaggaugacggaacuaugaagauuaaagaugaggaacgagacgauacccugacaauccuucugaaggcuaccuugcuagccgugucaggcgucuacccaaugaguaucccugcaacacuguuuguuugguauuucuggcagaaaaagaagcagcgcagcggcgugcucugggacacucccucuccaccggagguggagcgggccguccuggaugacgggauuuacagaauacuucagaggggauuacugggucguucccaggugggcguugggguauuccaagauggaguguuucauaccauguggcacgucacgcgcggcgcugugcucauguaucaggguaaacgguuggaaccuucaugggcaaguguuaagaaagaccugaucagcuacgggggaggcuggagauuccagggcuccuggaacacaggggaggaagugcaggucauugccguggagcccggaaagaaucccaaaaacguacaaacuacccccgguacauuuaagaccccugaaggcgaggucggggcgaucgcucucgacuucaagccaggaacuucuggcucgcccauugugaauagggaggguaaaaucguugggcuguacggaaacggcguggucaccacaagcggcacguaugugucagccauagcacaggccaaggcuucccaggaagggccucuuccggagaucgaagaugagguuuuuaaaaagcgaaaucugacuauuauggacuugcacccaggaagugguaaaacccggcgcuaccuacccgccaucgugagagaagcaauuaagaggaagcugcggacacucaucuuagcuccuacccgagucguggccucugagauggcggaggcccugaaaggcaugccaauaagauaucaaacuacagcaguaaagagcgaacauaccgggcgcgagauuguggaucuuaugugccacgcuacguucacuaugaggcugcucucccccguucgugucccuaacuacaauaugaucaucauggacgaagcccauuuuacagauccggcuucaauugcagcccggggauauaucucuaccagagugggcaugggugaggccgcugcgauauucaugaccgcaacucccccagggagcguggaagccuuuccucagaguaacgcugucauucaggacgaggagagggauauccccgaacgcuccuggaauagcggauacgacuggauuacagauuucccaggcaaaaccguaugguuugugccuucuaucaagucaggcaacgacauagccaauuguuugcggaaaaacgggaagagaguuauucagcuguccagaaagacauucgauacugaguaucagaaaacgaagaacaaugacugggacuacguggucaccacagauaucagugaaaugggagcaaacuucagggccgaccgcgugaucgauccccguagaugccucaaaccaguuauucugaaggacgguccggagcgggugauccuugcuggcccuaugcccgucacuguggcgagcgccgcacagaggcgcgggcgaauuggaagaaaucagaacaaagagggcgaucaguacguauauaugggucaaccacuaaauaacgacgaagaucacgcucauuggaccgaggccaagaugcuguuggacaauauaaacacacccgaagggaucauuccugcauuauuugagccagaacgggagaagucggccgcuaucgauggcgaguacaggcugcgcggagaagccagaaaaaccuucguggagcucaugaggcggggcgaccugcccguuuggcuuucuuauaaggucgcguccgaaggguuucaguacagcgaucgucgcuggugcuucgacggagagcgaaauaaccaggugcuggaagagaauauggauguggagaucuggacuaaagaaggugagagaaagaaacucaggccucggugguuggacgcacgcacguauucagacccgcuggcccuaagagaauuuaaggaguucgcugccggcaggcggagugucucuuccgaucugauucucgaaauagggaaacuuccacagcaccugaccuuacgagcucaaaacgcauuggacaaucugguuaugcuccacaacagcgagcagggaggcaaggccuacagacaugcuauggaggaacugcccgauacaaucgagacucuuaugcugcucgccuugauugcagugcugaccggugggguaacauuauuuuuccuaucaggcaagggacugggcaaaaccaguaucgggcuccuuugugugacugcgagcuccgcccuguuguggauggcuucugucgaaccucacuggauugccgcaagcaucauacuggaguuuuuccucauggugcugcuuauccccgagccagaccgccagaggacaccucaggauaaucaacucgcuuauguugugauuggacuguuguuuaugauccugacggucgccgcaaacgaaauggguuuacuagagaccacuaagaaagaccugggcauugggcauguagccgcugaaaaccaccagcacgcgacaaugcucgauguggaccuucaucccgccuccgcauggacccuguacgcuguugccaccacagugaucacuccaaugaugcggcacacgauagagaauaccacagccaacauuucauugacugcaaucgcuaaucaggccgcgauucugaugggacucgauaagggcuggccuaucucuaaaauggaccugggugucccgcuuuuagcucuggggugcuacagucaagugaacccccucaccuugacagccgcaguccugaugcuaguggcccauuaugcuauaaucggcccaggacugcaggcaaaggccacccgugaagcgcagaagagaacugcugccggcauuaugaaaaauccuacgguugaugggaucguggcaauugaccucgaucccguaguguacgacgccaaguucgagaaacagcuuggacaaaucaugcuguugauacuguguacaucgcagauucuccugaugaggaccacuugggcuuuaugcgagagcaucacccuugccacaggcccacugacuacccucugggaagguuccccugggaaguuuuggaacacaacgaucgcagucucuauggcuaauauuuuccgcggaucauaucuagccggcgcgggucuggccuucagcuugaugaaaucccugggcgggggacggcgaggcaccggggcacagggagagacucucggcgaaaaguggaagagacagcuuaaccaacugaguaaaucugaguuuaauacauacaagaggagcgguaucauggaaguugaccgcucagaggcuaaagagggguugaagcggggagaaaccacuaaacacgccguguccagaggcacagcaaagcugcguugguucgucgagaggaaccucgugaagcccgaagguaaaguaauagauuuaggcugugggcggggaggcuggaguuauuacugcgcugggcugaagaaagugaccgagguuaagggauauacgaaaggcgguccggggcaugaagaaccaauuccuauggccaccuacggauggaaucuugugaagcugcacagcggcaaagacgucuuuuucaucccaccagagaagugugauacacuacucugcgacauuggcgaaucuucccccaacccuacuaucgaggaagggcgcacccugcgaguguugaagauggucgagccguggcugagaggaaaucaguuuuguauaaaaauccucaaccccuacaugccaucagugguugagacacuugaacagaugcagaggaagcacgguggcaugcugguacggaauccuuuaagccgcaacucgacucaugagauguauugggugucuugcgggaccggaaauauugucagugccgugaacaugacauccagaaugcuguugaacagguucaccauggcgcaccgaaaacccacuuacgaacgggauguugaccucggcgcugguacgcgucauguggcagucgagccugaaguggccaaucuggauaucauugggcaaagaaucgagaacauuaagaaugagcacaaaagcacauggcacuaugacgaagauaacccauacaagaccugggcuuaucauggaucauacgagguaaagcccuccggcucugccagcaguauggugaauggcguuguccgccuacuuacuaaaccuugggacgugaucccaauggugacccagauagcaaugacagauacgacccccuuugggcagcaaagggucuucaaggaaaaaguugacacucggacaccgagagccaagcgcggaaccgcucagauuauggaggugacugcgaaauggcugugggguuuucucuccaggaacaagaagccucgaaucuguacacgggaagaguucaccagaaaaguaaggagcaaugccgcaaucggcgcuguguuugucgacgagaaccaguggaacucugccaaggaagcaguggaggaugaacgcuucugggaccugguucaccgugagcgggaauugcauaaacaggggaagugcgccacaugcguguauaacaugaugggaaaaagagagaagaagcugggcgaguuugguaaagcuaaggggucaagggccauuugguacauguggcucggagcgcgcuuccuugaguucgaggcacugggcuuuaugaaugaagaucacugguucagucgagagaacuccuuaagcggcgucgagggggaaggacugcauaaauuggguuacauacuccgggacaucucuaagauuccaggcgggaauauguaugccgaugacacugcuggaugggauaccagaaucacggaggacgaucugcaaaacgaagccaaaauuaccgacaucauggagcccgaacacgcacuacuugcuacaucgauauuuaagcugacuuaccagaauaaagugguaaggguucagcgcccugccaagaacggcaccgugauggaugucaucucaagacgggaccagagggguagcgggcaagugggaacauauggccucaacacuuucaccaauauggaggugcagcugauucgucagauggaguccgaaggcaucuuuuucccaagugaguuggaaucucccaacuuagcugagcgaguccuggauuggcucgaaaagcacggggccgagcgccuuaaaagaauggcaauuagcggagacgacuguguugugaagccgaucgaugaccgguuugcgacggcccugauagcucuaaaugauauggguaaaguaaggaaggacauuccucagugggagcccuccaaaggcuggaacgauuggcaacaggugccauucugcucacaucacuuucaucagcugaucaugaaggacgggcgcgaaaucgucgugccuuguagaaaucaggaugagcucguuggacgggccagggugagucaaggcgcagguuggucuuugcgagaaacagcuugccugggaaagagcuacgcccagauguggcagcuuauguauuuccaccguagagaccugcgccucgcagccaacgcgauuuguuccgcuguccccguggauuggguaccaaccucacggacuacauggagcauacacgcccaucaccaauggaugaccacugaggacauguuaucuguuuggaauaggguguggaucgaagagaaccccuggauggaggauaaaacccaugucuccaguugggaagaggugccuuaccugggaaagagagaagaccaguggugcggcagcuugauuggccugacagcacgcgccacgugggcuaccaauauccagguugccauuaaccaggugcggaggcucaucgggaaugagaacuaucuugacuacaugacuucgaugaaacgauuuaagaaugaguccgauccagaaggagcacugugguga

SEQ ID NO: 14260 - RNA, 9879 nt, Artificial Sequence
  derived and/or modified CDS sequence (opt3) from DENV-1__EU280167__SS-prME
agcgugaccaugcugcucacucuuaugcccacugcccuggcuuuccacuugacgaccagaggaggggaaccucauaugaucgucuccaagcaagaaagaggaaagucuuuacuguuuaagacaucagccgguguuaauaugugcacucuaauugccauggaccucggcgagcugugugaagauaccgugacauacaagugcccacggauaaccgaggcggaaccggacgauguagacuguuggugcaaugcuacugauacaugggugaccuaugggacguguagucaaacuggagagcaccgccgagacauccguagcgucgcccuugcaccccaugugggccuggguuuggagaccagaacagaaacuuggauguccucugagggggccuggaagcagauucagaggguugauaccugcgugcuccggcacccuggauucacagucaucgcucuguuucuggcacaugccauuggcaccucgaucucacagaaaggcauaaucuucauucucuuaaugcuggugacgccaagcaugacuaugcgcuguguagggaucggaaguagagacuuuguugaaggucuuuccggcgcuacauggguggaugucguguuggagcacgggucuugcgugaccagcauggccaaggacaagcccacucuggauauugagcuacucaaaacagaagucccuaacccagcgguucugaggaaacuuuguaucgaggcaaaaauauccaauaccacgaccgacucacggugccccacacaaggagaagccacucugguggaggaacaggaugcuaacuucguaugucgccgaaccuuuguggacagaggcugggguaaugggugcggauuguucggcaagggcagucuccugacaugcgacaaauuuaagugugucacuaaguuagaggggaaaauuauccaguacgagaacuucaaguauagcgugauuguuaccgugcacacaggagaucagcaucaagucgguaaugaaucuaccgagcacggcacuacggccacaaucaccccucaggcaccaacuaccgaaauccagcugacagacuacggggcucucacccuugauugcuccccgaggacuggacuggacuuuaacgagaugguguugcuaacaaugaaagaaaagucauggcugguacauaaacagugguuccucgaucugccccuuccuuggacgagcggcgccaguaccucucgggagacuuggaaucgucaagaccuguugguuacauuuaagaccgcgcacgccaaaaagcaggagguggucgugcucgguucccaggaaggggcaaugcacacagcucugacuggcgccaccgagauucaaacgagcggaaccacaacuauauucgcuggccauuuaaagugucgccugaaaauggauaagcuaacccucaaagggaugucguaugucaugugcacaggaucuuucaagcuggaaaaagagguggccgaaacucagcacgguaccguucuugugcagaucaaguacgagggcacggacgcaccauguaagauucccuuuuccacacaggaugagaaagggguaacccaaaacggaagauugaucacugccaauccuauagucacagacaaggaaaaaccagugaacauugaggcugaacccccguucggcgagucauauaucguuaucggugugggggagaaggcgcugaaacucaguugguuuaagaagggcagcuccauuggaaaaauguucgaagcaaccgccaggggcgcucggcgaauggccauccugggggauacugcaugggacuuuggaucuauugguggcgucuucaccagcguggggaaacuuguacaucagauauuuggaacagccuacggcgugcuguucucagguguuaguuggacgaugaaaaucgggauuggcgucuugcucaccuggcugggauuaaauucccgcagcacuucucugucaaugacaugcaucgcugugggccuagugacccucuaccugggggucaugguucaggccgacaguggaugugugaucaacuggaagggcagaggucuuaaaugcgggagcggaauuuuugugacaaaugagguacacacuuggaccggccaguauaaguuccaagcagauuccccuaaggguuugucugcggcuauaggcaaagccugggaagagggggucuguggaaucaggucggcaacgcggcuggaaaacauuauguggaagcagaucagcaacgagcucaaucauauucuguuagagaacgacaugaaauuuacagugguugugggcgaugucgccgggauccuggcucagggaaagaaaaugauacgcccccagccaauggaacacaaguacuccuggaaaaauuggggcaaggccaagaucauuggugcagacgugcaaaacucaaccuucaucauugaugggccuaauacucccgagugcagugacgaucagagagcuuggaacaucugggaaguugaggacuauggauuuggcauauucaccacaaauauuuggcuuaaauugagggauucuuacacucaggugugugaccaccgucucaugagcgccgcgaucaaggauuccaaagccguacaugcugacauggguuauuggauugaaucagagaagaacgagaccuggaaacuggcacgggccagcuucaucgaagucaagacaugcauauggccaaagucucacacgcuaugguccaauggcgugcuggagagugaaaugaucauucccaaaaucuacgggggaccuauuagccagcauaacuaucgaccaggcuacuuuacccaaacugcugggccguggcaccucggaaagcuggagcuugauuucgacuugugcgaaggcacaaccguggucguugacgagcacugugguaauagagggcccucucugggaacuacaaccgugacgggcaaaaucauacaugaguggugcuguagguccugcacuuuaccuccacuccgcuuucggggugaagauggcuguugguacgggauggagauuagacccguaaaggaaaaagaggagaaccuggugaagucaauggucagugccggaagcggcgaaguggacucguucucccuugggcuguugugcaucucuaucaugauugaggaaguuaugaggagccgcuggucacgaaagaugcucaugaccggaacacuggcaguguuuuuccuacugaucaugggccagcucaccuggaaugaucugauucggcuuuguauaauggucggugcgaacgccagugaccguauggggaugggaacuacauauuuggcucugauggccaccuuuaaaaugagaccuauguucgcagugggcuuacucuuuaggcgccugacaucccgggagguucuucugcuaacuaucggccucucucugguggcuagcgucgaauugccaaauucccuggaggaguuaggggauggacucgccauggguauuaugauccugaaacuucugaccgacuucagaucacaccaguugugggcaacgcuccugagcaugacauuuauuaaaaccgccuucagucuacauuacgcuuggaagacuauggcgaugguacugucuaucgugucccuuuuuccccucugccuguauaccacaagccagaagacuaccugguugccgguucuguuaggcucgcucggguguaagccucugacgauguuccuuauagccgaaaacaagaucuggggaaggaaaucauggccacugaacgagggcauuauggcaguggguaucgucucuauuuugcucaguucccugcuaaagaaugaugugccccuggcugggccucuuaucgccggaggcaugcucauagccugcuacguaauuagcggcucuagcgcugaccuguccuuggaaaaagcagccgaggugucaugggaagaggaggcggaacacaguggggcuagccauaacaucuuagucgagguucaggaugacggaacaaugaagaucaaagaugaagaacgagacgauacccugacuauucuccugaaggccacacuucuggcagugucugguguguaucccuuguccauaccagccacccuauucgucugguguuuuuggcagaaaaagaagcagcgcucaggcgugcugugggacacuccuagucccccaaaaguugaacgggcuguacucgacgaugggaucuacagaauuaugcaaaggggacugcuuggccguagccaggugggugucgggguguuccaggagaauguuuuucacacaauguggcacgugacccgcggagcagucuuaauguaucagggcaagcggcuggagccguccugggccucugugaaaaaggaccucaucucguacggcgggggauggagauugcaagguagcuggaacacgggcgaagagguacaggucauugcgguggaaccugggaaaaaucccaagaacguucagacugcuccaggaaccuucaagacacccgagggcgaggugggugccaucgcacuggauuuuaaaccugggaccucaggauccccaauagucaauagggaaggcaagaucgugggccucuacgggaacggaguugugacaacaagugguaccuaugucucugccauugcucaggccaaagcaagccaagagggcccccugccugaaaucgaggacgaaguguuccgaaagcggaaucuuacgauuauggaucugcauccgggguccggaaaaacacgcagauacuugccagcuaucguaagggaggccauaaagcggaagaugcgaacucuaauucuggcgcccaccagagugguugccucagagauggcagaagcucucaaaggcaugccuauccgcuaucagacaaccgccgucaagucugagcacacugguaaagaaaucguggacuuaaugugccaugcuaccuuuacaaugaggcugcuuagcccagugcguguccccaacuacaauaugauuaucauggaugaggcacacuucacggacccuaguuccauagccgcccggggguauauuagcacuagaguaggaaugggcgaagcugcggcaaucuuuaugaccgccacaccgcccggcucuguggaggcuuucccacagucaaacgccguuauucaagaugaggaaagggacaucccugagcgcuccuggaauaguggguacgaauggauaaccgauuuucccggaaagacugugugguucgucccaagcauuaaagcagguaacgacaucacaaauugccugcgaaagaacggcaagagagugauccagcucucgcggaaaaccuucgacacggaguaucagaagacuaaaaacaaugauugggacuacguugugacaaccgauauuucugaaaugggggccaacuuuagggcugaccgcgucauggauccucguagauguuugaagcccgugauccugaaagacggaccagagcggguaauucucgcgggcccgaugccugugaccguugccuccgcagcucagaggcgcggucgaauagggagaaaucauaacaaggagggcgaucaauacaucuauaugggacagccccugacuaaugacgaagaucacgcccacuggacagaggcaaagaugcuucuagacaacauuaauaccccagaaggcaucauccccgcccuguucgagccugagcgggaaaagagcgcugccauugauggggaguacagguugcgcggagaggcgagaaagacauuugucgaguuaaugaggcggggugaccugccaguguggcucucacauaaaguggcaagugaaggcuuccaguauucugaucgucgcuggugcuuugacggggagcgaaacaaucagguccuggaggaaaacauggacguugagauauggacuaaggaaggagagaggaagaaacuuaggccccgguggcuggaugcccgcacguacuccgacccucucgcuuugagagaguucaaagaguuugccgcuggcaggcggagcgugucaggugaucugauccuagagauugggaagcugccgcaacaccucacccagcgagcacagaaugcccuugacaaccugguaauguuacauaauagugaacagggcggcagagcuuaucgccacgccauggaggaauugccagauacaaucgagacucugaugcuccuggcacuuauugcggugcugaccggcggggucacacucuucuuuuugagcggaaagggucugggcaaaaccuccaucggguuacuaugugugauggccucuagcguucugcucuggauggcuuccguggaaccccacuggauagccgcaucaaucauucuugaguucuuucugauggucuugcugaucccugagcccgacaggcaacggacuccacaggauaaccagcucgcuuacguagugauuggacugcuuuucaugauccucacgguugccgcaaaugaaaugggccuguuggagaccacaaagaaagaccuggguauagggcauguggccgucgaaaaccaccaucacgcugcgauguuagauguggaccuacauccugccucugcauggacucuguaugcugucgccaccacaauuaucacccccaugaugcgucacacuauugagaacacaacggccaauaucagucucaccgcaauagcuaaccaggccgcgauccuuaugggccuggauaagggauggccaauuucgaaaauggacaucggcgugccuuugcuggcucucgggugcuacagccaaguuaauccgcugacucuuacagccgcaguguuaaugcugguagcccacuacgcuauuaucggacccggccuccaggcaaaggccaccagagaggcgcagaagaggaccgcugccgguauaaugaaaaacccaacaauugaugggaucguggcaaucgacuuggacccugucguuuaugaugccaaguuugaaaaacaacugggacagauuaugcuacugauccucuguacuucccagauacuucugaugcgcacgaccugggcuuugugcgagucuauuacacuggccacuggcccccucaccacacugugggaagguucaccaggcaaguucuggaauaccacuaucgcagugagcauggcuaacauuuuccggggguccuacuuagccggagcgggccuugccuuuagucugaugaaaucucucgggggaggccgaagagguacgggggcacagggagagacacuaggcgaaaaguggaagaggcaacugaaucaguugagcaaaucagaguucaacaccuauaagcgcuccgguaucauggaggucgaccggagugaagcuaaagagggccugaagagaggggaaacuaccaaacaugccgugagccguggaacagcaaagcucaggugguuuguagagcggaaucuugugaagccugaaggcaaaguuauagaucugggguguggacgcggcgguuggucuuacuauugcgcuggguugaagaaagugacugaggucaagggauacaccaaaggcggccccgggcacgaggaaccgaucccaauggccacauauggauggaaccuggugaagcuccauuccgguaaagacgucuucuuuauuccucccgagaagugugauacguuacugugcgacaucggcgaaucaagcccaaaucccaccauugaggaagggcgaacucuuagagugcugaagaugguugagccuuggcuaaggggaaaccaguucuguaucaaaauucucaauccguacaugcccucgguaguggagacacuggaacagaugcaacggaagcacggcgguauguugguccgcaacccacugucuagaaauaguacccacgagauguacuggguguccugcgggacuggaaacaucguuagcgccgugaauaugacaucaaggaugcuccuuaaccgauuuaccauggcgcaucggaaaccuacguaugaacgugaugucgaccugggcgcuggcaccagacacguggcaguagagcccgagguggccaacuuagauauaauugggcagcgcaucgaaaauaucaagcaugagcacaaauccacauggcauuacgacgaagauaacccuuauaagacuugggcuuaccacggaucuuaugagguuaagccaagcgguagugccuccagcauggucaauggcguggugaaacuguugaccaagcccugggacgucauuccuaugguuacacagauagcaaugacugacaccacaccauucgggcagcaaaggguguuuaaagaaaagguagauacccggacucccaaagccaagagaggaacggcucagaucaugguggucacagcgcgcuggcucuggucuuuccugucaaggaacaagaaaccgcgaauuugcacccgggaggaguuuacuagaaaggugaggaguaaugccgcaaucggcgcuguuuucguggacgaaaaccaguggaacuccgccaaagaggcagucgaagaugaccgcuuuugggaucuagugcaccgugagcgggaacuucauaagcaagguaaaugugcaaccugcguauacaacacaauggggaagagagagaagaaacugggagaguucggcaaggcuaaaggcagcagggccauuugguauauguggcucggggcgcgcuuccuggaauuugaggcauugggauucaugaaugaagaccacugguuuucucgagagaacucgcugucagguguugaaggcgaggggcuccauaaacuuggauacauccugcgggauauaagcaaaaucccuggcgguaauauguacgccgacgauacggcugggugggacaccagaauuacugagggagauuuacagaacgaagccaagaucacagacauuauggagccagaacacgcacuguuggcuaaauccaucuucaagcucaccuaucagaauaagguggucagggugcagcgccccgccaaaaacggcacugugauggaugucauaaguagacgggaccaaaggggcucugggcagguuggaacauacggucugaauaccuuuacaaacauggaggcucagcuaauucgucagauggagagcgaaggcaucuucuccccuaacgagcuugaaacuccaaaucuggccgagcgagugcucgacuggcuggaaaaguaugggguagagcgcuugaaaagaauggcaaucucaggagaugacuguguggucaagcccauugaugaccgguuugcgaccgccuuaacggcucugaacgauaugggcaaagugaggaaggacauaccgcaaugggagccuaguaaggguuggaaugauuggcagcagguucccuucugcucucaccauuuucaccagcucaucaugaaagacgggcgcgaaauuguggucccauguagaaaccaagaugagcuugugggacgggccaggguaagccagggcgcaggcuggucccugcgagaaaccgcuugccuagggaagucauacgcccagauguggcagcugauguauuuccaucguagagaccuccgcuuggcagccaaugcgaucuguagcgcuguuccuguggauuggguccccacaucucggacuaccugguccauucacgcccaucaccaauggaugacaacugaggacaugcugaguguguggaacaggguuuggaucgaagagaauccauggauggaggacaaaaccagaauaagcucgugggaagaugugcccuaccuuggagagcgcgaagaccaguggugcgguucccugaucggccucacggcacgggccacaugggcuaccaacguccagguggccauuaaucaaguaaggcgauuaaucgggaacgagaauuauucugauuacaugacuucaaugaagagauuuaaaaacaagagcgaaccugagggagcacugugguga

SEQ ID NO: 14261 - RNA, 9876 nt, Artificial Sequence
  derived and/or modified CDS sequence (opt3) from DENV-2__AJ968413__SS-prME
accgccggcaugaucauuaugcugauacccacagugauggcuuuccaccucacuacgagaaacggggagccucauaugaucgucagcaggcaggaaaagggaaaaucccuucuguuuaagaccgaggacgguguuaauaugugcacauugauggcaauggauuuaggcgaacugugugaggacacuauuaccuacaaaugcccacuacuccggcaaaacgaaccggaggauaucgacuguuggugcaauucuacaucaaccugggugacuuaugggacauguaccacgacuggagagcaccgccgagaaaagcguaguguagcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacucacuuucagcgcgcucugauuuucauccugcucacagcaguggccccaucuaugaccaugagaugcauuggcaucucgaacagggauuuuguugaaggggugucaggagguagcugggucgacauaguguuagagcacggcaguuguguaacuacaauggcuaagaauaagcccacccuggauuucgaacuuauuaaaacggaggccaagcaguuggcgacccugcggaaauauugcaucgaagcaaagcuaacaaacacuaccacagagucccgcuguccuacucaaggggagccaucucucaaugaagagcaggacaaacgauuuguuugcaagcauagcaugguggauagaggauggggcaacgguugugggcuguucggaaagggcggcauugucaccugcgccauguuuacaugcaaaaagaauauggaagggaaaaucgugcagcccgagaaccuugaauacaccaucgugauuacuccucacuccggagaggagcaugcugucgguaaugacacgggcaagcacgggaaagaaauaaagaucacaccacagucaaguauuaccgaggccgaacugacuggauauggcaccguuacaauggaguguagcccgaggaccgguuuggauuucaacgaaauggugcuccugcaaauggagaauaaagcaugguuaguacaccggcagugguuucuggaccucccccuuccuuggcugccaggggcugauacucagggcucuaacuggauccagaaggagacauuggugacguucaagaauccccaugccaaaaagcaagacgucgugguucuaggaucccaggaaggcgcgaugcacaccgcccugacuggggcaacagagauacagaugucaagcggaaaccuccuguuuaccggucaucuuaaaugccgucugcgcauggacaaguugcaacucaaaggcaugaguuacucuauguguacagggaaguucaagguggucaaagaaauugcugagacucagcacggaaccaucgugguaagaguucaguaugagggcgaugguuccccuugcaagaucccauucgaaauuauggaccuggagaaaaggcauguguuagggcggcugaucacggucaaccccauugugaccgaaaaggauagcccggucaauauagaggccgaaccucccuuuggcgacucguacgugaucauuggaguugagccaggccagcuaaaacucaacugguucaagaaggggucuuccaucggacaaauguuugagacaacuaugcgaggugcuaaacgcauggccauccugggcgauaccgcaugggacuucgggucacuuggaggcguguuuacaaguauugguaaggccuugcaccagguauucggggcuauauacggcgcggcauuuagcggagucuccuggacuaugaaaauccugauuggcgugaucauuaccuggaucgggaugaauucuagaagcacgucacucaguguuucccuggugcuugucggagugguaacacuguauuugggcgugguuguccaggccgauagcgguuguguggugucuuggaagaacaaagaacucaagugcgggucaggaauauucaucaccgacaauguccacacuuggacagagcaguacaaguuucaaccugaaagucccagcaaacuggcuuccgccauucagaaggcacaucaggagggcaucugugguauuaggucuguuacccgguuagaaaaccugauguggaaacagaucacuccagagcuaaaucacauacucucggagaacgaagugaagcugaccauuaugacaggcgauaucaaagggauuaugcaugccggaaagcgcagccuuagaccccaaccuacggaguugagguauuccuggaaaaccuggggcaaggcuaagauccugucaacugaaagucacaaucagacauuccucauagacgggccagagaccgccgaaugcccgaacacaaaucgugcauggaacucucuggagguggaggauuacggauuuggcguauucacuaccaauaucugguuaaaacugcgggaaaagcaggacgucuuuugugacagcaaacuuauguccgcggcuauuaaggauaaccgagccgugcacgcagacauggguuauuggaucgagucagccuugaaugauacguggaaaauugaaaaggcuagcuucaucgagguuaagucuugccauuggcccaaaucccacacacucuggaguaacggggugcuggagagcgaaaugauaauuccuaagaacuucgccggaccagucucucagcauaauuacagacccggcuaucacacccaaacugcagguccuuggcaucuaggcaaacuggagauggacuuugauuucugugaagggaccacagugguugugacugaggacugcggaaacaggggcccaucccuccgcaccacaacggcuucagggaagcugaucaccgaauggugcugucggaguugcacucuucccccguugagauacaggggagaggauggcuguugguacgguauggagauccgcccucugaaagaaaaggaggaaaauuuaguaaacagccucgucacagccgggcacggacagauugacaauuuuucgcugggcgugcuugguauggcgcuguucuuggaggaaaugcuccgaacccgggugggcacuaagcacgccacacugcuagucgcuguuuccuuugugacccugaucacggggaacaugucuuuccgugaucucggaagaguaauggugauggucggcgcaacuaugaccgacgauauugggaugggagugacauaucuggcccuuuuggcugccuuuaaaguuaggccaaccuucgcagcgggccuguuacuccgcaagcugacuagcaaagagcuuaugaugacaaccauaggugugguccugcuaucacagaguacaauccccgagacuauucucgaacugaccgacgccuuggcucuggggaugaugguguuaaagaucguucggaaaauggagagauaccaacucgccgugacgauuacagcaauccugugcgucccuaaugcuguaauacuucagaacgccuggaagguguccuguaccauccuggcaguugugucugucagccccuugcuccugacuuccucacagcagaaggccgauuggauuccacuagcucugaccaucaaaggacuuaauccuacagcgauuuuucucacuacccugagcaggacgaguaagaaacgaucuuggcccuugaacgaagccaucauggcagugggcaugguauccauacuggcuagcucguuacucaagaaugacauuccaaugacaggcccgcugguggccgggggacuucugaccgucugcuauguuuugacuggucgcucagccgaccucgagcuggaaaaagcugcagaugugcggugggaggaccaagccgagaucucuggcaguuccccuauccuaagcauuacaauaucugaagaugggagcauguccaucaagaacgaggaagaggagcagacccugacuauucuuaucagaacaggacuccuggugauuucaggcuuguuccccgucaguaucccaauaaccgcggcugccugguacuuaugggaagugaaaaagcagagggcagguguucugugggacguacccagcccuccacccguggggaaggccgagcucgaagauggagcuuaucguaucaaacagaagggcauucugggcuacucucaaaucggggcaggagucuauaaagaggguacguuucauacuauguggcacgugacccgcggcgccguucuuaugcauaaggggaaacggauugaaccuuccugggcggacgugaagaaggaucugaucucauacggaggcgguuggaaauuggagggggaguggaaggaaggagaggaaguccaggugcuagcucuggagccgggcaaaaauccaagagccguacagacaaagcccggccucuucaaaaccaacacagggacuauaggagcagucagucuggacuuuagcccugguaccuccggcucuccaauuaucgauaagaaggggaaagugguuggacuuuacggcaaugguguggucacgaggaacggggccuaugugucggcuaucgcccagacagaaaagagcauugaggacaaccccgagaucgaagaugacauauuccgaaaaaagcgguuaacuauuauggaucugcacccuggagcaggcaaaaccaagcgcuaccucccggcuaucguuagagaggccauuaagaggggcuugcggacacugauccucgcgcccacccgaguggucgccgcagaaauggaggaagcucugagagggcuuccaauacgcuaucaaacuccugccauuagggcugagcauaccggacgugagaucguggaccugaugugucacgcaacauucacgaugcgguugcuaucacccguaagagugccaaauuacaaccugaucauuauggacgaagcccacuuuacugauccugccuccaucgcugcgagggguuauauuaguacccgcguugagaugggcgaagcagccgggauauucaugacagcuacccccccaggaucucgagacccguuuccucagagcaaugcccccaucauggaugaggagagagaaauuccagagcgguccuggaacucaggccaugaaugggucacugacuucaaagguaagacagugugguuugugcccucuaucaaagcagggaaugauaucgccgcuugccucaggaagaacggaaaaaaggucauucaguuaagccgcaagaccuucgacagugaguacguaaaaacgcguacuaaugauugggacuuugugguuacaaccgauauauccgaaaugggcgcgaacuucaaggccgagagagugaucgacccucggagguguaugaaaccagucauucugaccgauggcgaggaacgcgugauccuugcagggcccaugccuguuacucacagcucugcugcccaacgaagaggacggauugguaggaauccgaagaacgagaaugaccaguauaucuacaugggcgaaccacuggagaacgacgaagauugcgcacauuggaaagaggccaagaugcucuuggacaauauaaacacacccgaggggaucauuccuucaauguuugaacccgagcgcgaaaaaguggaugcuaucgacggagaguacagacugaggggcgaagcccggaagaccuucgucgaucucaugcgucgcggugaccugccaguguggcuugcguauaagguagcagccgaggggauuaauuacgcugaucgaagaugguguuuugacggcaucaggaacaaccagauacuagaggaaaauguggagguugaaauuuggacaaaagagggagagcggaagaaacugaagccucgcugguuggaugccagaaucuauuccgaccccuuagcucugaaagaauucaaggaguucgcagccggcaggaagagucucacucugaaccuuauuacggaaauggggcggcugccaaccuuuaugacacagaaagcucgagaugcccucgacaauuuggcaguccugcacacugcggaggccggagguagagcuuacaaccacgcccuaagcgaacugccugagacccucgagacacuucuguuauugacccugcucgcaacugugacgggcgggaucuuccuguuucuuaugucgggacgcggcauagguaagaugacccuggggaugugcugcaucauuacagcuucuauccucuugugguaugcccaaauucagccgcauuggaucgcagccuccauaauucuggaauucuuuuuaaucgugcuacugauccccgagccagaaaaacagaggacuccucaggauaaucaacucaccuacgucguuauugcuauccuuacagugguagcggccaccauggcaaacgagaugggcuuccuggaaaagacuaaaaaggacuugggacugggcagcauaacaacgcagcagcccgagucaaauauucucgacaucgaucugcggccagcuagugccuggacccuuuaugccguggcaacuacauuugucaccccuaugcuccgucacucuauugagaacuccagcgugaauguuucacugaccgcuaucgccaaccaggcgacaguguugauggggcugggaaaggguuggcccuuaaguaaaauggacauaggcgucccgcuacuggcuaucggguguuacagccaaguaaauccaauuacucucacggccgcacuucuguugcugguggcccauuacgcuaucauuggaccuggccuccaggcaaaggccaccagagaagcgcagaaaagggcugccgcagguaucaugaagaaccccacaguugaugggauuacugugaucgaccuggauccaauacccuaugacccuaaauucgagaagcagcuuggccaagucauguuacuggugcucugcgucacccagguguugaugaugcgcacaaccugggcccugugugaagcucuaacucuggccacgggaccgauuuccacacucugggagggcaaucccgggcgguuuuggaacaccacuaucgcaguuucuauggcuaauaucuuccgaggaagcuaccuugccggcgcgggucuguuguuuuccauuaugaagaacaccacaaauacuagaagggggaccggaaacauaggcgaaacacugggugagaaauggaagaaccgccucaaugcccugggcaaaucagaguuccagaucuauaagaaaucugggauucaagaaguggaucggacguuagcaaaggagggaaucaaaagaggcgaaaccgaccaccaugcuguaagucgugggucggccaagcuuaggugguuuguggagcggaacauggucacuccagagggaaagguuguggaucugggcugcggucgcgggggauggagcuacuauuguggcggucucaaaaauguccgagaagugaagggccuaacaaaagggggaccuggccacgaggaacccauuccuauguccaccuacggguggaaccugguaagauugcagucuggaguggacguuuucuucacuccacccgagaagugcgauacacugcucugugacaucggcgaaucaagcccuaauccaaccguggaggcagguaggacgcuucggguccugaacuugguggagaauuggcugaacaauaacauacaguuuugcaucaaaguccucaaucccuauaugccguccgugauugaaaagauggaggcuuuacagcgcaaguacgggggagcccugguuagaaacccucuuaguaggaauucuacccacgaaauguacuggguaagcaacgccucaggcaauaucguguccagugucaacaugauuagccgaaugcugaucaaccgguucacaaugaaacauaagaaagcgacuuaugagccagauguggaccuaggcucugggacccguaauauaggaauugaauccgagguucccaaccucgacaucaucgguaagagaauugagaaaauaaagcaagaacacgagacaucauggcauuacgaucaggaccacccuuauaagacuugggcuuaccacggcagcuaugaaaccaaacagacagggucggcaucuaguauggugaauggagucgugcgccuguugaccaagccaugggauguagugcccaugguuacucagauggccaugacggacacaaccccguuuggccaacagagggucuucaaagagaagguggauacucggacccaggaaccuaaagaggguacaaagaagcugaugaaaaucacggcugaguggcucuggaaggaacuugggaaaaagaaaacccccagaauguguacucgcgaggaauuuacaaggaaggugcgauccaacgccgcacugggagccauuuucaccgacgagaauaaauggaagagcgcucgggaggcggucgaagauucaagauuuuggggcuuaguugacaaggagaggaaccugcauuuggaaggcaaaugcgagacuuguguguacaauaugauggggaagcgcgaaaaaaagcucggagaguucgguaaagccaagggcucccgugcaaucugguauauguggcugggggcucgguuucuagaguucgaagcccuuggauuucugaacgaggaucacugguucucuagagaaaauagccucaguggcguagagggugaagggcugcauaaguugggauacauucugagggacguguccaaaaaggagggcggcgcaauguacgccgaugacacagcugggugggacacccgcaucacacucgaggaucuuaaaaacgaagagauggucacuaaucacauggaaggagagcauaagaaacuggccgaagcgauauuuaaguuaaccuaucagaacaaggugguucgagugcaacggccaacgccuagagguaccgucauggacaucauuagcaggcgcgaucagagaggcucugggcaggugggaacauacggccugaauacuuucaccaacauggaggcacaauugauccggcagauggagggugaagggguauucaaaucaauucagcaccucacaguuacugaggaaaucgccgugcagaauuggcuggcuagggucggacgugagcgacuaagucgcauggccauuuccggcgacgauugcguggugaagccccuugacgauagauuugcaagcgcucugaccgcccucaacgacaugggcaaaguccggaaggauauacaacagugggagccaucuaggggguggaacgacuggacgcagguucccuucugcucgcaccauuuucacgaacugaucaugaaagauggacgcguguugguagugccuuguagaaaucaggacgaguuaauuggucgggcuaggaucucacaaggcgccggguggagccugcgagaaacagcaugccucggaaaguccuaugcgcagauguggagucuuauguacuuccaucguagagaucugcgccuagccgcuaacgccaucuguucugcagucccaagccacugggugccgaccucccggacuacauggucaauucacgcuaagcaugaguggaugaccacugaagacaugcugaccguuuggaauaggguguggauacaggagaaccccuggauggaggacaaaacaccugucgaaaguugggaggaaaucccauaucucggcaagagagaggaucaguggugcgguucuuugauugggcugacgagccgcgccaccugggcaaaaaauauccaaacugccauuaaccaggugcggucccuuaucggaaaugaagaguacacagacuauaugcccucaaugaagagguuucgaagagaggaagaggaagcgggcguacugugguga

SEQ ID NO: 14262 - RNA, 9876 nt, Artificial Sequence
  derived and/or modified CDS sequence (opt3) from DENV-2__AB543624__SS-prME
agcgccggaaugaucauuaugcugauacccaccgugauggcuuuccaccucacaacuagaaauggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaaugaaccggaggauauugacuguuggugcaauucuaccucaacaugggugaccuauggaacuuguacaaccacgggcgagcaccggcgcgaaaagcgaagcguggcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaucggcuaugguaccgugacuauggaguguagccccagaaccgggcuugauuucaaugaaaugguccuguugcaaauggagaacaaggccuggcucgugcacaggcagugguuucuggacuuaccucugccauggcuccccggcgcagauaagcaggagucuaauuggauacagaaagaaacacuuguuaccuucaagaacccucaugcuaaaaagcaagacguggucgugcugggauccccagagggcgccaugcacacugcguugacaggggccacggaaauucagaugucaagcggaaaucuacuguuuaccggucaucucaaaugccggcugcguauggacaaacuucagcugaagggcaugaguuacucuauguguacugggaaauucaagguaguuaaagagaucgcagagacacaacacggaaccaucgugauucgcguccaguaugaaggcgaugguucccccugcaagaucccguucgagauuauggacuuggagaagagauacgugcucgggaggcugauaacagucaacccuaucgugacugagaaggauaaccccguuaauauugaagcugagccaccuuuuggcgacagcuacaucaucauuggaguggagcccggccaguuaaagcugaacugguucaaaaaggggucgucuauaggacagauguuugaaaccacgaugcggggugccaaacgaauggcuauccuaggcgauaccgccugggacuucgggucccucggaggcguauuuacaucaauugguaaggcacugcaucaagucuucggggccaucuauggcgcugcguuuaguggagugagcuggacuaugaaaauucuuaucggcguuauaaucaccuggauugggaugaacucccgcucuaccagcuugucagugagucugguccucgugggaaucguaacucuguaccuuggcgugaugguucaggcagauuccgguugugucgugagcuggaagaacaaggagcugaaaugcgggucuggaauuuucaucaccgacaaugugcacacguggacagaacaguauaaguuucagccagagucacccaguaaauuggccagcgcuauacaaaaggcccaggaagagggcauuugugguaucagauccgucaccaggcucgagaaccugauguggaaacagauugcaccugaauuaaaucacauccuggccgagaacgaaguuaagcuaacuauaaugacaggcgauaucaaagggauuaugcaggcuggaaagcggucucuccgcccacaaccgaccgagcugaaguacucguggaaaacuuggggcaaggccaaaaugcuuagcaccgaauccuauaaucagacauucuugaucgacgggcccgagacggcagagugcccuaacaccaauagagcguggaacucacuggaaguggaggauuacggauuuggcguguucacuacaaauauuuggcucaagcugaaagaaaggcaggacgcuuuuugugacaguaaguuaaugucugccgcaaucaaggauaaccgugccguacaugcugacauggguuauuggauagagagcgcccugaaugauaccuggaaaauugagaaggcauccuucaucgaagucaaaaacugccacuggccaaagucacauacacuuuggagcaacgggguguuggagucugaaaugaucauucccaaaaaucucgcuggaccuguuucccagcacaacuaccggccaggcuaccacacucaaaucgccggucccuggcaucugggcaagcuagagauggacuucgauuuuugugacgggaccacggugauugucacagaagauugcggaaaucgaggcccgagucugagaaccacuaccgcgagcgggaagcucauaacagaguggugcuguaggucuugcacucugccuccacuucgcuaucggggagaggacggcuguugguacgguauggaaaucagacccuugaaagagaaggaagagaaccugguaaauuccuuaguuaccgccgggcacggacagguggauaacuucucacucggcguacuggguauggcucuuuuucuggaagagauguugaggacacgcgucggcacgaaacaugcaauucuccugguggccgugaguuucgucacccuaaucacugggaauaugagcuuuaaggaccugggacgaguugugguaauggugggcgcuacaauggccgaugacauugggaugggagucaccuaucucgcacugcuugcggccuucaaagugcggccuacuuuugcugccggcuugcuguuacguaagcucacaucgaaggagcugaugaugaccacgaucgguauaguucuucugucccagucuacuauccccgaaaccgugcuagagcucacagaugcacuggcuuuggggaugaugguccugaaaauugugagaaacauggaaaaguaccaauuagccguuaccaucauggcaauucucugcgugccaaaugccgucauccugcagaacgcuuggaaaguaagcuguacuauacuugcggugguuucagugaguccucuguugcucacauccucucagcagaagaccgacuggauuccccuggcccuaacaaucaaaggacugaauccaacugcaaucuuccuuaccacgcucagcaggacaaacaagaaacgcuccuggccgcugaaugaggcuauuauggccgucggcauggugucaauauuggccagcagucuguuaaagaacgacaucccuaugaccggcccccucguagcugggggacugcuuacugugugcuauguccugaccggucggucugcagauuuggaacucgagagagccacagacguuaagugggaggaucaagcggaaauuuccggcagcucgccaauccugucaauuacuaucucugaggacgggaguauguccaucaagaaugaagaggaggaacagacccuaacgauccugauuaggacaggacuucucgugaucagcggccuguuucccauuucuaucccuauaaccgcugccgcaugguacuugugggaggugaagaaacagcgagccggugucuuaugggaugugccaagucccccuccgauggggaaggcugaacuggaggacggagcauaucgcauuaaacagaagggcauccucggcuacucccaaaucggggccggaguuuacaaggaagguacuuuccacacaauguggcauguaacccggggcgcggugcugaugcacaaagggaagagaauugagccaucaugggcugaugucaaaaaggaccuuaucaguuauggaggcgguuggaaacuggagggggaauggaaggagggagaagaggugcagguuuuggcccuagaacccggcaagaacccuagggcagugcagacuaaaccaggccuguuuaagacaaacaaugggaccauaggagccgucagccucgauuucucucccgguacguccggcucaccuauuaucgacaaaaaggggaaagugguaggacuguacggcaacggugucgugacucguaguggggcuuauguuagcgccauugcacagaccgagaaguccaucgaggauaauccggaaauagaggacgauauuuuucgcaagcggagacuuacaaucauggacuuacaccccggagcuggcaaaaccaagagguaccugccagccaucgugcgagaagcgauuaaacggggccuccgcacauugauccuggccccuacuagagucguggcagcugagauggaagaggcccucagggggcugcccauucgguaucaaaccccagcuauacgagcagagcauacgggaagagaaaucguugaccuuaugugucacgccacauucacuaugcgccuguugucuccugugaggguccccaacuacaaucuaauuaucauggaugaggcccauuucaccgacccagcuucgaucgcggcacgugguuauauuagcacacggguggaaaugggcgaggccgcugggauauuuaugaccgccacuccgccuggaucaagagaucccuucccacaguccaacgcacccaucauugacgaggaaagggagaucccugaacgcaguuggaacucuggccacgaguggguaaccgauuuuaaggguaaaacagugugguucguuccaagcauuaaggccgggaacgacaucgcugcgugccugcgaaagaauggcaaaaaggucauacagcucuccagaaaaacguuugauucagaauacgugaagacucggaccaacgacugggauuucguggucacaaccgacaucucugagaugggcgccaauuuuaaagcagagaggguaauugauccccgccguuguaugaagccugugaucuuaacugacggcgaagagagaguuauucuggcugggccgaugccagugacacauagcagugccgcacaacggaggggacgcaucggucgaaaccccaaaaaugaaaacgaccaguacauauauaugggcgagccucuugaaaaugaugaggacugcgcccacuggaaggaggcuaagaugcugcucgauaacauuaacacccccgaagggaucauuccauccauguucgagccugaaagagagaaagucgacgccaucgauggagaauaccgguugaggggcgaggcgcgcaagacguuuguggaccugaugagaaggggugaucuccccguuuggcuggcauauaaaguggccgcugaggggauaaauuacgccgaccggcguugguguuucgauggcaucaagaacaaucagauucuugaagagaacgucgaaguggagaucuggacuaaagagggagaacgcaagaagcuaaaaccacgauggcuggacgcuagaauuuauagcgauccuuuggcauuaaaggaguuuaaagaguucgccgcuggcaggaagucucugacacucaaucugaucaccgagauggggcggcuuccgaccuucaugacucagaaaacacgcgacgcccuggauaaccucgcaguauugcacaccgcggaagccggagguagagcuuacaaucaugcccugucagagcuacccgagacacuggaaacucuccuucuguuaacguugcuggcaaccgugacaggcgggauauuucucuuccugauguccggaaggggcauugguaagaugacucuugggaugugcugcaucaucaccgcuaguauucugcucugguaugcccaaauccagccacacuggauagcagccagcauuaucuuggaguuuuuccugauuguuuuacuaaucccugaacccgagaagcagcggacaccacaggacaaccaacugaccuacgucgugauagcuauccucacuguggucgcggccacgauggcaaaugaaaugggcuuucuugagaaaaccaagaaagaccugggauugggcucgauugcuacacagcauccugagucuaacauccuggauauugaccuccgacccgccuccgccuggacucuguacgcaguugcuaccacauucaucaccccgaugcuuagacacagcauugaaaauucaagugugaacguaucucucacugccaucgcgaaucaggcuacagugcugaugggguugggaaaggguuggccacuguccaaaauggauauaggcgucccuuuacuagccauuggguguuauagccaggugaaccccaucacgcugaccgcagcccuccuucuguugguugcucacuacgcaaucauuggaccaggccugcaagccaaggcgacucgcgaggcucagaagagggccgcagccgguauaaugaaaaaucccacaguggacgggaucaccgucauugaucucgacccuaucccguaugaucccaaguuugaaaaacagcugggccagguaaugcuuuuaauucugugcgugacccaaguucucaugaugcggacaacuugggcuuugugugaggcccugacgcuagcaaccggaccaaucucaccucugugggaaggcaaccccgggcguuucuggaauacaacuauagcugugaguauggccaacaucuuuagaggaagcuaccucgcgggcgccggucuucuguucuccauuaugaagaacaccacaaauaccaggcgcgggacuggaaacaucggcgagacguugggugagaaauggaagucucggcugaaugcacucggcaaaagcgaauuucagauuuauaagaaguccgggauccaggaggucgaccgaacacuggcuaaagaaggaauaaagagaggcgagaccgaucaucacgccgugucaagggggucugcaaaauuacgcugguucgucgagcggaacauggugacuccugaaggaaagguuguggaccuuggcugcgguagagggggauggaguuacuauuguggcggucugaaaaauguacgugaggugaagggccucaccaaagggggaccaggccaugaagaacccauuccuaugucgacauacggguggaaccuagucaggcugcaaagcggaguugauguguuuuucaucccacccgaaaaaugcgacacuuugcugugugauaucggcgaguccucuccgaauccuaccgucgaggcuggucggacacuccgcgugcuuaaccugguagaaaauugguugaacaaucacacgcauuucugcauuaaggugcugaacccauacaugcccucaguucucgagaaaauggaagccuuacagcgaaaguaugggggagcccuggugagaaauccucuuagcaggaacuccacccacgagauguacugggucaguaaugcgucuggcaacauagugagcucagucaacaugaucucccggaugcugauuaaucgcuuuacuaugagacacaaaaaggcuacauaugaaccagacguggaccuaggcagugggaccaggaacaucggaauugagagcgagauccccaaucucgauauaaucgguaagcgaauugagaaaauaaagcaggaacaugaaacuucuuggcacuacgaccaggaucauccguauaaaacaugggcauaccacggcuccuaugagaccaagcaaacggggucagccagcucgaugguuaacggaguagugcggcuguugaccaaaccuugggacguccugcccacagugacucagauggcuaugaccgauacaacuccauucggccagcagcguguuuuuaaggaaaagguggacaccagaacacaagagccuaaagaggguaccaagaaacucaugaagauuacugccgaauggcuuuggaaagagcuggggaagaaaaagacgccccgcauguguacaagggaagaguucacccggaaggucagaucuaaugcagccuuaggagcuaucuuuacugaugagaacaaauggaagagugcgcgcgaagccguggaggacuccagguucugggaacugguagauaaagagcgaaauuugcaccucgaaggcaagugcgagaccuguguguacaacaugaugggcaaacgggagaagaagcugggggaauuuggaaaagcaaaggguagcagagcuauuugguacauguggcuaggcgccagguuccuugaguuugaagcacugggguuccucaaugaggaccauugguuuucacgcgaaaacucccugucuggaguugagggcgaggguuugcacaaacugggguauauacuccgugaugucagcaagaaagaaggaggcgccauguacgcugacgacacagccggcugggauacgcggaucacccuugaggaccugaagaaugaagagauggugacuaaccauauggaaggggagcacaagaaauuagcggaggcaauuuucaagcugacauaucagaauaaaguggucagaguucagaggccaacaccccgcggaacugugauggauaucaucagucgacgggaccagagagguuccggccaaguagggacauacggauugaacaccuuuacaaauauggaagcccagcucauuaggcagauggagggcgaagguguguucaagaacauacaacgccugacugucaccgaggagguggcuguucauaacuggcuagccagaguggggcgggaaaggcuuagccguauggcaaucucuggagaugacugcgucgugaaaccucuggaugaccgauucgcuaaugcccucacggcucugaacgauaugggcaagauucgcaaggacauccagcagugggagccaucaaaaggcuggaaugauuggacccagguaccguuuugcagucaccacuuccaugaauugauuaugaaggacgggagaguuuuagugguccccugucggaaccaagaugagcugaucggaagggcccgcauaucccagggugcaggcuggagccucagagaaacagcgugccuugggaaaucuuaugcccagauguggucgcugauguacuuucaccggagggaccuacgacuggcugccaaugcaaucuguucagcugugccuagccauugggugccaacuucccguaccacauggaguauucacgccaagcacgaguggaugacuaccgaggacaugcucacggucuggaacagaguuuggauccgcgaaaaucccuggauggaggauaaaacaccuguggaaucuugggaggaaauuccauauuugggaaagcgggaggaccaguggugcggcagccugaucggucuuaccuccagggcaacuugggccaagaacauacaagcggcuauuaaucagguaagaucacugaucgggaacgaggaauacacagauuacaugcccaguaugaaacgcuuccggagggaggaagaggaagccggagugcucugguga

SEQ ID NO: 14263 - RNA, 9876 nt, Artificial Sequence
  derived and/or modified CDS sequence (opt3) from DENV-2__AB189122__SS-prME
accgccggcgugauaauuaugaugauacccacagucauggcuuuccaccugacuacgagaaacggggaaccucauaugaucguuagcaggcaggaaaagggaaaaucccuccuuuuuaagaccgagaauggugugaacaugugcacacugauggcaauggacuugggcgaauuaugugaggauacuauuaccuacaauugcccacugcugcggcaaaacgaaccggaggacaucgauuguuggugcaauucuacaucaaccuggguaacuuaugggacauguaccgccacgggagagcaccgccgagaaaaacguaguguggcgcucgcuccccaugucggcaugggucuggagacuaggaccgaaacauggaugagcuccgagggggccuggaagcacgcacagaggauugagacuugggugcuucggcauccuggauucaccaucauggccgcuauacuggcauacacaaucggcaccacguauuuucagcgcguuuugauuuucauccuccugacugccguggcuccaucuaugacaaugagaugcauuggcaucucgaacagggacuuugucgaaggggugucaggagguagcuggguagauauaguucuggagcacggcaguugugugaccacuauggccaaaaauaagcccacacucgacuucgaauuaauuaagaccgaggcgaaacacccugcaacgcugcggaaguacugcaucgaagccaaacuuaccaacacaacuaccgcuucccgcuguccaacacagggggagcccucuuugaaugaggaacaagauaagcgauuugucugcaaacauagcaugguggacagaggauggggcaacgguugugggcuguucggaaagggcggcauugugacuugcgccauguuuaccugcaagaaaaauauggaggggaaggucguucagccugaaaaccuagaguauacaaucgugaucaccccacacuccggagaagagaaugcaguagguaacgauacuggcaaacaugggaaggagauuaaagugacgccgcagucaaguauaacagaagcugagcucaccggauacggcacugucaccauggaauguagccccaggacaggucuggacuucaaugagauggugcuucugcagauggaaaacaaggccugguugguucaccggcaaugguuucucgaucugccuuuaccauggcugcccggggcggacacccagggcucuaacuggauccagaaagagacucucgugacauucaagaauccucacgccaagaaacaggaugucgugguacuuggaucccaagagggcgcaaugcauacggcucugaccggggccacugaaauucagaugucaagcggaaacuugcuauuuacaggucaccugaagugccgucuccgcauggacaaacugcagcuuaagggcaugaguuauucuauguguaccgggaaauucaagguugugaaggagaucgcugaaacacaacauggaacuauagucauuagagugcaguacgagggcgacgguuccccaugcaaaauccccuucgagaucauggaucuggaaaagaggcacgucuuggggcggcucauuaccgugaauccgaucguuacggagaaagacagcccugugaacauugaagccgagcccccauuuggcgauucguacauaaucauuggaguagaaccuggccagcugaaguuaaauugguucaaaaaggggucuuccaucggacagauguuugagaccacaaugcgaggugcaaagcgcauggccauccugggcgacacugcuugggauuucgggucacuaggaggcgucuuuaccaguauugguaaagcgcuccaucaaguguucggggcaauauauggcgccgcuuuuagcggaguuuccuggacaaugaagauccugauuggcguggucaucacuuggauugggaugaacucuagaagcaccucacuuaguguguccuugguacuggugggaguugucacgcucuaccugggcgugauggugcaggccgacagcgguugugucguuucuuggaaaaauaaggagcuuaaaugcgggucaggaaucuucauaacagauaacgugcacaccuggacugaacaguauaaguuucagcccgagaguccaagcaagcuggcauccgccauccaaaaagcucacgaagagggcauuugugguaucaggucugugacacgguuggaaaaucucauguggaagcagauuacccccgagcugaaccauaucuuaucggagaaugaaguaaaacugacuauaaugaccggcgacauuaaggggaucaugcaggccggaaaacgcagccuaagaccucagccaacagagcucaaguacuccuggaaagcauggggcaaggcgaagaugcugucaacggaacuucacaaccauaccuucuugauugaugggccggagacugcugaaugccccaauacaaacagggccuggaauagucuggaggucgaggacuauggauuuggcguguucaccacaaacaucuggcucaaacugaaggaacgucaagauguauuuugugacucuaaauuaaugagcgcagccauaaaggacaaccgggcugugcacgccgauauggguuacuggaucgaguccgcacugaaugacacuuggaaaauugaaaaggcuucauucaucgaggucaagagcugccacuggccuaaaucucauacccuuugguccaacgggguguuggagagugaaaugauuaucccaaagaauuucgccggacccguuagccagcacaacuaucgaccuggcuaccauacgcagacagcggguccauggcaccucggcaaacuggagauggauuuugacuucugugaagggaccacugugguagucaccgaggauugcggaaauagaggccccucucuaaggacaacuaccgccuccgggaagcugauaacagaauggugcugucgcucaugcacgcucccgccucugcgguacagaggagaggacggcuguugguaugguauggagauuaggccacuuaaagaaaaggaggaaaacuuggugaauagucuggugaccgcugggcauggacagaucgauaacuuuagcuuaggcguccucgguauggcacuguuccuugaggaaaugcugcgcacucgaguuggcacaaagcacgccaucuugcucguggcuguaucguuugugacccugauuacugggaauauguccuuccgggaccuaggacgugucauggugaugguuggcgccacaaugaccgaugacaucgggaugggagugacguaccuggcacuccuggcggccuuuaaagucagacccacuuucgcugccggccuuuugcugaggaaguuaaccucuaaagagcucaugaugacaaccauugguauagugcugcuuagccaaucaacuaucccugagacaauucuggaacuaaccgaugcacucgcucuggggaugaugguuuugaagaucgugcgcaacauggagaaauaucagcuggccgucacaauuauggcaaucuuaugcguacccaaugccgugauacuccagaacgcuuggaagguuaguuguacuacccuggcgguggucuccgugucuccacuucuguugacgagcucccaacagaaggccgacuggaucccucucgcacugacaauuaaaggacuaaaucccaccgcuaucuuucugacuacccuuucacggacaagcaagaaaagaaguuggccacucaacgaagccauuauggccguaggcauggugucuauccuggcuuccagcuugcugaagaaugauauaccgaugacuggcccuuuagucgcagggggacuccugaccguuugcuacgugcuuacggguaggucggccgaccuggaguuggaacgagcggcugacgugcgcugggaggagcaggccgaaauuucaggcucuagucccauccucuccaucacaauuagcgaggaugggucuaugagcaucaagaacgaagaggaggaacagacccugacuauccuaauucggacaggacugcuugucaucuccggccucuucccagugucaauucccaucaccgcagccgcuugguaucugugggagguuaagaaacaaagagcagggguuuugugggacgugccuaguccacccccugucgggaaggccgaauuagaggauggagcguacaggauaaagcagaaaggcauccugggcuauagccagauuggggugggaguuuacaaggaagguacuuuucacacaauguggcaugugacccguggcgcuguccucaugcacaaagggaagcgcaucgagccgucuugggccgacgugaaaaaggaucugauuuccuacggaggcgguuggaaacuugagggggaauggaaagagggagaagagguacagguccuggcauuggaaccaggcaagaacccccgggccgugcaaacgaaaccuggccuauucaagacuaauaccgggacaaucggagcuguuucacuggacuuuaguccagguaccagcggcucccccauaguggauaaaaaggggaaggucgugggacucuauggcaacgguguugugacaagaucugggacuuacgucucggccauugcacagaccgagaaaaauaucgaggacaacccugaaaucgaggaugacauuuucaggaagaaacgacugacgaucauggaucuucauccgggagcuggcaagacaaaacgguauuuacccgccauagugcgcgaagcgauuaagagaggccugaggacucucaucuuggccccaacccggguaguggcagcugagauggaagaggcccugcgagggcucccuauuagauaccagacacccgcuauccgcgcagagcacaccggaagggaaauaguugaccugaugugucaugccacuuucaccaugcgucuucugagcccaauucgggucccuaauuauaacuugaucaucauggaugaggcccacuuuacagaccccgcuucaauugcggcaagagguuacaucuccacgaggguggaaaugggcgaggccgcugggauuuucaugacugccaccccaccgggaagucgcgacccuuuuccccagucuaaugcaccaauaauggaugaggaacgagagauccccgaaagaagcuggaacuccggccacgagugggugacagacuucaaggguaaaaccgucugguuuguaccuucaauuaaggccgggaaugauaucgcugcgugccuacggaaaaacggaaagaaagugauccaacugucuaggaagacuuucgacagcgaauauauuaagacacgcaccaaugauugggacuuuguugugacgacugauauaagugagaugggcgccaacuucaaagcagagcgugucaucgacccaagacgguguaugaagcccgugauucucacagauggcgaagagaggguuaucuuagcugggccuaugccggugacccauuccagcgccgcacagcgccgaggaagagucggucggaaucccaagaacgaaaaugaccaguacauuuacaugggcgagccccuggaaaacgaugaggacugcgcccacuggaaggaggcuaaaaugcuucuggacaacaucaauaccccugaagggauaauccccucuauguuugagccagaaagggagaagguggaugccauugacggagaauaucgccucagaggcgaggcgaggaaaacuuucguagauuugaugcggcguggugaccugccuguguggcucgcauaccgcguugccgcugaggggaucaacuaugccgaucgaagaugguguuuugacggcgucaagaauaaccaaauucuggaagagaauguggaaguggagaucuggacaaaggagggagaaaggaagaaacuuaaaccccgguggcuagaugcucgcauauacucagacccacuggcauugaaagaguucaaagaguucgccgcuggcagaaaguccuuaacccugaaccucauuacagagauggggaggcugccuacuuuuaugacgcagaaggcccggaaugcacuugauaaccuggcgguccuccauaccgccgaagcuggaggucgagccuauaaucacgcauugagugagcugccggagacacuagaaacucugcuccuucugaccuuauuggcuacaguuaccggcgggaucuuccuguuucucaugagcggaaaaggcauugguaagaugacucuggggaugugcugcaucauaacggccucggugcuucugugguacgcacagauccagccccacuggauugccgcuucuaucauucucgaguucuuuuugaucguacuguuaauaccagaaccugagaaacaaagaacaccacaggacaaccagcuaacauauguggucauugcgauccugacugugguugccgcaaccauggcuaaugaaaugggcuuccucgagaagaccaaaaaggauuuuggacuuggcuccaucgccacccagcaaccagagagcaacauucuggacaucgauuugcgcccugccucagcauggacucuguacgcuguggccacaacguucauaacccccaugcucaggcauaguauugaaaauucuuccgucaacguaagccugacugcgaucgcuaaucaggccacagugcuuauggggcucggaaaggguuggccgcugucaaaaauggacauuggcguuccauugcuggcaaucggguguuacagucaggugaacccuauaaccuuaaccgccgcucuacugcuccuugucgcacacuaugccaucauuggacccggccugcaggcgaaggcuacacgggaggcccaaaaacgugcagccgcugguaucaugaagaauccaacuguggacgggauuacggucaucgauuuggaccccauuccuuacgauccgaaauuugaaaagcagcugggccaggugaugcuccugguucuuugcgugacccagguauuaaugaugagaacaacuugggcccugugugaggcacucaccuuggcuacaggacccaucagcacccugugggaaggcaacccagggagguucuggaacacuacgauagccguguccauggcgaauauuuuucgcggaucuuaucuagccggcgcaggucuacucuucagcaucaugaagaacacagcuaauacccggcgagggacuggaaacaccggcgagacacuuggugagaaauggaagaauagacugaacgccuugggcaaauccgaauuucaagucuacaagaaaucagggauccaggagguugacaggacucuggcaaaggaaggaauugagcgcggcgagaccgaucaucacgcugugucucgggggagugccaaacucagaugguucgucgaacguaaucuggugacaccugagggaaagguaguggacuuaggcugcgguagagguggguggucguauuacuguggcggucuuaagaacguuaaagaagugaagggccugacgaaagggggacccggccaugaggaaccuauaccaaugagcaccuauggguggaaucucguccggcuacaguccggaguggaugucuucuuuacucccccugagaagugcgacacacuguugugugauaucggcgagucuucaccaaaccccaccguggaagccggucgcacucugcgaguucucaaucuuguagagaacuggcugaauaacaauacacaauucugcauuaaaguguugaacccguacaugccuagcgucaucgaaaagauggaggcgcugcagagaaaguacgggggagcucucgugaggaacccauuaucccggaauaguacccacgaaauguauuggguuucuaacgcaagcggcaauauugugucauccgucaacaugaucagucgcaugcugauaaauagauuuacgaugaggcacaaaaaggccaccuacgagcccgacguggaucuuggcagcgggacacgaaacaucggaauugagucugaaaucccuaaucuggacauuaucgguaaacggauagagaagauuaaacaggaacaugagacuuccuggcacuaugaucaggaccauccauacaagaccugggcuuaucacggcucauacgaaacaaagcaaacugggagcgccucgucuaugguaaacggagugguucgucuacucaccaaacccugggacgucaucccgauggugacacagauggcaaugaccgauacuacgccuuucggccagcagagaguguuuaaggagaaagucgacacacgcacccaagagcccaaggaagguacuaaaaagcugaugaagaucaccgccgagugguuguggaaagaacuggggaagaaaaagacaccaaggauguguacgcgggaggaguucaccagaaaaguucgcaguaaugcugcgcucggagccauuuuuacugaugaaaacaaguggaaauccgcaagggaggcuguggaagacagcggcuucugggagcuuguagauaaggaacgaaaucugcacuuagagggcaagugcgagacauguguguauaacaugauggggaaacgggaaaagaaacugggagaguuugguaaggccaaaggcucaagagcaauaugguacaugugguugggggccagguuccucgaauuugaggcucugggauuccuaaaugaagaccauugguuuucccgcgagaacucucuuagcggcgucgagggugaagggcugcacaagcucggauacauccugcgugaugugaguaagaaagagggcggcgccauguaugcggacgauaccgcagggugggacacucggauuacauuggaagaucugaagaaugaggaaaugguuaccaaccauauggagggagagcacaaaaagcucgccgaagcuaucuucaaacuuacauaccagaacaagguggucagagugcagaggccuacuccccgcgguaccguaauggacauuaucucccgacgggaccagagaggcagcgggcaaguugugacguauggacugaauaccuucacaaacauggaggcccaguuaauaaggcagauggaaggcgagggugucuuuaagucuauccaacaucugacugugaccgaggaaauugcagugaaaaauugguuggcucgcgucgggagagagcggcucucaaggauggccaucaguggagaugacugcguugugaagccacuggaugaccguuucgcuuccgcccuaacagcacuuaacgauaugggcaaaguacgaaaggacauucagcagugggaacccagccgcggcuggaaugauuggacucaggugccuuuuugcucucaccacuuccaugagcugaucaugaaagacgggagaguccucgugguuccaugucggaaccaagaugaacugauuggaagggcgcgcauaucgcagggugccggcuggucauugagagagaccgcuugcuuaggaaagagcuacgcccagauguggucccugauguauuuucaccggagggaccuccgacuugcagcuaaugccaucuguagugcagugccgucucauuggguccccacgagccguacaaccugguccauucacgccacucacgaguggaugacaaccgaagauaugcugacuguguggaacagaguauggauccaggagaauccuuggauggaagacaagaccccaguugagucaugggaagagauccccuaccuaggaaaacgcgaggaucaauggugcggcagucugauuggucucacaucucgggcgacgugggcuaagaacauacagaccgccaucaaucaggugaggagcuugauugggaacgaagaguauacugacuacaugccuuccaugaaaagauuccgccgggaagaggaagaggcaggaguccugugguga

SEQ ID NO: 14264 - RNA, 9876 nt, Artificial Sequence
  derived and/or modified CDS sequence (opt3) from DENV-2__AB189123__SS-prME
accgccggcgugauaauuaugaugauacccacagucauggcuuuccaccugacuacgagaaacggggaaccucauaugaucguuagcaggcaggaaaagggaaaaucccuccuuuuuaagaccgagaauggugugaacaugugcacacugauggcaauggacuugggcgaauuaugugaggauacuauuaccuacaauugcccacugcugcggcaaaacgaaccggaggacaucgauuguuggugcaauucuacaucaaccuggguaacuuaugggacauguaccgccacgggagagcaccgccgagaaaaacguaguguggcgcucgcuccccaugucggcaugggucuggagacuaggaccgaaacauggaugagcuccgagggggccuggaagcacgcacagaggauugagacuugggugcuucggcauccuggauucaccaucauggccgcuauacuggcauacacaaucggcaccacguauuuucagcgcguuuugauuuucauccuccugacugccguggcuccaucuaugacaaugagaugcauuggcaucucgaacagggacuuugucgaaggggugucaggagguagcuggguagauauaguucuggagcacggcaguugugugaccacuauggccaaaaauaagcccacacucgacuucgaauuaauuaagaccgaggcgaaacacccugcaacgcugcggaaguacugcaucgaagccaaacuuaccaacacaacuaccgcuucccgcuguccaacacagggggagcccucuuugaaugaggaacaagauaagcgauuugucugcaaacauagcaugguggacagaggauggggcaacgguugugggcuguucggaaagggcggcauugugacuugcgccauguuuaccugcaagaaaaauauggaggggaaggucguucagccugaaaaccuagaguauacaaucgugaucaccccacacuccggagaagagaaugcaguagguaacgauacuggcaaacaugggaaggagauuaaagugacgccgcagucaaguauaacagaagcugagcucaccggauacggcacugucaccauggaauguagccccaggacaggucuggacuucaaugagauggugcuucugcagauggaaaacaaggccugguugguucaccggcaaugguuucucgaucugccuuuaccauggcugcccggggcggacacccagggcucuaacuggauccagaaagagacucucgugacauucaagaauccucacgccaagaaacaggaugucgugguacuuggaucccaagagggcgcaaugcauacggcucugaccggggccacugaaauucagaugucaagcggaaacuugcuauuuacaggucaccugaagugccgucuccgcauggacaaacugcagcuuaagggcaugaguuauucuauguguaccgggaaauucaagguugugaaggagaucgcugaaacacaacauggaacuauagucauuagagugcaguacgagggcgacgguuccccaugcaaaauccccuucgagaucauggaucuggaaaagaggcacgucuuggggcggcucauuaccgugaauccgaucguuacggagaaagacagcccugugaacauugaagccgagcccccauuuggcgauucguacauaaucauuggaguagaaccuggccagcugaaguuaaauugguucaaaaaggggucuuccaucggacagauguuugagaccacaaugcgaggugcaaagcgcauggccauccugggcgacacugcuugggauuucgggucacuaggaggcgucuuuaccaguauugguaaagcgcuccaucaaguguucggggcaauauauggcgccgcuuuuagcggaguuuccuggacaaugaagauccugauuggcguggucaucacuuggauugggaugaacucuagaagcaccucacuuaguguguccuugguacuggugggaguugucacgcucuaccugggcgugauggugcaggccgacagcgguugugucguuucuuggaaaaauaaggagcuuaaaugcgggucaggaaucuucauaacagauaacgugcacaccuggacugaacaguauaaguuucagcccgagaguccaagcaagcuggcauccgccauccaaaaagcucacgaagagggcauuugugguaucaggucugugacacgguuggaaaaucucauguggaagcagauuacccccgagcugaaccauaucuuaucggagaaugaaguaaaacugacuauaaugaccggcgacauuaaggggaucaugcaggccggaaaacgcagccuaagaccucagccaacagagcucaaguacuccuggaaagcauggggcaaggcgaagaugcugucaacggaacuucacaaccauaccuucuugauugaugggccggagacugcugaaugccccaauacaaacagggccuggaauagucuggaggucgaggacuauggauuuggcguguucaccacaaacaucuggcucaaacugaaggaacgucaagauguauuuugugacucuaaauuaaugagcgcagccauaaaggacaaccgggcugugcacgccgauauggguuacuggaucgaguccgcacugaaugacacuuggaaaauugaaaaggcuucauucaucgaggucaagagcugccacuggccuaaaucucauacccuuugguccaacgggguguuggagagugaaaugauuaucccaaagaauuucgccggacccguuagccagcacaacuaucgaccuggcuaccauacgcagacagcggguccauggcaccucggcaaacuggagauggauuuugacuucugugaagggaccacugugguagucaccgaggauugcggaaauagaggccccucucuaaggacaacuaccgccuccgggaagcugauaacagaauggugcugucgcucaugcacgcucccgccucugcgguacagaggagaggacggcuguugguaugguauggagauuaggccacuuaaagaaaaggaggaaaacuuggugaauagucuggugaccgcugggcauggacagaucgauaacuuuagcuuaggcguccucgguauggcacuguuccuugaggaaaugcugcgcacucgaguuggcacaaagcacgccaucuugcucguggcuguaucguuugugacccugauuacugggaauauguccuuccgggaccuaggacgugucauggugaugguuggcgccacaaugaccgaugacaucgggaugggagugacguaccuggcacuccuggcggccuuuaaagucagacccacuuucgcugccggccuuuugcugaggaaguuaaccucuaaagagcucaugaugacaaccauugguauagugcugcuuagccaaucaacuaucccugagacaauucuggaacuaaccgaugcacucgcucuggggaugaugguuuugaagaucgugcgcaacauggagaaauaucagcuggccgucacaauuauggcaaucuuaugcguacccaaugccgugauacuccagaacgcuuggaagguuaguuguacuacccuggcgguggucuccgugucuccacuucuguugacgagcucccaacagaaggccgacuggaucccucucgcacugacaauuaaaggacuaaaucccaccgcuaucuuucugacuacccuuucacggacaagcaagaaaagaaguuggccacucaacgaagccauuauggccguaggcauggugucuauccuggcuuccagcuugcugaagaaugauauaccgaugacuggcccuuuagucgcagggggacuccugaccguuugcuacgugcuuacggguaggucggccgaccuggaguuggaacgagcggcugacgugcgcugggaggagcaggccgaaauuucaggcucuagucccauccucuccaucacaauuagcgaggaugggucuaugagcaucaagaacgaagaggaggaacagacccugacuauccuaauucggacaggacugcuugucaucuccggccucuucccagugucaauucccaucaccgcagccgcuugguaucugugggagguuaagaaacaaagagccgguguuuugugggacgugccuaguccacccccugucgggaaggcagaauuagaggauggagcguacaggauaaagcagaaaggcauccugggcuauagccagauuggggcuggaguguacaaggaagguacuuuucacacaauguggcauguuacccguggcgccgugcucaugcacaaagggaagcgcaucgagccgucuugggcagacgucaaaaaggaucugauuuccuacggaggcgguuggaaacuugagggggaauggaaagagggagaagaggugcagguacuggccuuggaaccaggcaagaacccccgggcuguccaaacgaaaccuggccuauucaagacuaauaccgggacaaucggagccgugucacuggacuuuaguccagguaccagcggcucccccauaguugauaaaaaggggaagguggucggacucuauggcaacggugugguuacaagaucugggacuuacgugucggcaauugcucagaccgagaaaaauaucgaggacaacccugaaaucgaggaugacauuuucaggaagaaacgacugacgaucauggaucuucauccgggagccggcaagacaaaacgguauuuacccgcgauaguccgcgaagccauuaagagaggccugaggacucucaucuuggcaccaacccgggugguagcugccgagauggaagaggcucugcgagggcucccuauuagauaccagacacccgcaauccgcgccgagcacaccggaagggaaauaguggaccugaugugucaugccacuuucaccaugcgucuucugagcccaauucggguuccuaauuauaacuugaucaucauggaugaggcucacuuuacagaccccgcgucaauugcagccagagguuacaucuccacgagggucgaaaugggcgaggcugccgggauuuucaugacugcaaccccaccgggaagucgcgacccuuuuccccagucuaaugccccaauaauggaugaggaacgagagauccccgaaagaagcuggaacuccggccacgagugggugacagacuucaaggguaaaaccgugugguuugucccuucaauuaaggcugggaaugauaucgcggccugccuacggaaaaacggaaagaaaguaauccaacugucuaggaagacuuucgacagcgaauauauuaagacacgcaccaaugauugggacuuugugguuacgacugauauaagugagaugggcgcaaacuucaaagcugagcgugugaucgacccaagacgguguaugaagcccgucauucucacagauggcgaagagagggugaucuuagccgggccuaugccgguuacccauuccauugcagcccagcgccgaggaagagugggucggaaucccaagaacgaaaaugaccaguacaucuacaugggcgagccccuggaaaacgaugaggacugcgcucacuggaaggaggccaaaaugcuucuggacaacauaaauaccccugaagggaucauucccagcauguuugagccagaaagggagaaggucgaugcgaucgacggagaauaucgccucagaggcgaggcaaggaaaacuuucguggauuugaugcggcguggugaccugccuguauggcucgccuaccgcguggcugccgaggggauuaacuaugcugaucgaagaugguguuuugacggcguuaagaauaaccaaauccuggaagagaaugucgaaguggagauauggacaaaggagggagaaaggaagaaacuuaaaccccgguggcuagaugcacgcauuuacucugacccacuggccuugaaagaguucaaagaguucgcugccggcagaaagucauuaacccugaaccucaucacagagauggggaggcugccuacuuuuaugacgcagaaggcacggaaugcgcuugauaaccuggccgugcuccauaccgcugaagccggaggucgagcauauaaucacgcuuuguccgagcugccggagacacuagaaacucugcuccuucugaccuuauuggccacagucaccggcgggauuuuccuguuucucaugaguggaaaaggcaucgguaagaugacucuggggaugugcugcauaaucacggcaagcguucuucugugguacgcccagauucagccccacuggaucgcugcgucgauuauccucgaguucuuuuugauagugcuguuaauuccagaaccugagaaacaaagaacaccacaggacaaccagcuaacauauguagugaucgccauccugacugucguggcagcuaccauggccaaugaaaugggcuuccucgagaagaccaagaaggauuuuggacuuggcucuauugccacccagcaaccagaguccaacauccuggacauagauuugcgcccugcaagcgcuuggacucuguacgccguugcgacaacguucauuacccccaugcucaggcauucaaucgaaaauaguucugugaacgucucccugacugcuauugccaaucaggcaacaguacuuauggggcucggaaaggguuggccgcugagcaaaauggacaucggcgugccauugcuggccauaggguguuacucacagguuaacccuaucaccuuaaccgcugcacuacugcuccuuguggcccacuaugcgauuaucggacccggccugcaggcuaaggccacacgggaggcacaaaaacgugccgcugccgguauuaugaagaauccaacugucgacgggaucacggugauugauuuggaccccaucccuuacgauccgaaauuugaaaagcagcugggccaggucaugcuccuggugcuuugcguuacccagguguuaaugaugagaacaacuugggcacugugugaggcucucaccuuggccacaggacccauaaguacccugugggaaggcaacccagggagguucuggaacacuacgauugcgguaagcauggccaauaucuuucgcggauccuaucuagcaggcgcuggucuacucuucucuaucaugaagaacacagccaauacccggcgagggacuggaaacaccggcgagacacuuggugagaaauggaagaauagacugaacgcauugggcaaaagcgaauuucaaauuuacaagaaauccgggauacaggagguggacaggacucuggcuaaggaaggaaucgagcgcggcgagaccgaucaucacgccgucucacgggggucugccaaacucagaugcuucguugaacguaaucuggugacaccugagggaaaggucguggacuuaggcugugguagagggggauggaguuauuacugcggcggucuuaagaacguaaaagaagugaagggccugacgaaagggggacccggccaugaggaaccuauuccaaugucgaccuauggguggaaucucguucggcuacagagcggaguggaugucuucuuuacucccccugagaagugugacacacuguugugcgauaucggcgaguccucuccaaaccccaccguggaagcgggucgcacucugcgaguccucaaucuuguggagaacuggcugaaaaauaacacacaauucuguauuaagguuuugaauccguacaugccuucaguaaucgaaaagauggaggcucugcagagaaaauacgggggagcacucgugaggaacccauuaagccggaacuccacccacgaaauguauugggucaguaaugccucuggcaacauagugagcucaguuaauaugaucucccgcaugcugauuaacagauuuacgaugaggcacaagaaagcuaccuacgagcccgacguggaucuuggcagugggacacgaaauaucggaauugagagcgaaaucccuaaccuggacauaauugguaagcggaucgagaaaaucaagcaggaacaugagacuucuuggcacuaugaucaggaccauccauacaagaccugggccuaucacggcuccuacgaaacaaaacaaacugggucagcaagcucgauggucaauggagugguacgucuacucaccaagcccugggacgugauuccgaugguuacacagauggccaugaccgauacuacgccuuucggccagcagagagucuuuaaagagaagguggacacacgcacccaagagcccaaagaagguacuaagaagcugaugaaaauaaccgcugagugguuguggaaggaacuggggaaaaagaaaacaccaaggaugugcacgcgggaggaguucaccagaaaggugcgcucuaacgcggcccucggagcaaucuuuacugaugaaaauaaauggaagagugcuagggaggccgucgaagacuccggcuucugggagcuuguugauaaggaacgaaaccugcacuuagagggcaaaugugagacaugcguguauaauaugauggggaagcgggagaaaaagcugggagaguuugguaaagcaaagggcagcagagccauuugguacaugugguugggggcuagguuccucgaauuugaggcccugggauuccuaaacgaagaccauugguuuucacgcgaaaauucccuuucuggcguagagggugaagggcugcacaagcucggauacauccugcgugaugugagcaaaaaggagggcggcgcgauguaugcagacgauaccgccgggugggacacucggauuacauuggaagaucugaaaaacgaggaaauggucaccaaucauauggagggagagcacaagaaacucgcugaagccaucuucaaacuuacauaccagaacaaggugguuagagugcagaggccuacuccccgcgguaccguccuggacauaaucagucgacgggaccagagaggcuccgggcaagugguaacguauggauuaaacaccuucacaaauauggaggcacagcugauuaggcagauggaaggcgaggguguuuuuaaaagcauccaacauuugacugugaccgaggaaauugcugucaagaacuggcucgcccgcguggggagagagcggcugucuaggauggcuaucucaggagaugacugcguggucaaaccacuagaugaccguuucgccagugcacuuacagcgcugaaugauaugggcaagguucgaaaagacauucagcagugggaacccucccgcggcuggaacgauuggacucaggugccuuuuuguagccaccacuuccaugagcucauaaugaaggacgggagaguacugguggucccaugccggaaucaagaugaauugaucggaagggcccgcauuucucagggugcuggcuggucguuaagagagaccgccugucuggggaagucauacgcacagauguggagccucauguauuuucaccggagggaccuucgacuggcugccaacgcaaucugcuccgccgugccgagucauuggguucccacgucucguacaaccuggagcauccacgcgacucacgaguggaugacaaccgaagauaugcuaacuguguggaauagagucuggauucaggagaacccuuggauggaagacaaaaccccaguggaguccugggaagagauacccuaccugggaaagcgcgaggaucaaugguguggcucacucaucgguuugacaagucgggcuacgugggccaaaaauauucagaccgcaaucaaccagguaaggucucugauugggaaugaagaguauacugacuacaugccuagcaugaagagauuccgccgggaagaggaagaggccggaguucuuugguga

SEQ ID NO: 14265 - RNA, 9876 nt, Artificial Sequence
  derived and/or modified CDS sequence (opt3) from DENV-2__AB189124__SS-prME
accgccggcgugauaauuaugaugauacccacagucauggcuuuccaccugacuacgagaaacggggaaccucauaugaucguuagcaggcaggaaaagggaaaaucccuccuuuuuaagaccgagaauggugugaacaugugcacacugauggcaauggacuugggcgaauuaugugaggauacuauuaccuacaauugcccacugcugcggcaaaacgaaccggaggacaucgauuguuggugcaauucuacaucaaccuggguaacuuaugggacauguaccgccacgggagagcaccgccgagaaaaacguaguguggcgcucgcuccccaugucggcaugggucuggagacuaggaccgaaacauggaugagcuccgagggggccuggaagcacgcacagaggauugagacuugggugcuucggcauccuggauucaccaucauggccgcuauacuggcauacacaaucggcaccacguauuuucagcgcguuuugauuuucauccuccugacugccguggcuccaucuaugacaaugagaugcauuggcaucucgaacagggacuuugucgaaggggugucaggagguagcuggguagauauaguucuggagcacggcaguugugugaccacuauggccaaaaauaagcccacacucgacuucgaauuaauuaagaccgaggcgaaacacccugcaacgcugcggaaguacugcaucgaagccaaacuuaccaacacaacuaccgcuucccgcuguccaacacagggggagcccucuuugaaugaggaacaagauaagcgauuugucugcaaacauagcaugguggacagaggauggggcaacgguugugggcuguucggaaagggcggcauugugacuugcgccauguuuaccugcaagaaaaauauggaggggaaggucguucagccugaaaaccuagaguauacaaucgugaucaccccacacuccggagaagagaaugcaguagguaacgauacuggcaaacaugggaaggagauuaaagugacgccgcagucaaguauaacagaagcugagcucaccggauacggcacugucaccauggaauguagccccaggacaggucuggacuucaaugagauggugcuucugcagauggaaaacaaggccugguugguucaccggcaaugguuucucgaucugccuuuaccauggcugcccggggcggacacccagggcucuaacuggauccagaaagagacucucgugacauucaagaauccucacgccaagaaacaggaugucgugguacuuggaucccaagagggcgcaaugcauacggcucugaccggggccacugaaauucagaugucaagcggaaacuugcuauuuacaggucaccugaagugccgucuccgcauggacaaacugcagcuuaagggcaugaguuauucuauguguaccgggaaauucaagguugugaaggagaucgcugaaacacaacauggaacuauagucauuagagugcaguacgagggcgacgguuccccaugcaaaauccccuucgagaucauggaucuggaaaagaggcacgucuuggggcggcucauuaccgugaauccgaucguuacggagaaagacagcccugugaacauugaagccgagcccccauuuggcgauucguacauaaucauuggaguagaaccuggccagcugaaguuaaauugguucaaaaaggggucuuccaucggacagauguuugagaccacaaugcgaggugcaaagcgcauggccauccugggcgacacugcuugggauuucgggucacuaggaggcgucuuuaccaguauugguaaagcgcuccaucaaguguucggggcaauauauggcgccgcuuuuagcggaguuuccuggacaaugaagauccugauuggcguggucaucacuuggauugggaugaacucuagaagcaccucacuuaguguguccuugguacuggugggaguugucacgcucuaccugggcgugauggugcaggccgacagcgguugugucguuucuuggaaaaauaaggagcuuaaaugcgggucaggaaucuucauaacagauaacgugcacaccuggacugaacaguauaaguuucagcccgagaguccaagcaagcuggcauccgccauccaaaaagcucacgaagagggcauuugugguaucaggucugugacacgguuggaaaaucucauguggaagcagauuacccccgagcugaaccauaucuuaucggagaaugaaguaaaacugacuauaaugaccggcgacauuaaggggaucaugcaggccggaaaacgcagccuaagaccucagccaacagagcucaaguacuccuggaaagcauggggcaaggcgaagaugcugucaacggaacuucacaaccauaccuucuugauugaugggccggagacugcugaaugccccaauacaaacagggccuggaauagucuggaggucgaggacuauggauuuggcguguucaccacaaacaucuggcucaaacugaaggaacgucaagauguauuuugugacucuaaauuaaugagcgcagccauaaaggacaaccgggcugugcacgccgauauggguuacuggaucgaguccgcacugaaugacacuuggaaaauugaaaaggcuucauucaucgaggucaagagcugccacuggccuaaaucucauacccuuugguccaacgggguguuggagagugaaaugauuaucccaaagaauuucgccggacccguuagccagcacaacuaucgaccuggcuaccauacgcagacagcggguccauggcaccucggcaaacuggagauggauuuugacuucugugaagggaccacugugguagucaccgaggauugcggaaauagaggccccucucuaaggacaacuaccgccuccgggaagcugauaacagaauggugcugucgcucaugcacgcucccgccucugcgguacagaggagaggacggcuguugguaugguauggagauuaggccacuuaaagaaaaggaggaaaacuuggugaauagucuggugaccgcugggcauggacagaucgauaacuuuagcuuaggcguccucgguauggcacuguuccuugaggaaaugcugcgcacucgaguuggcacaaagcacgccaucuugcucguggcuguaucguuugugacccugauuacugggaauauguccuuccgggaccuaggacgugucauggugaugguuggcgccacaaugaccgaugacaucgggaugggagugacguaccuggcacuccuggcggccuuuaaagucagacccacuuucgcugccggccuuuugcugaggaaguuaaccucuaaagagcucaugaugacaaccauugguauagugcugcuuagccaaucaacuaucccugagacaauucuggaacuaaccgaugcacucgcucuggggaugaugguuuugaagaucgugcgcaacauggagaaauaucagcuggccgucacaauuauggcaaucuuaugcguacccaaugccgugauacuccagaacgcuuggaagguuaguuguacuacccuggcgguggucuccgugucuccacuucuguugacgagcucccaacagaaggccgacuggaucccucucgcacugacaauuaaaggacuaaaucccaccgcuaucuuucugacuacccuuucacggacaagcaagaaaagaaguuggccacucaacgaagccauuauggccguaggcauggugucuauccuggcuuccagcuugcugaagaaugauauaccgaugacuggcccuuuagucgcagggggacuccugaccguuugcuacgugcuuacggguaggucggccgaccuggaguuggaacgagcggcugacgugcgcugggaggagcaggccgaaauuucaggcucuagucccauccucuccaucacaauuagcgaggaugggucuaugagcaucaagaacgaagaggaggaacagacccugacuauccuaauucggacaggacugcuugucaucuccggccucuucccagugucaauucccaucaccgcagccgcuugguaucugugggagguuaagaaacaaagagcagggguuuugugggacgugccuaguccacccccugucgggaaggccgaauuagaggauggagcguacaggauaaagcagaaaggcauccugggcuauagccagauuggggcuggaguguacaaggaagguacuuuucacacaauguggcauguuacccguggcgccgugcucaugcacaaagggaagcgcaucgagccgucuugggcagacgucaaaaaggaucugauuuccuacggaggcgguuggaaacuugagggggaauggaaagagggagaagaggugcagguacuggccuuggaaccaggcaagaacccccgggcuguccaaacgaaaccuggccuauucaagacuaauaccgggacaaucggagccgugucacuggacuuuaguccagguaccagcggcucccccauaguugauaaaaaggggaagguggucggacucuauggcaacggugugguuacaagaucugggacuuacgugucggcaauugcucagaccgagaaaaauaucgaggacaacccugaaaucgaggaugacauuuucaggaagaaacgacugacgaucauggaucuucauccgggagccggcaagacaaaacgguauuuacccgcgauaguccgcgaagccauuaagagaggccugaggacucucaucuuggcaccaacccgggugguagcugccgagauggaagaggcucugcgagggcucccuauuagauaccagacacccgcaauccgcgccgagcacaccggaagggaaauaguggaccugaugugucaugccacuuucaccaugcgucuucugagcccaauucggguuccuaauuauaacuugaucaucauggaugaggcucacuuuacagaccccgcgucaauugcagccagagguuacaucuccacgagggucgaaaugggcgaggcugccgggauuuucaugacugcaaccccaccgggaagucgcgacccuuuuccccagucuaaugccccaauaauggaugaggaacgagagauccccgaaagaagcuggaacuccggccacgagugggugacagacuucaaggguaaaaccgugugguuugucccuucaauuaaggcugggaaugauaucgcggccugccuacggaaaaacggaaagaaaguaauccaacugucuaggaagacuuucgacagcgaauauauuaagacacgcaccaaugauugggacuuugugguuacgacugauauaagugagaugggcgcaaacuucaaagcugagcgugugaucgacccaagacgguguaugaagcccgucauucucacagauggcgaagagagggugaucuuagccgggccuaugccgguuacccauuccagcgcagcccagcgccgaggaagagugggucggaaucccaagaacgaaaaugaccaguacauuuacaugggcgagccccuggaaaacgaugaggacugcgcucacuggaaggaggccaaaaugcuucuggacaacaucaauaccccugaagggauaauccccucuauguuugagccagaaagggagaaggucgaugcgauugacggagaauaucgccucagaggcgaggcaaggaaaacuuucguggauuugaugcggcguggugaccugccuguauggcucgccuaccgcguggcugccgaggggaucaacuaugcugaucgaagaugguguuuugacggcguuaagaauaaccaaauucuggaagagaaugucgaaguggagaucuggacaaaggagggagaaaggaagaaacuuaaaccccgguggcuagaugcacgcauauacucagacccacuggccuugaaagaguucaaagaguucgcugccggcagaaaguccuuaacccugaaccucauuacagagauggggaggcugccuacuuuuaugacgcagaaggcacggaaugcgcuugauaaccuggccgugcuccauaccgcugaagccggaggucgagcauauaaucacgcuuugagugagcugccggagacacuagaaacucugcuccuucugaccuuauuggccacagucaccggcgggaucuuccuguuucucaugagcggaaaaggcauugguaagaugacucuggggaugugcugcaucauaacggcaucgguucuucugugguacgcccagauccagccccacuggauugcugcgucuaucauucucgaguucuuuuugaucgugcuguuaauaccagaaccugagaaacaaagaacaccacaggacaaccagcuaacauauguagugauugccauccugacugucguggcagcuaccauggccaaugaaaugggcuuccucgagaagaccaagaaggauuuuggacuuggcuccaucgccacccagcaaccagagagcaacauucuggacaucgauuugcgcccugcaucagcuuggacucuguacgccguugcgacaacguucauaacccccaugcucaggcauaguauugaaaauucuuccgugaacgucagccugacugcuaucgccaaucaggcaacaguacuuauggggcucggaaaggguuggccgcugucaaaaauggacauuggcgugccauugcuggccaucggguguuacagucagguuaacccuauaaccuuaaccgcugcacuacugcuccuuguggcccacuaugcgaucauuggacccggccugcaggcuaaggccacacgggaggcacaaaaacgugccgcugccgguaucaugaagaauccaacugucgacgggauuacggugaucgauuuggaccccauuccuuacgauccgaaauuugaaaagcagcugggccaggucaugcuccuggugcuuugcguuacccagguguuaaugaugagaacaacuugggcacugugugaggcucucaccuuggccacaggacccaucagcacccugugggaaggcaacccagggagguucuggaacacuacgauagcgguauccauggccaauauuuuucgcggaucuuaucuagcaggcgcuggucuacucuucagcaucaugaagaacacagccaauacccggcgagggacuggaaacaccggcgagacacuuggugagaaauggaagaauagacugaacgcauugggcaaauccgaauuucaaaucuacaagaaaucagggauucaggagguggacaggacucuggcuaaggaaggaauagagcgcggcgagaccgaucaucacgccgucucucgggggagugccaaacucagaugguucguugaacguaaucuggugacaccugagggaaaggucguggacuuaggcugcgguagagguggguggucguauuacuguggcggucuuaagaacguaaaagaagugaagggccugacgaaagggggacccggccaugaggaaccuaucccaaugagcaccuauggguggaaucucguucggcuacaguccggaguggaugucuucuuuacucccccugagaagugcgacacacuguugugugauauuggcgagucuucaccaaaccccaccguggaagcgggucgcacucugcgaguccucaaucuuguggagaacuggcugaaaaauaacacacaauucugcaucaagguuuugaauccguacaugccuagcguaauugaaaagauggaggcucugcagagaaaauacgggggagcacucgugaggaacccauuaucccggaacaguacccacgaaauguauugggucucuaaugccagcggcaacaucgugucauccguuaauaugauaagucgcaugcugaucaacagauuuacgaugaggcacaagaaagcuaccuacgagcccgacguggaucuuggcagcgggacacgaaauauuggaaucgagucugaaauuccuaaccuggacaucauagguaagcggauugagaaaaucaagcaggaacaugagacuuccuggcacuaugaucaggaccauccauacaagaccugggccuaucacggcucauacgaaacaaaacaaacugggagcgcaucgucuauggucaauggagugguacgucuacucaccaagcccugggacgugaucccgaugguuacacagauggccaugaccgauacuacgccuuucggccagcagagagucuuuaaagagaagguggacacacgcacccaagagcccaaagaagguacuaagaagcugaugaaaauuaccgcugagugguuguggaaggaacuggggaaaaagaaaacaccaaggauguguacgcgggaggaguucaccagaaaggugcgcaguaacgcggcccucggagcaauauuuacugaugaaaauaaauggaaguccgcuagggaggccgucgaagacagcggcuucugggagcuuguugauaaggaacgaaaccugcacuuagagggcaaaugcgagacauguguguauaauaugauggggaagcgggagaaaaagcugggagaguuugguaaagcaaagggcucaagagccaucugguacaugugguugggggcuagguuccucgaauuugaggcccugggauuccuaaacgaagaccauugguuuucccgcgaaaauucucuuagcggcguagagggugaagggcugcacaagcucggauacauucugcgugaugugaguaaaaaggagggcggcgcgauguaugcagacgauaccgccgggugggacacucggaucacauuggaagaucugaaaaacgaggaaauggucaccaaucauauggagggagagcacaagaaacucgcugaagccauuuucaaacuuacauaccagaacaaggugguuagagugcagaggccuacuccccgcgguaccgucauggacaucauaucccgacgggaccagagaggcagcgggcaagugguaacguauggacugaacaccuucacaaauauggaggcacaguuaaucaggcagauggaaggcgaggguguuuuuaaaucuauucaacaucugacugugaccgaggaaaucgcugucaagaacugguuggcccgcguggggagagagcggcucucaaggauggcuauuaguggagaugacugcguggucaaaccacuggaugaccguuucgccuccgcacuaacagcgcuuaaugauaugggcaagguucgaaaagacauccagcagugggaacccagccgcggcuggaacgauuggacucaggugccuuuuugcucucaccacuuccaugagcugauuaugaaggacgggagaguacucguggucccaugucggaaucaagaugaacugauaggaagggcccgcaucucgcagggugcuggcuggucauugagagagaccgccugcuuaggaaagagcuacgcacagauguggucccugauguauuuucaccggagggaccuccgacuugcugccaacgcaauuuguagugccgugccgucucauuggguucccacgagccguacaaccugguccauccacgcgacucacgaguggaugacaaccgaagauaugcugacuguguggaauagagucuggauccaggagaacccuuggauggaagacaaaaccccaguggagucaugggaagagauucccuaccuaggaaagcgcgaggaucaauggugcggcagucugauaggucucacaucucgggcuacgugggccaaaaauauccagaccgcaauuaaccagguaaggagcuugaucgggaaugaagaguauacugacuacaugccuuccaugaagagauuccgccgggaagaggaagaggccggaguucugugguga

SEQ ID NO: 14266 - RNA, 9876 nt, Artificial Sequence
  derived and/or modified CDS sequence (opt3) from DENV-2__AB122020__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguuuuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucaucccaaaaaacuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugaugguauuaaaaauagugcgcaacauggaaaaguaccaacucgccgucacgaucauggcaauuaguugcgugcccaaugccguuauccugcagaacgcuuggaagguguccuguacaauucuugcggccgucucugugagcccacuguugcucaccuccucacagcagaaagcagacuggaucccucuggcucuaacuauaaagggccugaaucccaccgccauuuuucuuacaacucucagccggaccaguaaaaagagaucuuggccacugaacgaggccaucauggcuguuggcaugguguccaucuuggcaagcucgcuguuaaaaaaugacauuccgaugacggggccucucgucgccggaggucugcuuacaguaugcuaugugcugaccggcaggucagcggauuuggaacucgagcgagcugccgacguuaagugggaggaucaagcagaaauaucugggaguucccccauccugagcauuacuaucucugaggacggaagcauguccauuaaaaacgaagaggaggaacagacacuaaccauccugauacgcacuggccuucucgugaucucaggugucuucccagugaguauucccaucacagccgcugcaugguaccugugggagguaaagaagcagcgggccgggguguugugggaugucccuagcccacccccuguuggaaaagcggaauuagaggacggcgcuuauagaauuaagcagaggggcauccugggguacucucaaauaggagccgguguguauaaagaaggcaccuuucacacgauguggcaugugacucguggggcaguccucaugcaccgcggaaagcggauugagccguccugggccgaugugaaaaaggaccugaucucauacggcgguggguggaagcuugagggagaauggaaagagggcgaagagguucagguacuggcuuuggaaccaggcaagaaucccagagccgugcagaccaaaccugggaucuucaagacaaacaccggaacaauuggugcagucagucuagauuuuagcccaggcacuuccgggucucccaucguggacaggaaaggaaagguugugggccuguacgguaauggggucgugacccgaucgggagcuuauguaagcgccauagcgcagacggagaagucaauugaggauaacccugaaaucgaggacgauauuuuccggaaaaagcgccucacaaucauggaccugcauccgggcgccggcaaaacuaagagauaccuucccgcaauagucagggaagcuauuaaacggggguuacgaacccugauccucgccccaacaagagugguugcugcagagauggaagaggccuugcgcggacugccuaucagguaucaaacccccgccauucgugcugagcacacuggucgggaaaucguggaccucaugugucaugcgaccuucacaaugagacugcuuuccccagucagggugccuaacuacaaucugauuauaauggaugaggcacacuuuacggaccccgccaguaucgcugcccgcggcuauauuucuacucgaguugaaaugggggaggcagccggaaucuucaugaccgcuacaccaccgggcagcagagauccuuuuccccaguccaacgcgccaaucauggacgaggaacgggagauucccgaaaggucauggaauucuggucacgagugggugaccgauuucaaggggaagacugucugguuugugccuagcauaaaagccggaaacgacaucgcagcuugcuugcgcaagaauggcaaaaagguaauucagcuaagucguaaaacauucgauuccgaauacgugaagaccagagccaacgacugggauuuuguugucacgacugacaucagcgagaugggcgcaaauuucaaggccgagcgggugauugauccaaggcgcuguaugaaacccgugauccugacagacggggaagagcgagucauacucgcuggaccuaugccgguaacccauucuucagccgcgcaaagacgggguaggaucggccgcaacccaaagaaugaaaacgaccaguauauuuacaugggggagcccuuagaaaaugaugaggacugcgcacacuggaaagaggccaagaugcugcuugauaacaucaauaccccugaaggaauuauccccuccauguuugagccagaaagagagaaaguggacgcuauagauggcgaauacaggcugcggggugaggcccguaagacuuucguugaccucaugcgccgaggggauuugccuguguggcuggcuuauaaagucgcagccgagggcauuaacuacgcugacagaaagugguguuuugauggaaucaagaauaaccagauucucgaagagaacguggaaguugagaucuggacaaaagagggcgaaaggaagaaacugaagccccgguggcuugacgcccgcauauauagugauccacuagcacugaaagaguucaaggaauucgcggccgggagaaagagcuugaccuuaaaucugaucacagagaugggaaggcucccuacuuuuaugacgcagaaagcucggaacgcccuggacaaucuugcagugcugcauaccgcugaagucgguggccgagccuacaaccacgcacucucggaguugccggagacacuggaaacucuacugcuccuuacccuguuagccacagugaccgggggaauuuucuuguuucugaugucuggcaaggguaucgggaaaaugacucucggcaugugcugcauuaucacggcuuccauacugcuuugguaugcgcaaauucagccccacuggaucgccgcaagcaucauucuggaguucuuucucaucguauugcugauaccagaaccugagaagcagagaaccccccaggauaaucaauuaacauacgugguuauugcuauccuaacugucguggccgccaccauggcaaacgaaaugggauuccuggagaaaacaaagaaggaccucggcuuugggucaauuaccacucaggagagugaaucuaauauccuugacauagaucugcgcccagcuuccgccuggacauuguaugcgguggcuacgaccuucgucacuccuaugcugaggcauagcaucgagaacucaaguguuaaugugagccucacagccauugcaaaccaggccaccguacugaugggacuugguaaaggcuggccccucuccaagauggacaucggggugccgcuguuggcuauuggauguuacucucaggucaauccaaucacccugacagcagccuuacuacugcucguggcgcacuacgcuauuaucggcccuggucuucaagccaaagcaacucgggaagcccagaagcgugcugccgcagggauaaugaaaaaccccacgguugauggcauuaccgugaucgaccuggagccaauccccuaugauccuaaguuugaaaagcaguugggacaggucaugcugcucauucugugcguaacacaagugcuuaugaugagaacuaccugggcuuuaugugaggcccugacacucgcgaccggcccgauaagcacuuugugggaggggaaucccggaagguucuggaacacgacaaucgccguuuccauggcaaauauuuuucgcggcucauaccuggcuggugccgggcuacuguucucuaucaugaaaaacaccacuaauacccggcgaggaacaggcaacgugggugaaacucucggcgagaaguggaaaaguagacuuaacgcacuggggaagucggaauuucagauuuauaaaaagagcggaauccaggaggucgacaggaccuuggcuaaagagggcauaaagcgcggggaaacagaucaucacgccgugucccggggaucugccaagcugagaugguucgucgagcguaauauggugacgccagaaggcaaaguuguggaccucgguugcgggaggggaggcuggucauacuauugugguggccugaagaacguacgggaggugaaaggguuaaccaagggaggcccugggcaugaagagcccaucccuaugagcacuuacggauggaaucuuguccgccugcaauccggcguugauguguucuuuacaccacccgagaaaugcgacacccuccuaugugauauuggugaaaguucuccuaacccaacuaucgaggcggggcgaacacugagagucuugaaucugguggaaaacuggcucaauaacaauacccaguucugcauuaagguacuuaaccccuauaugccgagcgugaucgagaagauggaaacgcugcagaggaaauacggaggcgcuuugguucggaauccucugucacgcaacuccacccacgagauguacugggugaguaaugcaacaggcaacauagucagcucugugaauaugauuuccagaaugcucaucaacagguuuacuaugaagcacaaaaaggccaccuaugagccagacgucgauuuagggucaggaacacgaaacaucgguauugaaagcgagauacccaaucuggacaucauuggcaaacggaucgaaaagauuaagcaggagcaugaaacuucguggcacuacgaccaagaucauccuuauaaaaccugggcuuaccacgggucuuaugagacaaagcagaccggaagugccuccagcauggugaacggcguuguacgucuucugacuaaaccaugggacgugguccccauggugacgcagauggcaaugacagauaccacuccguucggucagcaaagaguuuuuaaggagaaaguggacacccgcacacaggaaccuaaggaggggacgaagaaacuaaugaagaucaccgccgaauggcucuggaaagagcugggaaaggagaaaacucccaggauguguacacgggaagaguucaccagaaagguccgcucaaaugcugcguugggcgccauauuuacugaugaaaacaaauggaaguccgcaagggaggcuguggaagacggccgauucugggagcugguagaucgggagagaaaucuccaccuugaagggaagugcgagacauguguguacaacaugaugggaaaaagggaaaagaaacugggugaguuuggcaaggccaaagggucucgcgcaaucugguauaugugguuaggagcccguuuccuggaauuugaggcuuugggcuuccucaaugaggaccauugguuuagccgggguaacagucuguccgggguugaaggagagggccuacacagacuuggcuacauucugagggaagucgggaagaaggagggaggugccauguacgcggaugacaccgcaggcugggauacacgcaucacucucgaagaccugaaaaaugaggagauggugaccaaccauaugaagggggaacacaaaaaguuggccgaggcuauuuucaaacugacguaucagaauaaggugguccgaguucagcggccaaccccuagaggaacagugauggacaucauuagcaggaaggaucaacgcggcucuggucagguagggacuuacggacucaacaccuucacaaauauggaagcccagcuuauaagacaaauggagggcgagggcaucuuuaaaucaauucagcaucugacugcaaccgaagagaucgcugugcagaacugguuagcccgggucgggagggaacgucugagucgaauggcuaucuccggagacgauugcgugguuaagcccauugacgaucgcuucgccagcgcauugacggcgcucaaugacauggguaaagugagaaaggauauacagcaaugggagccaucucggggcuggaacgacuggacacagguccccuuuugcucgcaccacuuccaugaacuggugaugaaagaugggaggguacuaguugugccuugucgcaaccaggacgagcuuaucggaagagcccggauuucacagggcgcugguuggagccugaaggagaccgccugccucgggaaguccuaugcacaaauguggacucugauguacuuucacaggcgagauuugcguuuagcugccaaugcaaucuguagugccgucccaucucauugggugccgacaagcagaaccacuugguccauucacgcgaaacacgaauggaugaccacagaggacaugcuggcuguguggaaccgcgucuggauccaggaaaaucccuggauggaggauaagacgccuguugaaucaugggaggaggugccauaucucggaaaacgggaagaccaguggugcggcagucuuauaggccugaccucuagggccacuugggcaaagaacauccagacagccauuaaucaaguaagaagccuaaucgggaacgaggaauacaccgacuauaugcccuccaugaaacgcuuccggagggaggaagaggaggcuggagugcugugguga

SEQ ID NO: 14267 - RNA, 9876 nt, Artificial Sequence
  derived and/or modified CDS sequence (opt3) from DENV-2__LC121816__SS-prME
accgugggcaugaucauuaugcugauacccacagccauggcuuuccaccucacuacgagaaacggggagccucauaugaucgucagcaggcaggaaaagggaaaaucccuucuguuuaagaccgaggacgguguuaauaugugcacauugauggcaauggauuuaggcgaacugugugaggacacugugaccuacaacugcccacuacuccggcaaaaugaaccggaggauauugacuguuggugcaacucuacaucaaccuggguaacuuaugggacauguaccgccacgggagagcaccgccgagaaaaacguaguguggcgcuggucccccaugugggcaugggucuugagacuagaaccgaaacauggaugagcuccgagggggcuuggaagcacgcccagaggaucgagacuuggauucugcggcauccuggauucaccaucauggcagccauauuggcucacacaaucggcaccacguacuuucagcgcguucucauuuucauccugcugacugcaguggccccaucuaugacaaugagaugcauuggcaucucgaauagggauuuugucgaaggggugucaggagguagcuggguagacauaguucucgagcacggcaguugugugaccacuauggcuaaaaacaagcccacauuagauuucgaacugauuaagaccgaggccaaacagccugcgacgcuucggaaguauugcaucgaagcaaaauugaccaauacaacuaccgccucccgcuguccaacacaaggggagcccucucugaacgaggaacaggacaagcgauuugucugcaaacauagcaugguggauagaggauggggcaaugguugugggcuauucggaaagggcggcauugugacuugcgcuauguuuaccugcaagaaaaacauggaggggaagaucguccagccugaaaaucucgaguacacaaucguuauuaccccacacuccggagaagagaacgccguggguaaugacacuggcaaacaugggaaggagguaaaagugacgccgcagucaaguauaacagaagcagagcugaccggauauggcacugucaccauggaauguagccccaggacaggucuugauuucaacgagauggugcuguugcaaauggaaaauaaggcuuggcucguucaccggcagugguuucuggacuuaccucugccauggcuccccggggccgauacccagggcucuaacuggauccagaaagagacucuugugacauucaagaacccucacgcgaagaaacaagacgucgugguacugggaucccaggagggcgccaugcauacggcauugaccggggcuacugaaauucagaugucaagcggaaaucuacuguuuacaggucaccucaagugccgucugcgcauggacaaacuucaacugaagggcaugaguuacucuauguguaccgggaaauucaagguugugaaggagaucgccgaaacacagcauggaacuauagucauuagagugcaguaugagggcgaugguuccccaugcaaaauccccuucgagaucauggacuuggaaaagaggcacguccucgggcggcugauuaccgugaacccgaucguuacggagcgagauagcccugugaauauugaagcugagcccccauuuggcgacucguacauaaucauuggaguagaaccuggccaguuaaaacugucuugguucaagaaaggguccucaaucggacaaauguuugagaccacaaugcgcggugccaagagaauggcaauccuaggcgauacugccugggacuucgggagucucggaggcgucuuuaccagcauugguaaggcucugcaucagguguucggggcgauauacggcgcagccuuuuccggaguuucuuggacaaugaaaauccuuauuggcguggucaucacuuggauugggaugaacagcaggucaaccaguuuguccgugagccugguacucgugggaguugucacgcuguaucuuggcgugauggugcaggcugauucugguugugucguuucauggaagaauaaagagcugaagugcgggaguggaaucuucauaacagacaacgugcacaccuggacugaacaguacaaauuucaacccgagagcccauccaaguuggccucugcaauccagaaggccuaugaagagggcauuugugguauccggucggugacacgccucgaaaaucugauguggaaacagauuacccccgaguuaaaccacauccugagcgagaaugaaguaaagcuaacuauaaugaccggcgauauuaaagggaucaugcaggcuggaaagagaucccucaggccucaaccaacagagcugaaauacucauggaagacguggggcaaagccaagaugcuuaguaccgaacaucacaaccagacuuugcugauugacgggccggagacagcagaaugccccaauaccaaccgugcguggaauucucucgaggucgaggauuauggauucggcguguuuacaacuaacaucuggcugaaguuaaaagaacggcaggacguuuucugugacagcaagcugauguccgcugccauaaaagauaaucgagcagugcaugccgacauggguuacuggaucgagucagcucuuaacgauaccuggaagauugaaaaagccagcuuuaucgaggucaagucuugccacuggccuaagucccacacguuguggaguaacggggugcucgagagcgaaaugauuaucccaaaaaauuucgcaggacccguuucucagcauaacuauagaccuggcuaccacacacaaaccgcugguccauggcaucugggcaagcuagagauggacuucgauuuuugugaagggacuaccgugguagucacagaggacugcggaaauaggggccccucccugcgcacuaccacagccucagggaaacucauaacggaauggugcugucggaguugcacccugccgccucuuagauacaggggagaggauggcuguugguaugguauggagauucgcccauugaaggaaaaagaggaaaaccuggugaauagcuuagugacugcggggcacggacagaucgacaacuucucgcucggcguccuggguauggcccuuuuucuggaggaaauguugcgaacacggguuggcaccaagcaugcucuccugcuaguggcaguauccuucaugacucugaucacagggaauaugucuuuucgugaucucggaagagugauggucauggugggcgccgcuaugaccgacgauauugggaugggaguuacguaccuggcccuuuuggcagcguucaaggugaggcccacuuuugccgcuggccuguuacuccgcaaacugaccagcaaggagcuuaugaugacaaccaucgguauuguccugcuaucacagaguacuauaccugagacaauccucgaacugaccgacgccuuggcacuggggaugaugauuuuaaaaaucgugcggaacauggagaaguaucaacucgcuguuacaauuauggccauccugugcgugcccaaugcagucauacuucagaacgccuggaaaguauccuguacuauccuggcugugguuucugugaccccauugcuccugacgagcuccagacagaaggcggauuggauuccucuagcccugacaaucaagggacuuaaucccaccgcaauuuuccucacuacccugucaaggacaaacaaaaagcgaagcuggccauugaaugaagcuaucauggccgucggcauggugaguauacuggccucuuccuuacucaaaaacgacauuccgaugacuggcccucugguagcugggggacuucugaccgugugcuacgucuugacgggucgcagcgcagaccucgagcuggaacgggccgcggauguuagaugggaggaccaggcugagaucucgggcucaucucccauccuaaguauuacaauauccgaagaugggagcaugucuaucaagaaugaggaagaggagcaaacccugacuauucuuaucaggacaggacuccuggugauuagcggcuuguuuccaguguccauccccauaaccgccgcagccugguauuuaugggaagucaaaaagcagcgugcuggugugcugugggacguuccuucaccacccccuguagggaaagcagagcucgaagauggagccuaccgcaucaagcagaagggcauucugggcuauagucagaucggggcgggaguguacaaagaggguacuuuccacacaauguggcacgucacccggggcgcugugcuuaugcauaaggggaaaagaauugaaccgagcugggccgacguuaggaaggaucugaucucuuacggaggcgguuggaaauuggagggggaguggaaggaaggagaggaagugcaaguccuagcacuggagccaggcaagaacccccgagccgugcagacgaaaccuggccucuuuaagacugacaccgggacaauaggagcuguaucccuggauuucucaccagguaccaguggcagccccauugucgacaaaaaggggaaagugguuggacuuuauggcaacgguguggucacacgguccgggacuuacgugucugccaucgcacagaccgaaaagucgaucgaggauaauccugagauugaagacgauaucuuucgcaagagaagguuaacgauaauggaccugcacccgggagcuggcaaaacaaagcgguaucuccccgccauuguucgagaggcgaucaaaagaggcuugcgcacucugauucucgccccaaccaggguggucgcagcugaaauggaggaagcccugcgugggcuuccuauccgguaccagacacccgcuauaagagcagagcauaccggaagggagauuguggaccugaugugucacgccacuuucaccaugcgcuugcuaagcccaguacgagugccuaacuauaaucugaucaucauggaugaagcccauuucacagaccccgcuucaauugcggcaagagguuacaucuccacgcggguugagaugggcgaagccgcugggauuuuuaugacugccaccccaccgggaaguagggauccuuucccccaaucuaacgcaccaauaauggacgaggagcgcgaaauccccgagcguagcuggaauuccggccacgaaugggucacagauuuuaaggguaaaaccgugugguucgugccuucaauuaaggccgggaacgacaucgcugcgugccucagaaagaauggaaaaaaggucauccaguuaucucggaaaacuuuugauagcgaguauauuaagacaaggaccaacgacugggauuucguagugacgacugacauaagugaaaugggcgccaauuuuaaagcagagcgcguuaucgauccacgaagauguaugaagcccgugauucugacagacggcgaggaacgggucauccuugcugggccuaugccggugacccacuccagcgccgcacagaggcgcggaagaauugguaggaacccaaagaaugagaacgaccaauacaucuacaugggcgaaccccuggagaaugaugaagacugcgcccauuggaaagaggcuaagaugcucuuggauaacauaaauaccccugaggggaucauucccucuauguucgaaccagagcgggaaaaaguugacgccaucgauggagaguaucgucugcgcggcgaagcgcgaaagacuuuuguggaccucaugagaaggggugaucugccugucuggcuugcauaccggguggccgcugaggggauuaacuaugccgaccgcagaugguguuucgauggcguaaaaaacaaucagauccuagaggaaaacguggagguugaaauauggacaaaggagggagagaggaaaaagcugaagccccggugguuggacgcucgaauuuacucagauccauuagcacugaaagaauuuaaggaguucgccgcuggcagaaaaucccucacccugaaucuuaucacagaaauggggcgccugccuacuuucaugacgcagaaggccaggaacgcacucgacaauuuggcgguccugcacaccgccgaggcuggaggucgggccuauaaccaugcacuaagugaacugccggagacacucgagacucuucuguuauugacccugcucgcuacagugaccggcgggauuuuucuguuccuuaugagcggaaaaggcaucgguaagaugacucuggggaugugcugcauaaucacggccucgauucucuugugguacgcacagauccaaccccacuggauugccgcuucuaucauacuggaauuuuucuuaauugugcuacugaucccagagccugaaaagcagcguaccccccaggauaaucagcucacauaugucguuaucgcgauucuuacugugguagccgcaaccauggcuaacgagaugggcuuucuggaaaaaacaaagaaagacuucggauugggcuccaucgccacccaacagccagagagcaauauacuggacauugaucucagaccugccucagcauggacucuguacgcuguggccacaacguuuaucacccccaugcuuaggcacaguauugagaacucuuccgucaaugugagccucacugcgaucgcuaaccaggccacaguucugaugggguugggaaaggguuggccgcugucaaaaauggacauaggcgugccauuacuagcaaucggguguuacagucaggucaauccuauuacccugaccgccgcucuccuucuguugguagcacauuaugccaucauuggacccggccugcaagcgaaggcuacacgcgaagcccagaagcgggcagccgcugguaucaugaaaaacccaacuguggaugggauuacgguuaucgaccucgaucccauaccuuacgacccgaaguucgagaaacagcugggccaggugaugcuuuuaguccugugcgugacccaaguccucaugaugcgaacaacuugggccuugugugaagcacugacccuagcuacaggacccauuagcacccugugggagggcaauccagggagauuuuggaacacuacgaucgccguguccauggcgaauaucuucaggggaucuuaucucgccggcgcaggucuucuguuuagcauuaugaagaacacaaccaacacucgccgggggaccggaaauacaggcgaaacuuugggugagaaauggaagaacagacugaaugcucucggcaaguccgaguuccagaccuacaaaaagucagggauacaggaaguugaucguacacuggccaaagagggaaucaagaggggcgaaacggaccaccaugcagugucucgggggagugcuaaauuacgcugguuuguagagcgaaaccuugugaccccugagggaaaggucguugaucugggcugcgguagagggggauggucguauuacuguggcggucucaaaaaugugagggaagucaagggccuaacuaaggggggacccggccacgaggaaccuauuccaaugagcacauauggguggaaccuggugcgguugcaauccggaguagacguguucuucacccccccugagaaaugcgauacucugcucugugacaucggcgaaucuucaccaaaucccacaguugaggccggucgcacccuuagagugcugaacuuggucgagaauuggcugaacaauaacacgcaguuuugcauuaaggugcucaauccguacaugccuagcgucaucgaaaaaauggaggccuuacagaggaaguacgggggagcgcuggugcgaaacccacuuucccggaauaguacccaugaaauguauuggguuucuaacgcuagcggcaacauaguaucauccgugaauaugaucagucguaugcugauuaacagauucacaaugcgccacaaaaaggcaacuuacgagcccgaugucgaccuaggcagcgggaccaggaauaucggaauugaaucugagacaccuaaccucgacaucauagguaagcggauugagaaaaucagacaggaacacgagacuuccuggcauuaugaucaagaccacccauacaagaccugggccuaucauggcucauacgaaacaaaacagaccgggagcgcuucgucuauggugaauggaguugugcgccuguugacuaagcccugggaugucaucccgauggugacgcagauggccaugacagacaccacuccuuuuggccagcaaaggguauucaaagagaagguggauacccgaacacaggaacccaaggaggguacgaaaaagcugaugaaaauuaccgcaaaguggcucuggaaagagcuugggaagaagaaaacuccacggauguguacaagagaagaguuuaccaggaagguucgcaguaacgccgcucugggagcgauauucacugacgaaaauaaauggaaguccgcccgugaggcagucgaggauagccgguuuugggaauuaguggacaaagagagaaaccugcacuuggaaggcaagugcgagacauguguguauaauaugaugggcaaaagggaaaagaagcucggggaguucggaaaagcuaaggguucacgcgccaucugguacauguggcugggcgcacgauuucuagaguucgaagcccuuggguuucugaacgaggaucacugguucucccgggaaaauucucucagcggagucgagggcgaaggucugcauaaauugggguacauucugagagacguuaguaagaaagagggaggcgcuauguaugccgaugacaccgcgggcugggacacaaggaucacucucgaggaucuuaagaacgaagagauggugaccaaucacauggaaggggagcauaagaaacuggcagaagccauuuuuaaguuaacguaccagaacaaaguagugcgcguccagagaccuaccccccggggaacagugauggacaucauauccaggcgugaucaacgagguagcggccagguugggacuuauggacugaauaccuucacaaacaugggcgcucaguugauccgccaaauggagggugaggggguguucaagucuauucagcaccucacugccaccgaagagaucgcaguccaggacuggcuggcuagagugggacgggaaaggcuaucacgcauggccauuaguggcgaugacugcguaguuaaaccacuugaugacagauuugcuuccgcccugacggcacucaacgauaugggcaaggugcggaaggacauccagcaaugggagcccagcaggggguggaaugauuggacacaggucccuuucugcucucaucacuuucacgagcugauuaugaaagacggacgaguguugguggucccaugucguaaccaggaugaauuaauagguagagcgcgcaucucgcagggcgccggguggucacugcgggagaccgcuugccucggaaagagcuacgcccaaauguggucccuuauguauuuccauaggagagaccugcgccuagcagcuaaugccauuuguagugcaguuccgucucacugggugcccacuagccggacaaccugguccauccaugccaaacacgaauggaugacuaccgaggacaugcugacaguauggaacaggguguggauccaggaaaauccuuggauggaggauaagacgccagucgagucaugggaagagauucccuaccucggcaaacgagaagaccaguggugcgguaguuugauagggcugaccucuagagcgacuugggcuaagaacauccagacagccauuaaucaagugcggagccuuaucggaaacgaggaauauaccgauuacaugccuuccaugaagagguuucgccgugaggaggaagaggcaggcguucugugguga

SEQ ID NO: 14268 - RNA, 9876 nt, Artificial Sequence
  derived and/or modified CDS sequence (opt3) from DENV-2__LC111438__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacgcacuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacauccugcgacgcugcggaaguauugcauugaagcaaaacuuaccaacacaacuaccgccucccgcuguccaacacagggggagcccucuuugaaugaggaacaagauaagcgauuugucugcaaacacagcaugguggacagaggauggggcaacgguugugggcuguucggaaagggcggcaucgugacuugcgcuauguuuaccugcaagaaaaauauggaggggaaggucguucagccugaaaaccuagaguacacaaucgugauuaccccacauuccggagaagagaaugccguagguaacgauacuggcaaacacgggaaggagauaaaagugacgccgcagucaaguaucacagaagcagagcucaccggauauggcacugucaccauggaauguagccccaggacaggucuggacuucaaugagauggugcuucugcagauggaaaacaaggcuugguugguucaccggcaaugguuucucgaucugccuuuaccauggcugcccggggccgacacccagggcucuaacuggauucagaaagagacucucgugacauucaagaauccucaugcgaagaaacaggaugucgugguacuuggaucccaagagggcgccaugcacacggcacugaccggggcuacugaaauccagaugucaagcggaaacuugcuauuuacaggucaucugaagugccgucuccgcauggacaaacugcagcuuaagggcaugaguuacucuauguguaccgggaaauucaagguugugaaggagauagccgaaacacaacacggaacuauugucaucagagugcaguaugagggcgacgguuccccaugcaaaauccccuucgagauuauggaucuggaaaagaggcaugucuuggggcggcucaucaccgugaauccgauuguuacggagaaagacagcccugugaacauagaagcugagcccccauuuggcgauucguacaucauuaucggaguagaaccuggccagcugaaguuaucuugguucaaaaagggguccucaaucggacagauguuugagaccacaaugcgaggugccaagcgcauggcaauucugggcgacacugccugggauuucgggagucuaggaggcgucuuuaccagcauagguaaagcucuccaccaaguguucggggcgaucuacggcgcagccuuuuccggaguuucuuggacaaugaagauucugaucggcguggucauuacuuggaucgggaugaauagcagaucaaccagucuuuccgugagcuugguacuggugggaguugucacgcucuaucugggcgugauggugcaggcugacucugguugugucguuucauggaaaaacaaggagcuuaaaugcgggaguggaauauucaucacagauaaugugcacaccuggacugaacaguacaaguuucagcccgagagcccacccaagcuggccuccgcaauucaaaaagcccaugaagagggcaucugugguauuaggucugugacacgguuggaaaaccucauguggaagcagaucaccccugagcugaaucacauauuaucggagaacgaaguaaaacugacuauuaugaccggcgacaucaaggggauuaugcaggcuggaaaacgcagccuaagaccacagccgacagagcucaaguauuccuggaaagccuggggcaaggcaaagaugcugucaacggaacuucauaaucacaccuucuugaucgaugggcccgagacugcggaaugcccuaacacaaauagggcuuggaacagucuggaggucgaggacuacggauuuggcguguucaccacaaauauauggcucaaacugaaggaaaaacaagauguuuuuugugacucuaaguuaaugagcgccgcaaucaaagacaaccgugccgugcacgcugauauggguuauuggauugaguccgcccugaacgacacuuggaagaucgaaaaggcaucauucauugaggucaaaagcugccauuggccaaagucucacacccuuugguccaaugggguguuggagagugaaaugaucauacccaaaaacuucgcuggaccuguuagccagcauaauuaccggccaggcuaucacacgcagacagccggucccuggcaucucggcucucuggagauggauuuugacuucugugaagggaccacugugguagucaccgaggauugcggaaaccgaggcccgucccuaagaacaacuaccgcgucagggaagcugauuacagaauggugcuguaggaguugcacgcucccuccacugcgcuaccggggagaggacggcuguugguacgguauggagaucagaccccuuaaagaaaaggaggaaaauuuggugaacagccuggugaccgccgggcacggacagaucgauaauuuuucguuaggcguccucgguauggcucuguuccuugaggaaaugcugaggacucgcguuggcacaaagcacgcaauuuugcucguggccguauccuuugugacccugaucacugggaacaugucuuuccgagaccuaggacgggucauggugaugguuggcgcuacaaugaccgaugacauugggaugggagugacguaucuggcccuccuggcagcguuuaaaauacguccuacuuucgccgcuggccuuuugcugagaaaguuaaccagcaaagagcucaugaugacaaccaucgguauuguccugcuuucacaaaguacuauccccgagacaauucuggaacuaaccgaugcccucgcacuggggaugaugguguugaagaucguuaggaauauggagaaauaccagcuggcugugacaauaauggccaucuuaugcgucccaaacgcaguaauucuccagaaugccuggaagguguccuguacuacccuggcuguugugucugucagcccucuucuguugacguccucacaacagaaggcggacuggaucccccucgcccugacaauuaaaggacuaaacccaaccgcaaucuuucugacuacccuuagccgcacaaguaagaaacggucuuggccgcucaaugaagcuauaauggccgugggcaugguauccauucuggccagcucguugcugaagaacgauaucccuaugacuggccccuuaguggcugggggacuccugaccgucugcuauguucuuacggguagaucagcagaccuggaguuggaaagggccgcggacgugcgaugggaggagcaggcugaaaucucuggcaguuccccaauucucagcauaacaaucucugaggaugggagcauguccauuaaaaaugaagaggaggaacagacccugacuauccuaauucgcacaggacugcuugugaucucaggccucuuccccgucaguauaccuaucaccgccgcagccugguaccugugggaggugaagaaacaacgggcugguguuuugugggacguaccaagccccccuccgguggggaaggcagaauuagaggauggagccuauagaauuaagcagaaaggcauccugggcuacucucagauuggggcgggagucuauaaggaagguacuuuucauacaauguggcacgugaccaggggcgcuguucucaugcauaaagggaagcguaucgagccauccugggccgacgugaaaaaggaucugauaucauacggaggcgguuggaagcuugagggggaauggaaagagggagaagagguccaggugcuggcauuggaacccggcaagaacccucgcgccguacaaacgaaaccaggccuauucaagacuaacaccgggacaauuggagcugucagucuggacuuuagccccgguaccuccggcucuccuaucguggauaaaaaggggaagguugugggacucuacggcaauggugucgugacacggucggggacuuauguuagcgccaucgcacagaccgagaaaucaauugaggacaacccggaaaucgaggaugacauauucagaaagaaaaggcugacgauuauggaucuucaccccggagcuggcaagacaaaacgauacuuaccagccaucgugcgggaagcgauuaagcgcggccugagaacucucaucuuggccccuaccagggucguggcagcugagauggaagaggcccugcgggggcuccccauacgauaucagacaccagcuauuagagcagagcauaccggacgcgaaaucguagaccugaugugucacgccacuuucaccaugaggcuucuguccccuauccgugugcccaauuacaacuugauuaucauggaugaggcccacuuuacagacccagcuaguauugcggcacgggguuauauaucuacgagaguugaaaugggcgaggccgcugggaucuucaugacugccaccccgccuggaagcagggaccccuuuccacaguccaaugcacccauuauggaugaggaacgcgagaucccugaacgaucauggaacucuggccaugagugggucacagacuucaaggguaaaaccgugugguuugugccaagcaucaaggccgggaaugauauugcugcgugccuaagaaaaaacggaaagaaagucauacaacugagucggaagacuuucgacuccgaauacaucaagacaaggaccaaugauugggacuuuguagugacgacugauauuagcgagaugggcgccaacuucaaagcagagcgcguuaucgacccccguagauguaugaagccugugauucucacagauggcgaagagcgggucaucuuagcugggccgaugccagugacccacucuucagccgcacagaggcgcggacgaguugguagaaaucccaaaaacgaaaaugaccaguauauauacaugggcgagccucuggaaaacgaugaggacugcgcccauuggaaggaggcuaaaaugcuucuggacaauaucaacacccccgaagggauuaucccauccauguuugagccugaacgggagaagguggaugccauugacggagaauacaggcuccgcggcgaggcgagaaaaacuuucgucgauuugaugaggcggggugaccugcccguguggcucgcauaucguguagccgcugaggggaucaacuacgccgaucgccgaugguguuuugacggcgugaagaauaaccaaauacuggaagagaauguugaagucgagauuuggacaaaggagggagaaagaaaaaagcuuaaaccaagguggcuagaugcucggaucuauagugacccucuggcauugaaggaguucaaagaauucgccgcuggccgcaagagcuuagcccugaaccucauuaccgagauggggagacugccgacauuuaugacucagaaggcaaggaaugcgcuugauaaccuggccgugcuccacacggcugaagccggaggucgggcauacaaucacgcuuugucggagcugcccgagacccuagaaacacugcuccuucugacuuuauuggccaccgugacaggcgggaucuuccuguuucucaugucuggaaaaggcauagguaagaugaccauggggaugugcugcaucauuacugcauccauccugcuuugguaugcccagauucagccacauuggaucgcugcgagcauaauucuggaguucuuucucaucgucuugcugaucccugaacccgagaaacaacgaacgccacaggacaaccaguuaaccuacguugugauugccauccuaacaguaguggcagcuacuauggccaaugaaaugggcuuccuggagaagaccaaaaaggauuuuggacucggcucaauagccacacagcaaccugagaguaacauucuugacaucgaucugagacccgcaucugcuuggaccuuguaugccgucgcgacuacauucauuacgccgaugcugcgccacuccaucgaaaauagcucagugaacguuagucucaccgcuauagccaaucaggcaacugugcugauggggcuuggaaaggguuggccacucagcaaaauggacaucggcgucccucuguuggccauuggguguuacucccagguaaaccccaucacacugauggcugcauuacuacugcucguggcccauuacgcgauuaucggaccaggccuucaggcuaaggccaccagggaggcacaaaaacgggccgcugccgguauuaugaagaaucccaccguugacgggaucacagugauagaucuggacccuauuccguaugaucccaaauuugaaaagcaguugggccaggucaugcugcucgugcugugcgucacucaggugcuuaugaugcguacgaccugggcauuaugugaggcucugacacucgccacuggaccaaucucuaccuugugggaaggcaacccugggagauucuggaauacaaccaucgcgguuagcauggccaacauuuuuaggggauccuaccuggcaggcgcuggucuacuguucucaauaaugaagaacacugccaauacgcgccgggggacaggaaacaccggcgagacucucggugagaaauggaagaaucgacuuaacgcacugggcaaaucugaauuucaaaucuauaagaaaagugggauucaggagguggacagaaccuuggcuaaggaaggaaucaaaaggggcgagacagaucaccaugccguaucgcgcgggagcgccaagcugcggugguucguggagagaaaucucgucacucccgaaggaaagguuguggaccugggcugcggucgugggggaugguccuacuauuguggcgguuuaaaaaacgucaaggaggugaaaggccuuaccaaggggggaccuggccacgaagagccaauucccaugucuacauacggguggaaucugguaaggcuccagucaggaguggauguuuucuuuacgccuccagaaaaaugcgacacccuacugugugauaucggcgagagcucccccaacccgacuguggaggcgggucggacauugcgcguccugaaucucguggaaaacuggcuuaauaacaauacccaauucugcauaaagguccugaacccuuauaugccaagugugaucgagaagauggaagcuuugcagcgaaaauacgggggagcacugguuagaaauccccucucuaggaacagcacucacgagauguacuggguaucaaacgccuccggcaauauugugaguagcgucaacaugaucucucggauguuaauuaaucgcuuuacaaugagacauaagaaagcuaccuaugaaccugacguggaucugggcuccgggacgaggaacaucggaauagagucagagaccccaaaucuugacauuaucgguaagcgaaucgaaaaaauuaagcaggagcacgaaacaagcuggcauuacgaucaggaccaccccuauaagacuugggccuaccacggcucguaugagaccaaacaaacagggucugcaaguuccaugguuaacggagugguccggcugcuaacuaagccgugggacgugauaccuaugguaacccagauggccaugacagauaccacucccuucggccagcagcguguguuuaaagaaaagguugacacgagaacacaagagccaaaagaggguaccaagaagcucaugaaaaucacugcuaaguggcuguggaaagaauuggggaagaaaaagaccccucgcauguguacaagggaggaauucacgcggaaagucagaagcaaugcggcccugggagcaauuuuuaccgaugagaacaaguggaagucagcucgcgaggccguggaagacuccggcuucugggagcucguggauaaagaaaggaaucuucaucuggagggcaagugcgaaacuugugucuacaacaugauggggaaacgagagaagaaauuaggagaguuugguaaggcaaagggcucucgggccaucugguauauguggcugggggcuagauucuuggaauuugaggcccucggauuccugaaugaagaccacugguuuagcagggagaacagucuauccggcguugaaggugaggggcuucauaaacugggauacauucuccgcgaugugagcaagaaagagggcggcgcgauguacgcagacgauacagccgggugggacacccguaucacucuggaagauuugaagaaugaggaaauaguaacaaacuauauggagggagaacacaaaaagcuggcugaggccaucuucaagcucaccuaccagaauaaagugguccgggugcagagacccacaccaagggguacuguuauggacauuaucucucgccgagaccagcggggcucagggcaaguggucaccuauggacuuaacacguucaccaacauggaggcacagcugauuagacagauggaaggcgaggguguguuuaagaguauccaacauuuaacaguaacugaagagauugcuguugagaauuggcuggugagggucgggcgcgaaagauugucccggauggccauaagcggagaugacugcguggugaaaccccucgaugacagguucgcuucugcccugaccgcacuaaacgauaugggcaagguccguaaagacauccagcagugggagccuucgcgaggcuggaaugauuggacacagguuccauuuugcucacaccacuuccaugaacuuauuaugaaggacgggcgcgugcugguagugccguguagaaaccaagaugagcucaucggacgggcgaggaucagccagggugccggcuggucccugcgcgaaacugcuugcuuggggaagaguuacgcccagauguggucuuuaauguauuuucacagacgggaccugaggcucgcagcuaaugccauuuguagcgcaguccccucccauugggugccuaccucacgaacgacauggaguauacacgccacccacgaguggaugacuacagaggauaugcuuaccguuuggaaccguguguggauccaggaaaauccauggauggaggacaaaacucccgucgaaucuugggaggaaauuccuuaccugggaaagagagaggaucaauggugcggcagccuaaucggucugaccucccgcgcgacaugggcuaaaaacauucagacggccaucaaucaggugcggucacucauagggaacgaggaauauaccgacuacaugccaagcaugaagagguucagacgcgaggaagaggaagcaggaguauugugguga

SEQ ID NO: 14269 - RNA, 9876 nt, Artificial Sequence
  derived and/or modified CDS sequence (opt3) from DENV-2__KF744400__SS-prME
accgcaggcaugaucauuaugcugauacccacugugauggcuuuccaccucacuacgagaaauggggaaccucauaugaucgucagcaggcaggaaaagggaaagucccuucuguuuaagaccgaaaaugguguuaauaugugcacauugauggcaauggacuuaggcgaacugugugaggauacuauuaccuacaaaugcccacuacuccggcaaaaugaaccggaggacaucgauuguuggugcaacucuacaucaaccugggugacuuaugggacauguaccacgacuggagagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacucacuuucagcgcgcucugauuuucauccugcucacagcaguggccccaucuaugaccaugagaugcauuggcaucucgaauagggacuuuguugaaggggugucaggagguagcugggucgauauaguguuagagcacggcaguuguguaacuacaauggcuaagaacaagcccacccuggacuucgaacuuauuaaaacggaggccaaggaaccugcgaccuugcggaaauauugcaucgaggcaaagcugacaaauacuaccacagagucccgcuguccaacucagggggaacccucucuaaacgaggaacaagauaaacgauuuguuugcaagcauagcaugguggacagaggauggggcaaugguuguggacucuucggaaagggcggcauuguaaccugcgccauguuuacaugcaaaaagaacauggaggggaaaaucgugcagccugaaaaucuggaguacaccaucgugauuacuccacacuccggagaggaacaugcugucgguaacgauacgggcaagcacgggaaagagauaaagaucacaccgcagucaaguaccacugaagccgagcuuaccggauauggcacaguuaccauggaauguagccccaggacuggucuggacuucaaugagaugguguugcuccagauggagaacaaagcauggcugguacaccggcaaugguuuuuagaucugccucucccauggcuucccggggcugacacacagggcucuaauuggauucagaaggaaacgcuggugaccuucaagaacccucaugccaaaaagcaggaugucgugguuuugggaucccaagagggcgcgaugcacacugcccuaacaggggcaaccgacauccagaugucaagcggaaaccugcucuuuacaggucaucugaaaugccgucuucgcauggacaagcugcaguugaaaggcaugaguuacucuauguguacugggaaguucaagguggucaaagaaauagcugagacccaacacggaacgauugugguaagaguucaguaugagggcgaugguuccccaugcaagauccccuucgaaaucauggaccucgagaaaaggcaugugcuggggcgguuaauuaccgucaauccgaucgugacagaaaaggauagcccugucaacauugaggccgaacccccauuuggcgacucguacgugauaaucggaguugagccuggccagcugaaacuaaauugguucaagaaggggucuuccauuggacagauguuugagacuaccaugcgaggugcuaaacgcauggccauccucggcgauacagcaugggacuucgggucacugggaggcguguuuacaagcaucgguaaggcccuucaccaaguauucggggcuauuuacggcgcggcauuuagcggagucuccuggaccaugaaaauauugaucggcgugauuaucacguggauugggaugaacucuagaagcacaucacugaguguuucccucgugcuggucggagugguaacccuuuaucugggcgugguuguccaggccgauagcgguuguguggugucuuggaagaauaaagaauugaagugcgggucaggaaucuucauaacugacaacguccacacauggaccgagcaguacaaguuucagcccgaaaguccaagcaaacucgcuuccgccauccaaaaggcacaucaggagggcauuugugguaucaggucuguuacucggcuggaaaauuuaauguggaaacagauuacccccgagcugaaccacauccuaucggagaaugaagugaagcucacaauaaugacgggcgauauuaaagggaucaugcaugccggaaagcgcagccugagaccucagccaaccgagcuuagguauuccuggaaaacuuggggcaaggcuaagauuuugucaacagaaagucacaaccaaaccuuccugaucgacgggccggagacagccgaaugccccaauacuaaccgugcauggaacucucucgagguggaggauuacggauuuggcguauucaccacgaacauauggcugaaauuacgggaaaagcaggacgcguuuugugacccuaaacugaugagcgcugccaucaaggauaaucgagcaguccacgccgacauggguuauuggauugaguccgcucuuaacgauacauggaaaaucgaaaaggccucauucauugaggugaagaacugccauuggccaaaaagccacaccuuguggucuaaugggguucucgaguccgaaaugaucauacccaagaacuucgcaggaccugugagucagcauaauuacagaccaggcuaucacacucagaccgcuggucccuggcaucugggcaaacuagagcuggacuuugauuucugugaagggacaacugucgugguuaccgaggacugcggaaacaggggcccgagccuccgcacaacgaccgccucugggaagcugauuacugaauggugcugucgguccugcacacuuccuccauugagauacaaaggagaggauggcuguugguacgguauggagaucaggccccugaaggaaaaggaggaaaauuuagugucaagucucguaaccgcggggcacggacaaaucgacaacuuuagccugggcguccuugguauggcccuguucuuggaggaaaugcuccgcacucgagugggcaugaaacacgcuauucugcuaguggcagucucguuuguuacacugaucaccgggaauauguccuuccgggaucucggacgugugaugguaauggugggcgccacgaugacugacgauauugggaugggagucaccuaucuggcucuuuuggccgcauuuaaggugagaccuacauucgcggccggccuguuacucaggaaacugaccucuaaggagcuuaugaugacuacaauagguaucguucugcuaagccagucaaccauucccgagacaauccucgaacugacugacgcuuuggcccuggggaugaugguguuaaaaauuguccgcaagauggagcgguaccagcucgcagugaccaucauggcuauacugugcguuccaaacagugugauccuucaaaaugccuggaaggucuccuguacgauucuggcaguagugucuguuagcccuuugcuccugacauccucacagcagaaagccgauuggaucccccuagcucugaccauuaagggacuuaacccaacugcgaucuuucucaccacacugagcagaacaaguaaaaagaggucuuggccguugaaugaagccauaauggcagugggcauggucuccauucuggcuagcucguuacucaaaaacgacaucccuaugaccggcccccugguggccgggggacuucugacgguaugcuauguguugacaggucgaucagccgaccucgagcuggaaaaggcugcagauguccgcugggaggaccaggccgagaucucuggcaguuccccaauucuaagcguuauagugucugaagaugggagcauguccaucaaaaaugaggaagaggagcaaauucugaccauccuuauucggacuggacuccuggugaucucaggcuuguuccccgucaguauaccuaucacagcggcugccugguacuuaugggaagugaagaagcagagagccgguguucugugggacguaccaagucccccuccgguggggaaagccgagcucgaagauggagcuuauaggauuaagcagaaaggcauccugggcuacucucagauuggggcaggagucuauaaggaggguaccuuucauacuauguggcacgugacacguggcgccguucuuaugcauaaagggaagcgcaucgaaccauccugggcggacgugaagaaagaucugauaucauacggaggcgguuggaaguuggagggggaguggaaagaaggagaggaaguccaagugcuagcucuggagcccggcaagaacccucgggccguacagaccaaaccaggccucuucaagacgaaugcagggacuauuggagccgucagucuggacuuuagccccgguaccuccggcucuccuaucaucgauaagaaagggaaggugguuggacuuuacggcaacgguguggucacaagaaacgggucguaugugagcgcuauugcccagaccgaaaaaucaaucgaggacaauccggagauagaagaugacauuuucaggaagaaacgauuaacaaucauggaucugcaccccggagcaggcaagacuaagcgguaccucccagcuauuguucgcgaggccaucaaaagaggcuugaggacccugauacucgcgccuacgcggguggucgccgcagaaauggaggaagcucugcgagggcuucccauuagauaucagacaccagccauccgcgcugagcauacuggaagggagaucguggaccugaugugucacgcaaccuucacaaugcguuugcuauccccuauucggguacccaacuacaaucugaucauuauggacgaagcccacuuuaccgauccagccaguauagcugcgagagguuauaucucuacuaggguggagaugggcgaagcagccgggauuuucaugaccgcuacaccgccuggaagccgcgaccccuuuccacaauccaacgcccccaucauggaugaggagcgagaaaucccugagagaucauggaacucuggccaugaauggguuacggacuucaaggguaaaacugucugguuugugccaagcauuaaggcagggaacgauauagccgcuugccuccggaaaaauggaaagaaggugauccaguuaaguaggaaaaccuucgacuccgaguacgucaagacacgcaccaacgauugggacuuuguagugacuacagauauuagcgaaaugggcgcgaauuucaaagccgagcguguuaucgaccccagacgguguaugaagccugugauucugaccgauggcgaggaaagggucauccuugcagggccgaugccagugacgcacucuucagcugcccagcgccgaggaagaauaggucggaaccccaaaaaugagaacgaccaauauaucuacaugggcgaaccucuggagaaugacgaagauugcgcacauuggaaggaggccaaaaugcucuuggacaacauuaauacucccgaggggaucauuccauccauguuugaaccugagagggaaaagguugaugcuaucgacggagaguaccgccugagaggcgaagccaggaagacauucguggaucucaugcggcguggugaccugcccgucuggcuugcguauaaaguggcagccgaggggauaaacuacgcugaucgccgaugguguuuugacggcauuagaaacaaucagauccuagaggaaaacguagagguggaaauuuggaccaaggagggagagaggaaaaagcugaaaccacggugguuggaugcccgcaucuauagugacccuuuagcucugaaggaguucaaggaguucgcagccggcagaaaaagccucacccugaaucuuauaacugaaauggggaggcugccgacauuuaugacccagaaggcucgggaugcccucgacaacuuggcaguucugcacacagcggaggccggaggucgagcuuacaaucacgcccuaucggaacugcccgagacucucgagacgcuucuguuauugacccugcucgcaacagucacuggcgggaucuuccuguuucuuaugucuggaagaggcauugguaaaaugacccuggggaugugcugcaucauuacagcuuccauccucuugugguaugcccagauacaaccacauuggauugcagccagcaucauccuggaguucuuuuuaauugugcuacugaucccugagcccgaaaagcagcgcaccccacaggauaaccagcucacuuacguggucauagcuauucuuacgguuguggcggccaccauggcaaaugagaugggcuuccuggaaaagacuaagaaggacuugggacugggcucaaucgcuacucaacagccugagaguaacauucucgacaucgaucugaggcccgccucugccuggacccuuuaugcaguagcuacaaccuuuauaacuccgaugcuccggcacuccaucgagaauagcucagugaacgucagucugacagccauugcgaaucaggcuacgguguugauggggcugggaaaagguuggccauuaagcaagauggacaucggcguuccucuacuggccauuggguguuacucccaggugaaccccaucacccucacugcagcccuucuguugcuggucgcucauuacgcaauuaucggaccaggccuccaagccaaagcgacacgugaagcucagaagagagccgcagccgguauaaugaaaaaucccaccguagaugggauuaccgcuaucgaccuggauccuaucccguaugaccccaaguucgagaagcagcuuggccaggugauguuacugguucucugcgugacacaagucuugaugaugaggacuacgugggcccugugugaagcacuaacccuggcuacaggaccaauuucuacucucugggagggcaacccugggcgcuuuuggaauaccacaauagccgugagcauggcgaacaucuuccggggauccuaccuugccggcgcaggucuguuguuuucaauuaugaaaaauaccacuaacacgcgaagagggacaggaaacaucggcgaaacccugggugagaaguggaaaucuaggcucaaugcucugggcaagagugaguuccagauuuauaaaaagucggggauccaggaagucgaucgcacuuuagccaaagagggaauaaagcggggcgaaaccgaccaccaugcagugagcagaggguccgcuaaacuucguugguuuguugagaggaacauggugacacccgagggaaaaguaguggaucugggcugcggucgcgggggauggucuuacuauuguggcggucucaagaauguccgggaaguuaaaggccuaacuaaaggcgggccugggcacgaggaaccaauccccaugucaaccuacggguggaaccuggugcgauugcaaagcggagucgacguguucuucacaccuccagagaaaugcgauacgcugcucugugacauuggcgaauccagucccaauccgaccguagaggccgguagaacucuuagggugcugaacuugguugagaauuggcugaacaauaacacacaguuuugcaucaaggugcucaauccuuauaugccaucugucauugaaaagauggaggccuuacagcggaaauacgggggagcgcuggugcgcaacccccuuagcagaaauucaacccacgaaauguacugggucuccaacgcuaguggcaauaucgugagcucuguuaacaugauauccaggaugcugauuaaccgauucacuaugaagcauaaaaaggcaacauaugagccugauguagaccuaggcucagggaccuguaauaucggaaucgaaagcgaggugccaaaccucgacauuauagguaaacggaucgagaagauuaagcaggaacacgagacgucguggcauuacgaucaagaccaccccuauaaaaccugggccuaccacggcucuuaugaagcuaagcagacagggagugccuccagcauggucaauggagugguucgucuguugacuaaaccgugggaugugaucccuauggucacccagauggcaaugacagacacuacccccuuuggccagcaaagaguguucaaggagaaaguagauacacgcacccaggaaccaaaggaggguacuaagaaacugaugaagauuacggccgaguggcucuggaaagaacuugggaagaaaaagacaccuaggaugugcacccgggaggaauuuacuagaaaagugcgcucaaacgcugcgcugggagccaucuucaccgacgagaauaaguggaaguccgcaagggaggcuguugaagauucucgauuuugggaguuagucgacaaagaacggaaccugcauuuggagggcaagugugaaacaugcguguacaauaugaugggcaaaagagagaagaaacucggggaguucggaaaggccaaggguagcagggcaauaugguauauguggcugggcgcccgcuuucuagaguucgaggcucuuggguuucugaacgaagaucacugguucagucgugaaaauucccucagcggaguggaaggcgagggucuguacaaauugggguacauccugcgggacgucucuaagaaagagggaggcgccauguaugcggaugacacggcaggcugggacaccagaauuacucucgaagaucuuaagaacgaggaaaugguuacaaaucauauggagggggaacacaaaaagcuggccgaggcuaucuuuaaguuaaccuaccagaacaaagugguaagggugcagcgccccacuccacgaggaacagucauggacauuaucucacggagagaucaaagggguaguggccagguggggaccuauggacugaauacauucacuaacauggaggcccaguugauucgccaaauggaaggcgaggguauauucaaguccauccagcaucucaccgcaacggaagagauugcuguucagaauuggcugaccagaguggggcgggagaggcuaagccguauggccaucucuggagacgauugcgucgugaaaccccuugacgaucgauuugcuucggcccugacagcacucaacgacaugggcaagguacgcaaagauauccagcaaugggaaccuucaagaggcuggaacgacuggacucagguuccauucuguagccaccacuuucaugagcugauuaugaaggaugggcggguguuggucgugccgugcaggaaucaggacgaauuaauaggacgcgcgagaaucucccagggugccggcuggagucugcgggagaccgcuugucucgggaagucuuacgcccaaauguggagccuuauguauuuccacaggcgagaucugcgucuagcagcuaacgccauuugcuccgcagugcccucacauugggucccuacaaguagaacuaccuggucuauccacgccaaacacgaauggaugacgacagaggacaugcugaccguuuggaaucgcguguggauucaggagaacccauggauggaagacaagacucccguagagagcugggaagagaucccuuaccucggaaaacgggaagaucagugguguggcuccuugauaggucugacaucaagggcgaccugggcuaagaauauccagacugccauuaaccaagugagaagccuuaucgggaaugaggaguauaccgacuacaugccaucuaugaaacgcuuucggagggaagaggaagaggcaggaguccugugguga

SEQ ID NO: 14270 - RNA, 9876 nt, Artificial Sequence
  derived and/or modified CDS sequence (opt3) from DENV-2__KF744401__SS-prME
accgcaggaaugaucauuaugcugauacccacugugauggcuuuccaccucacuacgagaaauggggaaccucauaugaucgucagcaggcaggaaaagggaaagucccuucuguuuaagaccgaaaaugguguuaauaugugcacuuugauggcaauggacuuaggcgaacugugugaagauacuauuaccuacaaaugcccacuacuccggcaaaaugaaccggaggacaucgauuguuggugcaacucuacuucaaccugggugacuuaugggacauguaccacgacuggagagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacucacuuucagcgcgcucugauuuucauccugcucacagcaguggccccaucuaugaccaugagaugcauuggcaucucgaauagggacuuuguugaaggggugucaggagguagcugggucgauauaguguuagagcacggcaguuguguaacuacaauggcuaagaacaagcccacccuggacuucgaacuuauuaaaacggaggccaaggaaccugcgaccuugcggaaauauugcaucgaggcaaagcugacaaauacuaccacagagucccgcuguccaacucagggggaacccucucuaaacgaggaacaagauaaacgauuuguuugcaagcauagcaugguggacagaggauggggcaaugguuguggacucuucggaaagggcggcauuguaaccugcgccauguuuacaugcaaaaagaacauggaggggaaaaucgugcagccugaaaaucuggaguacaccaucgugauuacuccacacuccggagaggaacaugcugucgguaacgauacgggcaagcacgggaaagagauaaagaucacaccgcagucaaguaccacugaagccgagcuuaccggauauggcacaguuaccauggaauguagccccaggacuggucuggacuucaaugagaugguguugcuccagauggagaacaaagcauggcugguacaccggcaaugguuuuuagaucugccucucccauggcuucccggggcugacacacagggcucuaauuggauucagaaggaaacgcuggugaccuucaagaacccucaugccaaaaagcaggaugucgugguuuugggaucccaagagggcgcgaugcacacugcccuaacaggggcaaccgaaauccagaugucaagcggaaaccugcucuuuacaggucaucugaaaugccgucuucgcauggacaagcugcaguugaaaggcaugaguuacucuauguguacugggaaguucaagguggucaaagagauagcugagacccaacacggaacgauugugguaagaguucaguaugaaggcgacgguuccccaugcaagauccccuucgagaucauggaucucgagaagaggcaugugcuggggcgguuaauuaccgucaauccgaucgugacagagaaggacagcccugucaacauugaagccgagcccccauuuggcgauucguacgugauaaucggaguugagccuggccagcugaaacuaaauugguucaagaaggggucuuccauuggacagauguuugaaacuaccaugcgaggugcuaaacgcauggccauccucggcgacacagcaugggauuucgggucacugggaggcguguuuacaagcaucgguaaggcccuucaccaaguauucggggcuauuuacggcgcggcauuuagcggagucuccuggaccaugaaaauauugaucggcgugauuaucacguggauugggaugaacucuagaagcacaucacugaguguuucccucgugcuggucggagugguaacccuuuaucugggcgugguuguccaggccgacagcgguuguguggugucuuggaagaauaaagaguugaagugcgggucaggaaucuucauaacugauaacguccacacauggaccgaacaguacaaguuucagcccgagaguccaagcaaacucgcuuccgccauccaaaaggcacaucaggaaggcauuugugguaucaggucuguuacucggcuggagaauuuaauguggaaacagauuacccccgagcugaaccacauccuaucggaaaaugaggugaagcucacaauaaugacgggcgacauuaaagggaucaugcaugccggaaagcgcagccugagaccucagccaaccgaacuuagguauuccuggaaaacuuggggcaaggcuaagauuuugucaacagagagucacaaccaaaccuuccugaucgaugggccggaaacagccgagugccccaauacuaaccgugcauggaacucucucgagguggaagacuacggauuuggcguauucaccacgaacauauggcugaaauuacgggagaagcaggaugcguuuugugacccuaaacugaugagcgcugccaucaaggacaaucgagcaguccacgccgauauggguuauuggauugaauccgcucuuaacgacacauggaaaaucgagaaggccucauucauugaggugaagaacugccauuggccaaaaagccacaccuuguggucuaaugggguucucgaauccgagaugaucauacccaagaacuucgcaggaccugugagucagcauaauuacagaccaggcuaucacacucagaccgcuggucccuggcaucugggcaaacuagaacuggauuuugacuucugugaggggacaacugucgugguuaccgaagauugcggaaacaggggcccgagccuccgcacaacgaccgccucugggaagcugauuacugaguggugcugucgguccugcacacuuccuccauugagauacaaaggagaggacggcuguugguacgguauggaaaucaggccccugaaggagaaggaagagaauuuagugucaagucucguaaccgcggggcacggacaaaucgauaacuuuagccugggcguccuugguauggcccuguucuuggaagagaugcuccgcacucgagugggcaugaaacacgcuauucugcuaguggcagucucguuuguuacacugaucaccgggaauauguccuuccgggaccucggacgugugaugguaauggugggcgccacgaugacugaugacauugggaugggagucaccuaucuggcucuuuuggccgcauuuaaggugagaccuacauucgcggccggccuguuacucaggaaacugaccucuaaggagcuuaugaugacuacaauagguaucguucugcuaagccagucaaccauucccgaaacaauccucgagcugacugaugcuuuggcccuggggaugaugguguuaaaaauuguccgcaagauggaacgguaccagcucgcagugaccaucauggcuauacugugcguuccaaacagugugauccuucaaaaugccuggaaggucuccuguacgauucuggcaguagugucuguuagcccuuugcuccugacauccucacagcagaaagccgacuggaucccccuagcucugaccauuaagggacuuaacccaacugcgaucuuucucaccacacugagcagaacaaguaaaaagaggucuuggccguugaaugaggccauaauggcagugggcauggucuccauucuggcuagcucguuacucaaaaacgauaucccuaugaccggcccccugguggccgggggacuucugacgguaugcuauguguugacaggucgaucagccgaccucgaacuggagaaggcugcagacguccgcugggaggaucaggccgaaaucucuggcaguuccccaauucuaagcguuauagugucugaggacgggagcauguccaucaaaaaugaagaggaggaacaaacccugacuauucuuauccggacaggacuccuggugauuucaggcuuguuccccgucaguaucccuauaaccgcggcugccugguacuuaugggaggugaagaagcagagagccgguguucugugggauguaccaagucccccuccgguggggaaagccgaacucgaggacggagcuuauaggaucaagcagaaaggcauucugggcuacucucagaucggggcaggagucuauaaggaagguacuuuucauacaauguggcacgugacccguggcgccguucuuaugcauaaagggaagcgcauugagccauccugggcggaugugaagaaagaccugaucucauacggaggcgguuggaaguuggagggggaauggaaagagggagaagagguccaagugcuagcucuggaacccggcaagaacccucgggccguacagacgaaaccaggccucuucaagacuaaugcagggaccauaggagccgucagucuggauuuuagccccgguacauccggcucuccuauuaucgacaagaaagggaaggugguuggacuuuacggcaacgguguggucaccagaaacgggucguaugugagcgcuaucgcccagacagagaaaucaauugaggauaauccggaaaucgaggacgauauauucaggaagaaacgauuaacuauuauggaccugcaccccggagcaggcaagaccaagcgguaccucccagcuaucguucgcgaagccauuaaaagaggcuugaggacgcugauccucgcgccuacacggguggucgccgcagagauggaagaggcucugcgagggcuucccauaagauaucagacuccagccauucgcgcugagcauaccggaagggaaaucguggaucugaugugucacgcaacauucaccaugcguuugcuauccccuauccggguacccaacuacaaucugauuaucauggacgaggcccacuuuacugacccagccaguauugcugcgagagguuauauaucuaccaggguggaaaugggcgaggcagccgggaucuucaugacagcuacgccgccuggaagccgcgaucccuuuccacaauccaacgcccccauuauggacgaggaacgagagaucccugaaagaucauggaacucuggccaugaguggguuacugauuucaaggguaaaaccgucugguuugugccaagcaucaaggcagggaacgacauugccgcuugccuccggaaaaauggaaagaaggugauacaguuaaguaggaaaacauucgauuccgaauacgucaagacccgcacuaacgacugggauuuuguagugacaaccgacaucagcgagaugggcgcgaauuucaaagccgagcguguuauugaucccagacgguguaugaagccugugauccugacggacggcgaagagagggucauucuugcagggccgaugccagugacucacucuucagcugcccagcgccgaggaagaaucggucggaaccccaaaaaugaaaacgaucaauauauauacaugggcgagccucuggaaaaugacgaggacugcgcacauuggaaggaggccaaaaugcucuuggauaacaucaauacacccgaagggauuaucccauccauguuugagccugaaagggagaagguugacgcuauugauggagaauaccgccugagaggcgaggccaggaagaccuucguggaccucaugcggcguggugaucugcccgucuggcuugcguauaaaguggcagccgaggggaucaacuacgcugaccgccgaugguguuuugauggcauaagaaacaaucagauucuagaagagaacguagaaguggagaucuggaccaaggagggagaaaggaaaaagcugaaaccacggugguuggacgcccgcauuuauagugauccuuuagcucugaaggaguucaaggaguucgcagccggcagaaaaagccucacucugaaucuuaucacagagauggggaggcugccgaccuuuaugacacagaaggcucgggacgcccucgauaacuuggcaguucugcacacugcggaagccggaggucgagcuuacaaucacgcccuaucggagcugcccgagacgcucgaaacccuucuguuauugacacugcucgcaacugucaccggcgggauauuccuguuucuuaugucuggaagaggcaucgguaaaaugacacuggggaugugcugcauuaucaccgcuuccauucucuugugguaugcccagauccaaccacauuggauagcagccagcauuauccuggaguucuuuuuaaucgugcuacugauuccugaacccgagaagcagcgcacuccacaggacaaccagcucacguacguggucaucgcuauacuuaccguuguggcggccacaauggcaaaugaaaugggcuuccuggagaaaacuaagaaggauuugggacugggcucaauugcuacccaacagccugagaguaacauccucgacauugaccugaggcccgccucugccuggacacuuuaugcaguagcuaccacuuuuaucacaccgaugcuccggcacuccauagaaaauagcucagugaacgucagucugacggccaucgcgaaucaggcuaccguguugauggggcugggaaaagguuggccauuaagcaagauggauauuggcguuccucuacuggccaucggguguuacucccaggugaaccccauuacucucacagcagcccuucuguugcuggucgcucauuacgcaaucauuggaccaggccuccaagccaaagcgacccgugaggcucagaagagagccgcagccgguaucaugaaaaaucccaccguagacgggauaacagcuauugaucuggacccuaucccguaugaucccaaguucgaaaagcagcuuggccaggugauguuacugguucucugcgugacucaagucuuggugaugaggacgaccugggcccugugugaggcacuaacacuggcuacuggaccaaucucuacccucugggaaggcaacccugggcgcuuuuggaauacaaccauugccgucagcauggcgaacauauuccggggauccuaccuugccggcgcaggucuguuguuuucaaucaugaaaaauacuacgaacacacgaagagggaccggaaacauuggcgagacucugggugagaaguggaaaucuaggcucaaugcucugggcaagagugaguuccagaucuauaaaaagucggggauucaggagguggaccgcaccuuagccaaagaaggaaucaagcggggcgagacagaucaccaugcaguuagcagaggguccgcuaaacuucguugguuuguggagaggaacaugguaacucccgaaggaaaaguggucgaccugggcugcggucgcgggggauggucuuacuauuguggcggucucaagaauguucgggaggugaaaggccuaaccaaaggcgggccugggcacgaagaaccaauacccaugucaacauacggguggaaccugguccgauugcaaagcggaguggauguauucuucacgccuccagaaaaaugcgacacccugcucugugauaucggcgaguccagucccaauccgacuguggaggccgguagaacacuuaggguucugaacuugguggaaaauuggcugaacaauaacacccaguuuugcauuaagguccucaauccuuauaugccaucugugaucgagaagauggaagccuuacagcggaaauacgggggagcgcugguccgcaacccccuuagcagaaauucaacucacgagauguacuggguguccaacgcuaguggcaauauuguuagcucuguaaacaugaucuccaggaugcugauaaaccgauucacaaugaagcauaaaaaggcaaccuaugaaccugacguggaucuaggcucagggacgcggaauauuggaaucgagagcgaggucccaaaccucgacaucauugguaaacguauagaaaagaucaagcaggagcacgaaaccucguggcauuacgaccaagaucaccccuauaaaacaugggccuaccacggcucuuaugaggcuaagcagacugggagugccuccagcauggugaauggaguugugagacuguugaccaaaccgugggacgucauuccuauggugacacagauggcaaugacugauaccacacccuuuggccagcaacgcguauucaaggaaaaaguggacaccaggacucaggagccaaaggaggguacgaagaaacugaugaagaucacagccgaauggcucuggaaagagcuugggaagaaaaagaccccucggauguguacuagagaagaguuuacccgcaaaguuaggucaaacgcugcgcugggagccauuuucacagaugagaauaaguggaaguccgcacgagaagcugucgaggacucucgguuuugggaauuaguggauaaagagagaaaccugcauuuggaaggcaagugcgagacguguguguacaauaugaugggcaaaagggagaagaaacucggggaguucggaaaggccaaggguagccgcgcaaucugguauauguggcugggcgcccguuuucuagaguucgaagcucuuggguuucugaacgaggaccacugguucagucgggaaaauucccucagcggagucgagggcgagggucuguacaaauugggguacauacugagagauguuucuaagaaagaaggaggcgccauguaugcggacgauaccgcaggcugggacacuaggaucacacucgaggaccuuaagaacgaagagauggugaccaaucauauggaaggggagcacaaaaagcuggccgaggcuauuuuuaaguuaacuuaccagaacaaaguagugcgcguccagcgacccacaccacggggaaccgugauggauaucauuucaagaagggaccaacgcgguaguggccagguugggacauauggacugaauacuuucaccaacauggaagcccaguugaucagacaaauggagggcgaagguauuuucaaguccauacagcaucucacggcaaccgaggagaucgcugugcagaauuggcugacacgggucgggagggaacgucuaagccgaauggccauuucuggagaugacugcgugguaaaaccccuugaugaccgcuuugcuucggcccugacugcacucaacgauaugggcaagguuagaaaagacauccagcaaugggagccuucacggggcuggaacgauuggacccaggugccauucugcagccaccacuuucaugaacugaucaugaaggacgggagggucuugguggugccgugucgcaaucaggaugaguuaauuggcagagcgcggauaucccagggugccggcuggagucugagggaaacagcuugccucgggaagucuuacgcccaaauguggagccuuauguauuuccaccgacgugaccugagacuagcagcuaacgccaucuguuccgcaguccccucacauuggguuccuacaagucgcaccacguggucuauucacgccaaacacgaguggaugacaaccgaggauaugcugacuguguggaaucggguauggauccaggaaaacccauggauggaggacaagacacccguggaaagcugggaggaaauuccuuaccucggaaaaagggaggaccaguggugcggcuccuugaucggucugaccucaagagcgacuugggcuaagaauauacagaccgccaucaaccaaguccgcagccuuauugggaaugaggaauauacagauuacaugccaucuaugaaacgguuuaggcgagaggaagaggaagcaggagugcugugguga

SEQ ID NO: 14271 - RNA, 9876 nt, Artificial Sequence
  derived and/or modified CDS sequence (opt3) from DENV-2__KF744402__SS-prME
accgccggcaugaucauuaugcugauacccaccgugauggcuuuccaccucacuacgcgaaauggggaaccucauaugaucgucagcaggcaggaaaaggggaaaucccuucuguuuaagaccgaagacgguguuaauaugugcacauugauggcaauggauuuaggcgaacugugugaggacacuauuaccuacaaaugcccacuacuccggcaaaaugaaccggaggauaucgacuguuggugcaauucuacaucaaccugggugacuuaugggacauguaccacgacuggagagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcacccugcgaccuugcggaaauauugcaucgaagcaaagcugacaaauacuaccacagagucccgcuguccaacucagggggagcccucucuaaacgaagaacaagacaaacgauuuguuugcaagcauagcaugguggauagaggauggggcaaugguuguggacucuucggaaagggcggcauuguaaccugcgccauguuuacaugcaaaaagaacauggaagggaaaaucgugcagccugagaaucuggaauacaccaucgugauuacuccacacuccggagaggagcaugcugucgguaacgacacgggcaagcacgggaaagaaauaaagguuacaccgcagucaaguaucaccgaggccgaacuuacuggauauggcaccgugacaauggaguguagccccaggaccggucuggauuucaaugaaaugguauugcuccagauggagaacaaagcauggcuggugcaccggcaaugguuuuuagaccugccucucccauggcuucccggggcugauacucagggcucuaauuggauucagaaggagacacuggucacguucaagaacccucaugccaaaaagcaggacgugguuguguugggaucccaagaaggcgcgaugcacaccgcccuaacuggggcaacagagauccagaugucaagcggaaaccugcucuuuaccggucaucugaaaugccgucuucgcauggacaagcugcaguugaaaggcaugaguuacucuauguguacagggaaguucaaggucgugaaagaaauagcugagacucaacacggaaccauuguaguuagagugcaguaugagggcgaugguuccccaugcaagauccccuucgaaaucauggaccucgagaaaaggcauguccuggggcgguuaauuacggugaauccgaucgucaccgaaaaggauagcccugugaacauugaggccgaacccccauuuggcgacucguacguuauaaucggaguggagccuggccagcugaaacuaaauugguucaagaaggggucuuccauuggacagauguuugagacaacuaugcgaggugcuaaacgcauggccauccucggcgauaccgcaugggacuucgggucacugggaggcguauuuacaaguaucgguaaggcccuucaccaagucuucggggcuauuuacggcgcggcauuuagcggaguguccuggacuaugaaaauauugaucggcguuauuaucaccuggauugggaugaacucuagaagcacgucacugagugugucccucauccuggucggagugguaacacuuuaucugggcgugguuguccaggccgauagcgguuguguggugucuuggaggaauaaggaauugaaaugcgggucaggaauauucaucaccgacaacguccacacuuggacagagcaguacaaguuucagcccgaaaguccaagcaagcucgcuuccgccauucaaaaagcacaucaggagggcaucugugguauucggucuguuacccgccuggaaaauuuaauguggaagcagaucacucccgagcugaaccacauacuaucggagaaugaagugaaacucaccauuaugacaggcgauaucaaggggauuaugcaugccggaaaaagaagccugaggccucagccaacggagcuucguuauuccuggaagaccuggggccgggcuaaaaucuugucaacugaaagucacaaccaaacauuccugauagacgggccggagaccgccgaaugccccaauacaaaccgagcauggaacucucucgagguggaggauuacggauuuggcguauucacuaccaacaucuggcugaaguuaaaggaaagacaggacgucuuuugugacagcaaacugauguccgcggcuauuaaggauaauagggccgugcacgcagacauggguuauuggaucgagucagcccuuaacgauacguggaaaauugaaaaggcuagcuucaucgagguuaaaucuugccauuggccuaagucccacacauuguggaguaacggggugcucgagagcgaaaugauaauuccaaagaauuucgccggacccgucucucagcauaacuaccgcccuggcuaucacacccagacugcagguccauggcaucugggcaaacuagagauggacuuugauuucugugaagggaccacagugguugugacugaggacugcggaaaucggggccccucccugagaaccacaacggcuucagggaagcucaucaccgaauggugcuguaggaguugcacucugccgccucuucgcuaccgaggagaggauggcuguugguacgguauggagauccggccauugaaagaaaaggaggaaaaccugguaaauagcuuagucacagccgggcacggacaaauugacaacuuuucgcucggcgugcuggguauggcgcuuuuccuggaggaaauguugcguaccagagugggcacuaaacacacaauccuccuggucgccguuuccuuugugacccuaauuacggggaauaugucuuucagggaucugggacgcguaauggugauggucggcgcuacuaugaccgacaacauagggaugggagugacauaucucgcacugcuugccgcuuuuaagguucggcccaccuucgccgcaggcuugcuguuaagaaagcucacuagcaaagagcugaugaugacaaccaucgguauugugcuucugucacagaguacaaucccugagacuauucuagaacucaccgaugcgcuggccuuggggaugaugguccugaagaucgugaggaauauggagaaauaccaguuagcuguuacgauaauggccauccucugcgugcccaacgcagucauucugcaaaaugcuuggaagguauccuguacaauccuugccgugguuucugugagcccacuguugcucaccuccucacagcagaaagcagacuggauuccucuggcccuaacuaucaagggacugaaccccaccgcuauauuucuuacaacucucagccgaaccaguaagaaacgcucuuggccacugaaugaagcgauuauggccgucggcaugguguccaucuuggcaagcucgcuguuaaagaacgauaucccgauuacgggcccucucguagcugggggacugcuuacagugugcuauguccugaccggucggucagccgacuuggagcucgaaagagccgcugacguuaggugggaggagcaggcagaaauaucuggcaguucccccauccugagcauuaucauuucugaggaugggagcauguccaucaaaaaugaagaggaggaacaaacucuaacaauacugauccguaccggacuucucgugauuucaggccuguucccagugaguauccccauuacugccgcggcuugguacuugugggaggucaagaaacagcgcgccgguguguuaugggacguuccuagcccacccccuguagggaaggcagaacuggaggauggagccuaucggaucaaacagaagggcauacucggcuacucucagauuggggcuggaguguauaaggaagguacauuucauaccauguggcacgucacgagaggcgcagugcugaugcauaaagggaagaggaucgagccguccugggccgacguuaaaaaggaucuuaucucauacggaggcgguuggaaacuggagggggaauggaaggagggagaagaggugcaagucuuggcgcuagaaccaggcaagaacccccgagcugugcagacuaaaccuggccuguucaagaccaacgccgggacaauuggagcaguaagucucgacuuuagcccagguaccuccggcucucccaucauagauaaaaaggggaaagucgugggacuguacggcaaugguguugugacacggaacgggucguaugucagcgccauugcucagacuggaaagucaaucgaggacaauccugagauugaagaugacaucuuccgcaagaaaagacuuaccauaauggauuuacacccgggcgccggcaagacgaaaagguaccugcccgcaauugugcgggaggcuaucaagcgagggcucagaacauugauccuggccccaacucgcguuguggcggccgaaauggaggaagcacucaggggacugccuauucguuaucagacccccgcuauccgggccgagcauacagguagagagauugucgaccuuaugugucacgcuaccuucacuaugaggcuguuguccccaauacgcgugccuaacuacaaucuaaucauuauggaugaagcacacuuuaccgaccccgccaguaucgccgcucgaggcuauaucucuacaagaguagagaugggggaagcggcaggaauuuucaugacggccacuccaccgggcagccgggacccuuuuccccaauccaacgcuccaauaauggaugaggagagggaaauccccgagcgcucauggaacucuggucaugaaugggugaccgacuucaaagggaagacaguuugguuugucccuagcauuaaggccggaaacgauaucgcagccugccugcguaaaaauggcaagaaagugauucagcucaguagaaagaccuucgacuccgaguacgugaaaacucggacaaacgauugggacuuugucguaaccacggauaucagcgaaaugggcgcuaauuucaaggcggagagggugauagacccacgccgauguaugaagcccguuaucuuaacugauggggaggaaagagugauucuggccggaccuaugccggucacacacucuucagcagcucagcggaggggucgcaucggcagaaaccccaaaaaugagaacgaccaauauauuuacaugggggaaccccuugagaaugaugaagaccaugcccacuggaaggaggcaaaaaugcugcucgacaacaucaacaccccugagggaauaauucccuccauguuugaaccagagagggaaaagguggaugccaucgacggcgaguaccgguugcguggugaagcucgcaaaaccuucguugaucugaugcgaagaggggaccucccuguguggcuggccuauaaggucgcggcagagggcauuaauuacgccgauaggcgguggugcuuugacggaauccgcaacaaucagauacuugaggaaaacguggagguagaaaucuggacuaaagagggcgagagaaagaagcuaaaacccagguggcuggaugcucggauuuauagugacccauuggccuuaaaggaguucaaagaguucgcugcagggcgaaagagccugacacucaaucugaucaccgaaaugggaagacuuccuacauuuaugacucagaaagcccgcgaugcucuggacaaccucgccguguugcacacggcagaggcggguggcagggccuacaaucaugcucugucggaacuaccggagacccuggagacacuccuucuguuaacuuugcuggccaccguuacagggggaauuuuccucuuucugaugucuggcaaggguaucgggaagaugacccuuggcauguguugcauaauuacugcauccguccugcucugguaugcucagauccaaccccacuggaucgccgcaagcauuaucuuggaguucuuucugauaguguuacuaauuccagagccugaaaaacagcggacgccccaggauaaccagcugaccuacguggucaucgccauucucacaguuguggcugcgacuauggccaaugagaugggauuccuugaaaagaccaaaaaggacuuuggccuggggucaaucgcaacacaacagccagagaguaacauauuggauaucgaccugcguccugcuucugccuggacccucuaugccguagcaacuacauucauuacgcccaugcugagacauuccaucgagaauagcucagugaacgucagucuuaccgcuauugccaaucaggcgacugugcucaugggacuggguaaaggcuggccguugagcaagauggacaucgggguuccacuguuagcuauuggaugcuacucccaggugaacccuaucacacuaaccgccgcacugcuccuucuggucgcccacuacgcuauaauuggccccgguuugcaagcaaaggccaccagggaagcgcagaaacgcgcugccgcagggaucaugaagaauccaacaguagauggcaucacugugauugaccuggaucccauaccuuaugacccgaaauuugagaagcagcucggacagguuaugcugcuuguguuaugugucacgcaagugcugaugaugcggaccacaugggcccucugcgaggcuuugacucuggccaccggccccaucucuacacuaugggaggggaacccaggacgauucuggaauaccacuauugcagucagcauggcuaacaucuuuagaggcuccuaccuggccggugcggggcuccuuuucucaauuaugaaaaacacgacaaauaccaggcgcggaacuggcaacaucggugaaacccugggcgagaaguggaagucucgguugaaugcccuggggaaaagugaguuucagauauauaagaaaucgggaauccaggaaguggauagaacacucgcaaaggagggcauuaaacguggggaaacugaccaucacgcuguuagcaggggauccgccaagcugcggugguucguggagcgcaacaugguaaccccugagggcaaaguggucgauuuagguugugggcgaggaggcuggucuuacuauugcgguggccuuaagaauguuagagaagugaaggggcugacaaaaggaggccccgggcacgaggaaccuaucccaaugucaacguacggauggaaccucgucaggcuacaaagcggcguggacguauucuuuacaccaccugagaagugugauacucuguugugcgacauuggugaauccaguccaaaucccacaguggaggcagggcggacccugcgcguucucaaccuuguggagaauuggcugaacaauaacacucaguucuguaucaaagucuugaauccguauaugccuucugugauagaaaagauggaggcucugcagagaaaauacggaggcgcccucgucaggaacccauuaagccgaaauucaacacaugaaauguacuggguguccaacgccaguggcaacauuguuagcucuguaaauaugaucucccggaugcugaucaaccguuuuaccaugagacacaagaaggcgacguaugagcccgauguggaccuugggucaggaacccgcaauauugguauagaaagcgaggucccuaaccuggauaucauuggcaaaaggaucgagaagauuaaacaggaacaugagacaucguggcacuacgaccaagaccacccauauaagacuugggcuuaccaugggucuuaugaaaccaaacagacaggaagugcauccagcauggugaauggcguugugcggcuacucacuaagcccugggaugucaucccgauggugacccagauggccaugacagacaccacuccuuucggucagcaaagaguauuuaaggagaaaguggauacgcgcacacaggaacccaaggaggggaccaaaaagcugaugaaaauaacugcugagugguuguggaaggaacugggaaagaaaaagaccccaaggaugugcacacgagaggaguucacgcggaaaguuagaucaaacgccgcacucggcgccaucuuuaccgacgagaauaaguggaaauccgcuagggaggcggucgaagauucucgcuucugggagcuuguggacaaggaacguaaccugcacuuagagggcaaaugugaaacuugcguguacaauaugauggggaagcgggagaagaaacugggagaguuugguaaggccaaaggcagcagagcaauuugguauaugugguugggggcuagguuccucgaauuugaggcccugggauuccuaaacgaagaucauugguuuagucgcgaaaauucccuuagcggcgucgaaggugaggggcugcacaagcucggauacauccugcgagacguuucuaaaaaggagggcggcgcaauguacgccgaugacacagcugggugggauacccggauuacuuuggaagaccugaagaacgaggaaauggugacaaaucauauggagggagaacacaaaaagcucgccgaggcgaucuucaaacuuaccuaucagaacaagguagugagaguccagaggccuacaccccgcgguacugugauggacauuauaucaagacgggaucaaaggggcagugggcagguuggaaccuacggccugaauacguucaccaacauggaggcacaguuaauccgucaaauggaaggugaggggguguuuaaauccauucagcaccugacagccacugaagagaucgcuguccagaacugguuggcccgagugggacgcgagagacucagccggauggcaaucucuggcgacgauuguguaguuaagccacuggacgauagguucgcuucggcccuaaccgcucuuaaugacaugggcaaggugcgcaaagauauucagcaaugggaacccucaagaggguggaacgacuggacacaggucccuuuuugcagccaucacuuccaugagcugauaaugaaggauggacgggugcucguggucccaugcaggaaucaggacgaacugaucggucgagcccguauuucccagggcgcaggguggaguuugagagagacugcguguuuaggaaaaucuuaugcccaaauguggagccugauguacuuucaccgccgggaucucaggcuugcugccaacgcaaucugcuccgcuguuccgucacacugggugcccaccaguagaacgacauggucuauucaugccaagcacgaauggaugaccacugaggacaugcugacaguauggaaucgcguguggauccaggagaacccuuggauggaagauaaaaccccagucgagagcugggaagagauacccuaucuaggcaagcgggaagaccaguggugugguucccugaucgggcucacuucaagggcaaccugggccaagaauauucagacagcgaucaaccaagugcggagcuugauuggaaaugaggaguacacggacuauaugccuucuaugaaaagauucagaagggaagaggaagaggcuggcguucugugguga

SEQ ID NO: 14272 - RNA, 9876 nt, Artificial Sequence
  derived and/or modified CDS sequence (opt3) from DENV-2__KF744408__SS-prME
accgccggaaugaucauuaugcugauacccacagugauggcuuuccaccucacuacgcggaacggggaaccucauaugaucgucucaaggcaggaaaaggggaaaucccuucuguuuaagaccgaagacgguguuaauaugugcaccuugauggcuauggauuuaggagaacugugugaggacacuauuaccuacaaaugcccauuacuccggcaaaacgaaccggaggauaucgacuguuggugcaauucuacaucaaccugggugacuuaugggacauguaccacgacuggagagcaccgccgagaaaagcguaguguggcccuggugccccaugucggcaugggucuugagaccaggacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguugugucacuacaauggcuaagaacaagcccacccuggauuucgaacuuauuaaaacggaggccaagcacccugcgaccuugcggaaauauugcaucgaagcaaagcugacaaauacuaccacagccucccgcuguccaacucagggggagcccucucuaaacgaggaacaagacaaacgauuuguuugcaagcauagcaugguggauagaggauggggcaaugguuguggacucuucggaaagggcggcauuguaaccugcgcuauguuuacaugcaaaaagaacauggaggggaaaaucgugcagccugaaaaucuggaguacaccaucgugauuacuccacacuccggagaagaacaugccgucgguaacgacacgggcaagcacgggaaagagauaaagaucacaccgcagucaaguauuaccgaagcagagcuuacuggauauggcaccguuacaauggaauguagccccaggaccggucugggguucaaugagaugguguugcuccagauggaagauaaggcuuggcugguacaccggcaaugguuuuuagaccugccucucccauggcuucccggcgccgauacucagggaucuaacuggauccagaaggagacacuggugacguucaagaauccucaugcgaaaaagcaggacgucgugguuuugggcucccaagagggggccaugcacaccgcacuaacuggagcuacagaaauacagaugucaagcgguaaccugcucuuuaccggccaucugaaaugccgucuucgcauggacaagcugcaguugaaagggaugaguuacucuauguguacaggaaaguucaagguggucaaagagauugccgaaacucaacacggcaccaucgugguaagaguucaguaugagggugauggguccccaugcaagauccccuucgagauuauggaccucgagaaaaggcaugugcugggccgguuaaucacggucaacccgauugugaccgagaaggauagcccugucaauauagaagcugagcccccauuuggagacucguacgugaucauuggcguugaaccugggcagcugaaacuaucuugguucaagaagggauccucaaucggucagauguuugagacaacuaugcgaggcgccaaacgcauggcaauccucggggauaccgccugggacuucggaagucugggcgguguguuuacaagcauugggaaggcacuucaccaaguauucggcgcgauauacggagcagccuuuuccggcgucucuuggacuaugaaaaucuugauuggggugaucauuaccuggaucggaaugaacagcagaucaacgagucuguccguuagccucgugcuggucggcgugguaacacuuuaucugggugugguuguccaggcugauucuggguguguggugucauggaggaauaaggaguugaaaugcggaaguggcauauucaucaccgacaacguccacacuuggacagaacaguacaaguuucagcccgagagcccauccaagcucgccucugcaauucaaaaagcccaucaggaagguaucuguggcauucggucgguuacccgccuggagaauuuaauguggaagcagaucacucccgaacugaaccacauacuaagcgagaaugaggugaaacucaccauuaugacaggggauaucaagggaauuaugcaggcuggcaaaagaucccugaggccucaaccaacggaacuucguuauucauggaagaccugggggaaagccaagaucuugaguacugagucucauaaccagacauuccugauagacggaccggaaaccgcagagugccccaauacaaaccgggcguggaauagccucgaaguggaggauuacggcuuugguguauucacuaccaacaucuggcugcgauuaagagagaagcaggacgcuuuuugugacuccaaacugaugucagccgcaauuaaggauaauagggccguccacgcugacaugggguauuggaucgaaagcgcccuuaacgauacguggaaaauugagaaggcaucuuucaucgaagugaaauccugccacuggccuaagagucauacauuguggagcaauggaguucucgagucugagaugauaauuccaaagaacuucgcuggccccgugucccagcacaacuaccgcccugguuaucauacccaaacugccggcccauggcaccuggggaaacuagaaauggacuuugauuucuguaagggaaccacagucgugguuacugaggacugcggcaaucgggggcccucacugagaaccacaacggcgaguggaaaacucaucaccgaauggugcuguaggagcugcacucugccgccucuucgcuaccgaggcgaggaugguuguugguacgggauggaaauccggccauugaaggagaaagaggaaaaccugguaaauucguuaguaacagccggacauggccagauugacaacuuuucccucgguguccugggcauggcucuuuuccuggaggaaauguugcguaccagaguggggacuaagcacgcaauccuccugguggccgucucuuuuguuacacuaauuaccggaaauaugagcuucagggaucugggccgcgugaugguaauggugggggcuacgaugacugacgauauaggaaugggcgucaccuaucucgcccugcuugcagcguuuaaggugcggcccacauucgccgcugguuugcuguuaagaaaacucaccucaaaggagcugaugaugacuacaaucgggauuguucuucugagucaguccaccaucccugaaacaauucuagagcucacugacgcccuggcauugggaaugauggugcugaaaaucgucaggaacauggagaaguaccaauuagcugugaccauaauggccauccucugcguucccaaugcagugauucugcagaacgccuggaaagucucuuguacgauccuugcuguagugagcguuuccccacuguugcucacaucaagccagcagaaggcggauuggauuccucuggcccuaaccaucaagggccugaaucccacugcaauauuucuuaccacacucagucgaacuucuaaaaagcgcuccuggccacugaacgaagcuauuauggccgugggcauggucagcaucuuggccucgucacugcucaaaaaugacaucccgaugaccgggccucuaguggcuggaggucugcuuacgguaugcuaugugcugacaggccggucugcagacuuggagcucgaaaaggccgcggaugucagaugggaggaccaagcugaaauuaguggguccagccccauacugucuaucauuaucagcgaggauggauccaugucaauuaaaaacgaggaagaggaacagacccuaacuauccugauaaggacaggccuucucguuaucaguggucuguucccagugagcauucccaucaccgccgcagccugguacuugugggaggugaagaaacagcgugcuggggucuuaugggacgugccuucuccacccccuguuggaaaggcagagcuggaagauggcgccuaucgcauuaagcagaaaggcauccucggguacucccaaauaggagcggguguauauaaggagggcacuuuucacacaauguggcaugugaccagaggggcuguccugaugcacaaaggaaagagaauugaaccgucaugggccgacgugaaaaaggaucuuaucaguuacggcgguggguggaagcuggagggagaauggaaagagggcgaggaaguucagguguuggcacuagagccaggcaagaaucccagggccguccagacgaaaccugggcuguucaagacuaacgcuggaaccaucggugccgugagccucgacuuuuccccaggcacaucugggucgcccauuaucgauaaaaagggaaagguagucggccuguacgguaauggggugguuacccgaaacggaagcuaugugucagcaauagcucagacagaaaaauccauugaggacaacccugaaaucgaggaugacauuuuccggaagaaacgccuuacuaucauggauuuacauccgggcgccggcaagaccaaaagauaccugcccgcgauagucagggaggccauuaagcgggggcuccgaacguugauccuggcaccaacaagagugguugcugccgaaauggaggaagcucuccgcggacugccuaucagguaucaaacucccgcaauucgugccgagcacaccggucgggaaaucguggaccuuaugugucaugccacauucaccaugagacuguugaguccaauuagggucccuaauuacaaccuaauaaucauggacgaggcucacuuuacugaucccgcgucuauugcagcccgcggcuauaucagcacccgaguggagaugggggaagcugccggaaucuucaugacagcaacgccaccgggcuccagagacccuuuuccccagucaaaugccccaauuauggaugaggaacgggagauacccgagaggucuuggaacagcggucacgaauggguaacugacuucaaggggaaaaccgugugguuuguuccuaguaucaaggcuggaaaugauauugcggccugccugcgcaaaaacggcaagaaagucauccagcucucccguaagacauucgacagcgaguacgugaagaccagaacuaaugauugggacuuuguggucacaaccgauauuucugaaaugggcgcaaacuucaaagcugagcggguaaucgacccaaggcgcuguaugaagcccgugauauuaacggauggggaagaacgaguuauccuggccggaccuaugccggugacucauucauccgcagcccaaagacgggguaggauuggccgcaaucccaaaaacgagaaugaccaguauaucuacaugggggaaccacuugagaacgacgaagauugcgcucacuggaaggaggccaaaaugcugcucgacaauauuaacacaccugaaggaaucauacccaguauguuugagccagagagagaaaaggucgaugcgauugacggcgaguacagguugcggggugaagcacguaaaaccuucguggaucugaugcgccgaggggaccucccuguuuggcuggccuauaagguggcugccgagggcaucaauuacgcugauagaaggugguguuuugacggcauucggaacaaccagauccuugaagagaaugucgagguggaaauauggaccaaggagggcgaacgcaaaaagcuaaaacccagauggcuggaugcaaggaucuauagcgacccauuggccuuaaaggaguucaaagaguucgcugccgggcggaagucgcugacucucaaccugauuacagaaaugggacgacuuccuaccuuuaugacacagaaggcaagaaaugcgcuggauaaccucgccguauugcauacugcugaggccgguggccgcgcauacaaucacgcucugucugaacuaccggagacgcuggaaacccuccuucuguuaacauugcuggccacugugaccgggggaaucuuccucuuucugauguccggcaaagguauugggaagaugacacuuggcaugugcugcaucauaaccgcaagcguucugcucugguaugcccaaauucagccccacuggaucgcugcgucaaucauuuuggaguucuuucugaucgucuuacuaauaccagagccugaaaaacagaggacuccccaggacaaccaacugacguacguggugauugccauccucaccgucguugcagcuacaauggccaaugagaugggauuccuugaaaagacuaaaaaggaucugggcuuggggaguauuaccacacagcagccagagucuaacauccuggacauagaccuccggccugccuccgcauggacccuguaugcuguggccacuacauuuaucacgcccaugcuucgucauagcauugaaaauucaaguguaaacgugagccucaccgcgaucgcuaaucaggccacuguccugaugggauuggguaagggcuggccgcuguccaaaauggauauuggggugccauuacuagcaaucggauguuacucucaaguuaacccuauuacacugaccgccgcucuccuucuguugguggcacacuacgccaucauaggccccggucugcaggcgaaggcuaccagagaggcccagaaaagggcagccgcugggauuaugaagaauccaacagucgacggcaucacuguaaucgaucucgaccccauuccuuaugauccgaaauucgagaagcagcugggacaagugaugcuuuuaguucugugcgugacgcagguccucaugaugcgcaccacaugggccuugugugaagcacugacucuagcuaccggccccauaagcacacugugggaggggaacccaggacgguuuuggaauaccacuaucgccguguccauggcgaacauuuuccgaggcucauaccucgccggugcagggcuucuguuuucuaucaugaagaauacgacaaacaccagaaggggaacuggcaacauuggugaaaccuugggcgagaaauggaagagucgccugaaugcucucgggaaaucggaguuccagaucuauaagaaaagcggaauacaagaggucgaccggacacuggccaaggagggcaucaaaagaggggaaacugaucaucacgcagugucccguggaucugcuaaguuaaggugguuuguugagcggaacaugauuaccccugaaggcaaggugguagaccuugguugcgggcgcggaggcuggucauacuauugugguggccugaaaaaugugcgagaggucaaggggcucacaaaaggaggccccgggcaugaggaaccuaucccaaugagcacguacggauggaaccuaguuagacugcaguccggcguggaugucuucuucacacccccugagaagugcgacacuuugcugugugauauuggugaaaguucuccaaaucccacaguggaggccgggaggacccuccggguacuuaaccugguggaaaauugguugaacaauaacacucaguuuugcaucaaaguucugaauccguauaugccuagcgugauagagaagauggaggcccuccagcgcaaguacggaggcgcguuagucagaaacccacugucaagaaauuccacacacgaaauguacugggugaguaacgcuagcggcaauauugucucuuccgugaacaugaucucacgaaugcuuaucaaccgguucaccaugaaacacaagaaagcaacguaugagcccgacguugaucuggggagcggaacccguaauauugguauagaaucggagguaccuaaccuagacaucauuggcaagagaaucgagaaaauuaagcaagagcaugagacaucuuggcacuacgaccaggaucauccauauaagacuugggccuaccacgggaguuaugaaaccaaacagacaggauccgcuagcucaauggugaauggcgucgugcgccuccugacuaagcccugggacguuaucccgauggugacccagauggccaugacagauaccacuccuuuuggucaacagagggucuucaaagagaagguggacacgcggacacaggaacccaaagaggggaccaagaaguugaugaaaauaacugcagaauggcuguggaaggagcucggcaaaaagaaaaccccaagaauguguacacgcgaggaauuuacgaggaaaguacgauccaacgccgcucuuggcgcgaucuucaccgaugagaauaaauggaagucugcccgggaagcaguggaggacagcagauuuugggagcugguugauaaggaaaggaacuuacaccuggagggcaaaugcgaaacuugugucuacaauaugauggggaagcgcgagaaaaaguugggagaguucgguaaagcuaagggcagucgugccauuugguauauguggcucggggcacgguuucuggaguucgaggcccuaggauuucuuaacgaagaccauugguucuccagagagaauagccugucuggcguggaaggugaggggcuccacaagcugggauacaucuugagggaugugagcaaaaaggaaggcggcgcuauguacgccgacgauacagcggggugggacacccgcauuacucuggaggaccucaaaaacgaggaaauggucacaaaucauauggagggagaacacaagaaacuugcagaggccaucuuuaagcugaccuaucagaacaagguugugcgaguacaacggccuacacccagagguacugugauggauauuauaaguaggcgcgaccagagaggcuccgggcaggucggaaccuacggcuuaaauacguucaccaacauggaagcucaacugauccggcagauggagggugaggggguguucaaaagcauucagcauuugacagccacugaagagaucgcaguucagaauuggcucgcuagggugggacgugaacgacugucucgcauggccaucucgggcgaugacugcgucgugaagccacuagaugacagauuugcuucagcccuuaccgcacugaacgauaugggcaaaguacggaaggacauucaacagugggagcccagcaaaggguggaacgauuggacacagguuccuuucugcucccaccacuuucaugagcucauaaugaaggacggaagggugcuggucgugccaugucgcaaucaggaugaauugaucgguagagcgcggauuagucaaggcgccggguggucuuuaagggagacugcuugccugggaaagagcuaugcccagauguggucccucauguacuuccaccgacgugaccuuagacuggcagcuaacgccaucuguucagcagugccgagucauuggguccccaccucucgcacgacauggagcauucacgccaaacacgaauggaugaccacugaggauaugcuaacaguuuggaaucggguguggauccaggaaaacccuuggauggaggacaagaccccaguagaguccugggaagagauacccuaucugggcaaaagggaagaccaguggugcgguucacucaucggguugacuagcagagcgaccugggcuaagaauauucaaacagccaucaaccaggugcgcucucugauuggaaaugaggaauacacggauuauaugccuuccaugaaacgguuuaggcgagaggaggaagaggcaggcguccuuugguga

SEQ ID NO: 14273 - RNA, 9876 nt, Artificial Sequence
  derived and/or modified CDS sequence (opt3) from DENV-2__JX669476__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagagcgagaaccucgaauacaccauagucaucacuccucacuccggugaggagcaugcuguuggcaaugacacggggaagcacggaaaagaaauuaagaucacaccacagucaaguaccacugaggccgaacugaccggcuaugguacagugaccauggaguguagcccgaggacugggcuugauuucaacgaaaugguacuguugcaaauggaggacaaagcauggcucgugcaccggcagugguuucuggauuuaccccugccuuggcucccaggcgcugacacacagggaucuaauuggauacagaaggagacgcuugucaccuucaagaacccccaugccaaaaagcaagacgugguugugcugggcucccaggaaggggcgaugcacacugccuugacaggagcaaccgagauucagaugucaagcgguaaucuacuguuuacaggccaucucaaaugccgucugcgcauggauaagcuucaacugaaagggaugaguuacucuauguguacuggaaaguucaagaucgucaaagaaaucgcugagacccagcacggcacgauugugaucagaguacaguaugagggugacggguccccuugcaagauuccauucgaaauaaccgauuuggagaaaaggcauguucucggccggcugaucacagugaaccccauugucacugaaaaggacagcccggugaacaucgaggccgaaccucccuuuggagauucguacaucauugucggcguggagccagggcaguuaaaacugaauugguucaagaagggaucuuccauaggucaaauguuugagaccacaaugcgaggcgcuaaacgcauggccauccuaggggacacugcaugggauuucggaucacucggcgguguuuuuaccaguauugggaaggcccugcaccagguguucggcgcuaucuacggagcggcauuuagcggcguauccuggacgaugaaaauucuuaucggggucauaaucacauggauuggaaugaacucuagaagcaccucauugagugugucccugguucucgugggcgucgugacucuguaucuuggugccaugguacaggcugacagcggguguaucgugucuuggaagaauaaagaacugaagugcggaucaggcauuuucaucacagauaacguucacaccuggacugagcaguacaaguuucaaccugaauuccccaguaaauuggccagcgcaauacagaaggcccaugaggaagguauuuguggcaucagguccgucacccggcucgagaaucugauguggaaacagauuacaccagaguuaaaccacauccugucugaaaaugaggugaagcuaacgauaaugaccggggacaucaaaggaauuaugcaggcuggcaagcgcucgcucagaccccaaccuacugaacugaaauauagcuggaagacaugggggaaggccaaaaugcuuuccaccgagucacauaaccagacauuuuugaucgauggaccagaaacugcagagugcccgaauaccaacagggcguggaauagucuggagguggaagacuacggcuucggugucuuuacgacaaacauuuggcucaagcugcgugagaaacaggacguuuucugugauucuaaguuaaugagcgcugccaucaaagacaaucgggcagugcacgccgauaugggguauuggauagaauccgcucugaacgacaccuggaagguggagaaggccucauucauugagguaaaaagcugccacuggcccaagucucauacucuuugguccaauggagucuuggaaagugagaugaucaucccuaaaaacuuugcaggcccagugagccagcacaacuaccgacccgguuaucauacccaaacagcuggcccuuggcaccucgggaagcuggaaauggauuucgacuuuugugagggaacuaccguuguggucacagaagauugcggcaauagagggccaucucuaaggacgaccacugccuccggaaaacugauuacagaguggugcugucgcucaugcacccuccccccgcugcgguacagaggcgaggacgguuguugguacgggauggaaaucaggccucuuaaggagaaggaagagaacuuggugaauagucugguuacugcgggacauggccagauugauaacuucagcuuaggugugcucggcauggcccuguuucuugaagagaugcugcgcacacgaguagggaccaaacacgcuauauugcucgucgcacugucguucgugacgcuaaucacuggaaauauguccuuucgggaccugggccgugugauggucaugguuggggccaccaugacagaugacauuggaaugggcgugaccuaucucgcucugcuugccgcauucaagguaagaccaacuuuugcggccgguuugcuguuaaggaaacucacaucuaaggagcugaugauggcuaccaucgggauugcccuucugagccagucaacacuacccgaaacuauccucgagcugaccgaugcauuggcucugggaaugauggccuuaaaaauagugcgcaacauggaaaaguaccaacucgcagucacgaucauggccauuaguugcgugccuaaugcuguuauccugcagaacgcguggaagguguccuguacaauucuugccgcagucucugugagcccccuguugcucaccuccucacagcagaaaacugacuggaucccacuggcucuaaccauaaagggccugaauccuacagccauuuuccuuacuacccucagccggacgaguaaaaagagaucuuggccccugaacgaggccaucauggcuguuggcaugguguccaucuuggcaagcucgcuguuaaaaaaugacauuccaaugacagggccgcucgucgccggaggucugcuuaccguaugcuaugugcugacuggcaggucagcggauuuggaacucgagcgagcugccgacguuaagugggaggaucaagcagaaauaucugggaguuccccuauccugagcauuacaaucucugaggacggaagcauguccauuaaaaacgaagaggaggaacagacccuaacuauccugauacgcacaggccuucucgugaucucaggugucuuucccgugaguauuccaaucaccgccgcugcaugguaccugugggagguaaagaagcagcgggccgggguguugugggauguccccagcccuccacccguugaaaaagcggaguuagaagacggagcuuauagaauuaagcagaggggcauccugggcuacucucaaauaggggccggaguguauaaagaggguacguuccacacuauguggcaugugacccguggcgcaguccucaugcaccgcgggaagcggauugagccuuccugggccgaugugaaaaaggaccugaucucauacggaggcgguuggaagcuugaaggggaguggaaagaaggagaggaaguucagguacuggcuuuggagccgggcaagaauccaagagccgugcagacaaaacccggcaucuuuaagaccaacacagggacuauuggagcagucagucuagauuucagcccugguaccuccggcucuccaaucguggacaggaaagggaagguugugggacuguacggcaauggugucgugacgcgaucgggggcuuauguaagcgccauagcgcagacagagaagucaauugaagauaaccccgagaucgaagacgauauuuuccggaaaaagcgccucacuaucauggaccugcauccuggagccggcaaaaccaagagauaccuuccggcaauagucagggaggcuauuaaacggggcuuacgaacacugauccucgcccccaccagagugguugcugcagaaauggaggaggccuugcgcgggcugccaaucagguaucaaacuccugccauucgugcugaacacaccggacgggagaucguggaccucaugugucaugcgacauuuacgaugagacugcuuucccccgucagggugccaaacuacaaucugauuauaauggaugaagcacacuucacugacccugccaguaucgcugcccgcgguuauauuucuacccgaguugagaugggcgaggcagccgggaucuuuaugacagcuacccccccaggaagcagagauccguucccucaguccaacgcgcccaucauggacgaagagcgggaaauuccagagaggucauggaauucuggccacgaaugggugacugauuuuaaggguaagacagucugguucgugcccagcauaaaagccgggaacgacaucgcagcuugcuugcgcaagaauggaaaaaagguaauucagcuaagucguaaaaccuuugauuccgaguacgugaagacgagagccaacgacugggauuucguugucacuacagacaucagcgagaugggcgcaaauuuuaaggccgaacgggugauugauccuaggcgcuguaugaaaccagugauccugaccgacggcgaggaacgagucauacucgcugggcccaugccuguaacccauucuucagccgcgcaaagacggggaaggaucggucgcaacccgaagaaugagaacgaccaguauauuuacaugggcgaaccauuagagaaugaugaggacugcgcacacuggaaagaagccaagaugcugcuugauaacaucaauacucccgaggggauuaucccuuccauguucgaacccgagagagaaaaaguggacgcuauagauggagaguacaggcugcggggcgaggcccguaagacauuuguugaccucaugcgccgaggugauuugccaguguggcuggcuuauaaagucgcagccgaagggauuaacuacgcugacagaaagugguguuucgauggcaucaagaauaaccagauucucgaggaaaacguggagguugagaucuggaccaaagaaggagagaggaagaaacugaagccucgguggcuugacgcccgcauauauagugauccccuagcacugaaagaauucaaggaguuugcggccggcagaaagagcuugacauuaaaucugaucacugaaauggggaggcucccaacguucaugacccagaaagcucggaacgcccuggacaaucuugcagugcugcauacagcugaggucggaggucgagccuacacucacgcacucucggaguugccugaaacccuggagacacuacugcuccuuacccuguuagccgcugugacuggcgggauuuuuuuguuccugaugucuggaaagggcaucgguaaaaugacgcucgggaugugcugcauuaucaccgcguccauacugcuuugguaugcccaaauucagccgcacuggaucgcagcuagcaucauucuggaauuuuuccucaucguauugcugauacccgagccagaaaagcagagaacaccucaggauaaccaauuaacuuacgugguuauugccauccuaaccgucguggccgcaacaauggcuaaugagaugggcuuucuggagaaaaccaagaaggaccucggauucggcucaauuacuacacaggaaagugagucuaacauccuugacauagaucugcgccccgccuccgcguggacguuguaugcuguggccaccacuuuugucacaccaaugcugaggcauagcaucgaaaauucaaguguuaacgugagccucaccgcaauugccaaucaggcuaccguacugauggggcuuggaaaagguuggccucucuccaagauggacaucggcgugccccuguuggcaauuggguguuacucucaggucaacccgaucacacugacugccgcguuacuacugcucguggcucacuacgccauuaucggaccaggccuucaagcaaaagccacgcgggaggcucagaagcgugccgcagcugguauaaugaaaaauccuaccguugaugggauuacagugaucgaccuggaacccaucccauaugaucccaaguucgagaagcaguugggccaggucaugcugcucauucugugcguaacucaagugcuuaugaugagaaccacaugggccuuaugugaggcgcugacccucgccacuggaccuauaagcacguugugggaaggcaacccggggagguuuuggaauacaaccaucgcaguuuccauggcuaacauuuuccgcggaucauaccuggccggcgcaggucuacuguuuucuaucaugaaaaauacuaccaacacacggcgagggacuggaaaugugggcgagacccucggugaaaaguggaaaaguagacuuaacgcucugggcaagucggaguuccagauuuauaaaaagagcgggauccaggaggucgacaggacauuggccaaagaaggaauaaagcgcggcgagacggaucaucacgccgugucccgggggucugcgaagcugagaugguucgucgaacguaacauggugacccccgagggaaaaguuguggaccucggcugcgguagggggggauggucauacuauuguggcggucugaagaauguacgggaagugaaaggcuuaacuaaggggggaccaggccaugaggagccuauccccaugagcacauacggguggaaccuuguccgccugcaauccggaguugauguguuuuucaccccuccagaaaaaugcgacacucuccuaugugauauuggcgagaguucucccaauccuacaaucgaagcuggucgaacccugagagucuugaaccugguggagaauuggcucaacaauaacacgcaguuuugcauuaagguacuuaauccauauaugcccagcgugaucgaaaagauggagacccugcagaggaaauacgggggagcauugguucggaacccgcugucacgcaauuccacacacgagauguacugggugaguaacgccacuggcaauauagucagcucugugaacaugauuuccagaaugcucaucaauagguucaccaugaagcacaaaaaggcuacauaugaaccugacgucgauuuaggcucagggacucgaaacaucggaauugagagcgaaauaccaaaccuggacaucauugguaaacggaucgagaagauuaagcaggaacaugagaucucguggcacuacgaccaagaucaucccuauaaaaccugggccuaccacggcucuuaugagacaaagcagaccgggagugcauccagcauggugaauggaguuguacgucuucugacuaaaccuugggacguggucccaauggugacgcagauggccaugacagauaccacucccuuuggccagcaaagaguuuucaaggaaaaaguggacacccgcacacaggagccgaaggaagguacgaagaaacuaaugaagauaaccgcugaguggcucuggaaagagcuggggaaggaaaaaacuccuaggauguguacacgggaggaauuuaccagaaagguccgcucaaacgcggccuugggagcaguguucacugaugagaauaaauggaaguccgcuagggaagccguagaggacgaucgauuuugggagcugguggaccgggaaagaaaccuccaccuugagggcaagugcgaaacauguguuuacaauaugaugggcaaaagggagaagaaacugggggaauucggaaaggcaaaagguucucgcgccaucugguauaugugguuaggcgcucguuuucuggaguucgaggccuugggguuucucaacgaagaucauugguucagccggggaaauagucuguccggcgucgagggugaagggcuacacagacuuggauacauucugagggaggugggcaagaaggaaggcggggcgauguacgcagacgauaccgccggaugggacacacgcaucacucucgaggaccugaaaaacgaggaaauggugaccaaucauaugaagggugagcacaaaaaguuggcugaagccauuuucaaacugacguaucagaacaaggucguucgagugcagcggcccaccccaagaggcacaguaauggauaucauuagcaggaaggaccaacgcgggucuggacaggugggcacuuacggucucaauaccuuuacaaacauggaggcacagcuuauaagacaaauggagggggaaggaaucuucaaaucaauucagcaucugacugcuaccgaggaaaucgccguccagaauugguuagcucgggugggcagggagcgucugagucgaauggccaucuccggcgaugacugcguugugaagccuauugaugaccgcuuugcaagcgcguugacggcccucaacgauauggggaaagucagaaaggacauacagcaaugggaacccucucggggauggaaugauuggacacaggugccauucugcucgcaccacuuucaugagcugguaaugaaagacgguaggguucuagugguccccugucgcaaccaggaugagcuuaucggcagagcucggauuucacagggggccggauggagccugaaggaaaccgcaugccucggcaaguccuaugcucaaauguggacucugauguacuuccacaggcgagacuugcguuuagccgcaaacgccaucuguagugcggugccuucucauugggugccaacaagcagaaccacuugguccauucacgcuaaacacgaguggaugaccacagaagauaugcugacggucuggaaucgcguuuggauccaggagaacccguggauggaagacaagacccccguggagucaugggaggaaguaccuuaucucgguaaacgggaggaccaguggugcgggagucuuauaggacugacuucuagggccacaugggcaaagaauauccagaccgccauuaaccaagugagaagccuaaucggcaaugaaggcuacacugauuauaugccauccaugaaacgcuuucggagggaggaagaggaggcugggguccugugguga

SEQ ID NO: 14274 - RNA, 9876 nt, Artificial Sequence
  derived and/or modified CDS sequence (opt3) from DENV-2__JX475906__SS-prME
accgugggcaugaucauuaugcugauacccacagccauggcuuuccaccucacuacgagaaauggggaaccucauaugaucgucagcaggcaggaaaagggaaagucccuucuguuuaagaccgaagacgguguuaauaugugcacauugauggcaauggauuuaggcgaacugugugaagacacugugaccuacaacugcccacuacuccggcaaaaugaaccggaggauauugacuguuggugcaacucuacaucaaccuggguuacuuaugggacauguaccgccacgggagagcaccgccgagaaaaacguaguguggcgcuggucccccaugugggcaugggucuugagacuagaaccgaaacauggaugagcuccgagggggcuuggaagcacgcccagaggaucgagacuuggauucugcggcauccuggauucaccaucauggcagccauauuggcuuacacaaucggcaccacguauuuucagcgcguucucauuuucauccugcugacugcaguggccccaucuaugacaaugagaugcauuggcaucucgaauagggauuuugucgaaggggugucaggagguagcuggguagacauaguucucgagcacggcaguugugugaccacuauggcuaaaaacaagcccacauuagauuucgaacugauuaagaccgaggccaaacagccugcgacgcuucggaaguacugcaucgaagcaaaauugaccaauacaacuaccgccucccgcuguccaacacaaggggagcccucucugaacgaggaacaggacaagcgauuugucugcaaacacagcaugguggauagaggauggggcaaugguugugggcuauucggaaagggcggcauugugacuugcgcuauguuuaccugcaagaaaaacauggaggggaagaucguccagccugaaaaucucgaguauacaaucguuauuaccccacauuccggagaagagaacgccguggguaaugacacuggcaaacacgggaaggagguaaaagugacgccgcagucaaguauaacagaagcagagcugaccggauacggcacugucaccauggaauguagccccaggacaggucuugauuucaacgagauggugcuguugcaaauggaaaauaaggcuuggcucguucaucggcagugguuucuggacuuaccucugccauggcuccccggggccgauacccagggcucuaacuggauccagaaagagacucuugugacauucaagaacccucacgcgaagaaacaagacgucgugguacugggaucccaggagggcgccaugcacacggcauugaccggggcuacugaaauucagaugucaagcggaaaucuacuguuuacaggucaucucaagugccgucugcgcauggacaaacuucaacugaagggcaugaguuauucuauguguaccgggaaauucaagguugugaaggagaucgccgaaacacagcacggaacuauagucauuagagugcaguacgagggcgaugguuccccaugcaaaauccccuucgagaucauggacuuggaaaagaggcauguccucgggcggcugauuaccgugaacccgaucguuacggagaaagauagcccugugaauauugaagcugagcccccauuuggcgacucguacauaaucauuggaguagaaccuggccaguuaaagcugucuugguucaaaaagggguccucaaucggacaaauguuugagaccacaaugcgaggugccaagcgcauggcaauccuaggcgauacugccugggacuucgggagucucggaggcgucuuuaccagcauugguaaagcucugcaccagguguucggggcgauauauggcgcagccuuuuccggaguuucuuggacaaugaagauccuuauuggcguggucaucacuuggauugggaugaacagcagaucaaccaguuuguccgugagccugguacucgugggaguugucacgcuguaccuuggcgugauggugcaggcugauucugguugugucguuucauggaaaaauaaggagcugaaaugcgggaguggaaucuucauaacagacaacgugcauaccuggacugaacaguauaaguuucaacccgagagcccauccaaguuggccucugcaauccagaaagcccacgaagagggcauuugugguaucaggucggugacacggcucgaaaaucugauguggaagcagauuacccccgaguuaaaccacauccugagcgagaaugaaguaaaacuaacuauaaugaccggcgauauuaaggggaucaugcaggcuggaaaacgcucccucagaccucaaccaacagagcugaaguacucauggaaaacguggggcaaggccaagaugcuuaguaccgaaccgcauaaccagacuuucuugauugacgggcccgagacagcagaaugcccuaauaccaacagggcguggaacucucuggaggucgaggauuauggauuuggcguguucacaacuaacaucuggcucaaacugaaggaacgucaggacguauuuugugacagcaaauuaauguccgcugccauaaaggauaaucgggcagugcacgccgacauggguuacuggaucgagucagcucugaacgauaccuggaaaauugaaaaggccagcuucaucgaggucaagucuugccauuggccaaaaucccacacgcuuuggaguaacgggguguuggagagcgaaaugauuauccccaagaauuucgcaggaccuguuucucagcacaacuaucgaccaggcuaccauacacaaaccgcuggucccuggcaccucggcaaacuggagauggacuuugauuucugugaagggacuaccgugguagucacagaggacugcggaaauagaggcccgucccuaaggacuaccacagccucagggaagcugauaacggaauggugcugucgcaguugcacccucccuccacugcgguacagaggagaggauggcuguugguaugguauggagauuaggccccuuaaagaaaaggaggaaaacuuggugaauagccuggugacugcggggcauggacagaucgacaacuuuucguuaggcguccucgguauggcccuguuccuugaggaaaugcugcgcacacgaguuggcaccaagcacgcuuugcuccugguggcaguauccuuuaugacucuaaucacagggaauaugucuuuccgggaucugggacgugugauggucauggugggcgccgcuaugaccgacgauauugggaugggaguuacguaccucgcccugcuugcagcguuuaaagugagaccuacuuucgccgcuggcuugcuguuaaggaagcucaccagcaaagagcugaugaugacaaccaucgguauuguccuucugucacagaguacuauacccgagacaauccuagaacucaccgacgcccuggcauuggggaugaugauucugaagaucgugcgcaacauggagaaauaucaauuagcuguuacaauuauggccauccucugcgugccaaaugcagucauacugcagaacgccuggaagguauccuguacuauccuugcugugguuucugugagcccucuguugcucaccuccucacggcagaaggcggauuggauuccccuggcccuaacgaucaaaggacugaauccaacagcaauuuuucuuaccacucucagcagaaccaacaagaaaaggaguuggccgcugaaugaagcuaucauggccgucggcauggugucuauauuggccuccagccuguuaaagaacgacauuccuaugacaggcccccucguagcugggggacugcuuacugugugcuacguccugaccggucgaucggcagacuuggagcucgaacgcgccgcggauguucggugggaggaccaggcugagaucucaggcucuaguccaauccuguccauuacgauaagcgaagaugggucuaugagcaucaaaaaugaggaagaggagcaaacacuaaccauucugaucagaacuggacuucucgugauuuccggccuguuccccgugucaaucccuauaacagccgcagccugguauuugugggaagucaagaaacagagggcugguguguuaugggacguuccaagucccccuccgguagggaaggcagagcuggaagauggagccuaccguaucaagcagaaaggcauucucggcuauagccagaucggggcgggaguguacaaggaggguaccuuucauacuauguggcacgucacacgcggcgcugugcugaugcacaaagggaagcggauugaaccaucuugggccgacguuagaaaagaucuuaucuccuacggaggcgguuggaagcuggagggggaguggaaggaaggagaggaagugcaagucuuggcacuagagcccggcaaaaacccuagggccgugcagaccaagccaggccuguucaaaacgaacacugggaccauaggagcuguaucacucgacuuuagucccgguacaagcggcuccccuauugucgauaagaaagggaaggugguuggacuguauggcaaugguguggucacccgaucugggacauacgugucggccaucgcacaggcugaaaagagcaucgaggacaacccggagauugaagaugacaucuuccggaaacgcagacuuacuauaauggauuuacaucccggagccggcaagaccaaaagguaucugccagcgauuguucgggaggccaucaagcgaggccucagaacguugauucuggcaccuacacgcguggucgcugccgaaauggaggaagcucucagggggcugcccauccguuaccagacuccagcaauacgggccgagcacaccggaagagagauuguggaccuuaugugucaugccacauucaccaugaggcuguugucaccuguacgcgugcccaauuauaaccuaaucaucauggacgaagcucacuuuacugauccagcguccauugcagcccgagguuacaucaguaccagaguugagaugggcgaagcugccgggauuuucaugacagcaacgccgccuggaucucgggaccccuuuccacaaagcaaugcccccauaauggaugaggagagggaaaucccugagcgcuccuggaacucaggccaugaaugggucacugacuucaaagguaagaccgugugguuugugccaucuauuaaggcugggaaugauaucgcggccugccugcguaaaaacggaaagaaagucauccagcucagcagaaagacauucgacagugaguauauuaaaacccggacuaaugauugggacuuuguagugacaaccgauauauccgaaaugggcgcaaacuucaaggcugagaggguuaucgacccccgccgauguaugaagccugugauuuuaacggauggcgaggaaagagucauccuggccgggccgaugccagugacucacagcucugcagcccagcggaggggacgcauugguagaaaucccaaaaacgagaaugaccaauacaucuacaugggcgaaccucuugagaacgacgaagauugcgcucacuggaaggaggccaaaaugcugcucgacaauauaaacacacccgaggggaucauuccaucaauguuugaaccugagagggaaaagguugaugcgaucgacggagaguaucgguugcguggcgaagcacgcaaaaccuucguggaucugaugcgaagaggugaccuccccgucuggcuggccuacaggguggcugccgaggggauuaacuaugcugaucggcgcugguguuuugacggcguaaagaauaaccagauccuugaggaaaauguggagguugaaauauggaccaaagagggagagagaaagaagcuaaaaccaagguggcuggaugcacggauuuacuccgacccuuuggccuuaaaggaguucaaagaguucgcugccggccgaaagagucugacucucaaccugaucacagaaauggggagacuuccgaccuuuaugacacagaaagcacgcaaugcgcuggauaaccucgccgucuugcauacugcugaggccggagguagggcauauaaucacgcucugagcgaacuacccgagacgcuggagacccuccuucuguuaacauugcuggccacugugaccggcgggauuuuccucuuucugaugucgggaaagggcaucgguaagaugacacuugggaugugcugcauaaucaccgcaucuauucugcucugguacgcccagauccaaccacauuggauugcugcguccaucauauuggaguucuuucugauuguguuacuaaucccugagcccgaaaaacagcggacuccacaggacaaccagcugacguaugucguuaucgccauucucaccgugguagcagcuacaauggccaaugagaugggcuuccuugaaaagacuaaaaaggauuuuggacugggcagcaucgccacccaacagccugagucaaacauauuggacauugaccugcgucccgcaagugcuuggacacucuacgccguggcgaccacuuucaucacaccgaugcugagacacucuauugaaaauuccagcgucaacgugucacuuacggcuaucgccaaucaggcaaccguucucauggggcugggaaaagguuggccauugaguaagauggauauaggcgugccucuguuagccaucggguguuacagccaggucaaccccauuacucuaacagcugcacugcuccuucugguagcccacuaugcgaucauuggaccaggcuugcaagcuaaggccaccagggaagcacagaaacgcgccgcugccgguaucaugaagaaucccaccguggacgggauuacaguuaucgaucuggacccuauaccguacgaucccaaauuugagaagcagcucggccaggugaugcugcuugucuuaugcgugacucaaguccugaugaugcggacgaccugggcacucugugaggcuuugacacuggccacuggaccaauuuccacccuaugggagggcaacccugggcgauucuggaauacaaccaucgcggugucuauggccaacaucuuuagaggaagcuaucuggcaggcgcuggucuccuuuucuccauuaugaaaaacacuacgaauacaaggcgcgggaccggaaacacuggcgaaacccugggugagaaguggaagaaucgguugaacgcccugggcaaaucagaguuucagauauacaagaaaucugggauccaggaaguugacagaacacucgcaaaggagggaauuaaacguggcgaaacugaucaucacgcugugaguagggggucggccaagcugcggugguucguagagcgcaauuuagugacccccgagggaaaagucguugaccuuggcugcggucgagggggauggagcuauuacuguggcggucugaagaacgugagagaagucaagggccucacaaaagggggaccuggccaugaggaaccaauccccauguccacguauggguggaaucuagugaggcugcaaucuggaguagauguguucuuuaccccuccagagaagugcgacacuuugcugugugauauuggcgaaucaagccccaacccgacaguugaggccggucggacccuccgcgugcuuaaucuggucgagaacugguugaauaacaauacucaguucugcaucaaagugcugaacccuuacaugccauccgucauagaaaagauggaggcgcuccagagaaaauacgggggagcuuuagugaggaauccccugagucgaaacucuacacacgaaauguauuggguuagcaacgcaucaggcaauaucguauccagugugaacaugauuagccggaugcuuaucaaucguuuuaccaugagacauaagaaggccacguacgagccugacgucgaucugggcucugggacccgcaacauuggaaucgaauccgagacaccaaaucuagacauaauugguaaaaggaucgagaagaucaaacaggaacacgagacuucauggcacuaugaccaagaucaucccuacaagaccugggcuuaucacggcagcuacgaaacaaaacagacugggucggccucuaguauggugaacggaguugugcggcuccugaccaagccgugggacgucauuccuauggugacacagauggcaaugaccgauacuacgcccuucggccagcaaagaguauuuaaggagaaaguggacacacgcacccaggaaccaaaggaggguacuaaaaaguugaugaaaauaaccgccgaguggcuguggaaggaacucgggaagaaaaagacaccuaggauguguacgcgagaggaguucacccggaaaguuagauccaaugcugcgcuuggagccaucuuuacugaugagaacaaguggaaaagcgcaagggaggcugucgaagacucacgcuucugggagcugguggauaaggaacguaauuuacaucuggagggcaaaugcgaaacauguguguauaacaugaugggcaagcgggagaagaaauugggggaguuuggaaaggccaaagguuccagagcaauuugguacauguggcucggcgccagguuccuggaauuugaggcucuaggguuccuuaaugaagaccacugguuuucucgcgagaacagccugaguggagucgaaggcgagggucuccacaagcugggguacaucuugcgagauguuuccaaaaaggagggaggcgccauguaugcggacgauaccgcaggcugggacacucggauuacacuggaagaccucaagaaugaggaaauggugaccaaccauauggagggggaacacaagaaacuugccgaggcuaucuucaaacugacauaccagaauaaaguagugagaguccagaggcccacuccacgcggaaccgugauggauauaaucagcagacgggaccaaagggguucuggccagguugggacguauggauuaaacaccuucacaaacaugggcgcccagcugauucgucaaauggagggugaagggguguuuaaaucaauccagcauuugacugcaaccgaggaaauugcuguccaggauuggcucgcccgagugggacgcgagagacugagucggauggcuaucuccggcgacgauugcguaguuaagccccuagacgauagguucgccagcgcacuuacagcgcugaaugacaugggcaaggugcgcaaagauauucagcaaugggagccuucuagaggguggaacgacuggacucaggucccauuuugcucgcaccauuuccacgaacucauaaugaaggauggacgggugcugguggucccguguaggaaucaggacgaguugaucggucgagcccguauuucacagggcgcuggguggagcuuaagagaaaccgccugccugggaaaauccuacgcacaaauguggagucucauguauuuucaccgccgggaucuuaggcuggcugccaacgcaaucuguucugccguucccagccauugggugccuacguccagaacaaccuggucaauccacgcgaagcaugaguggaugacuacagaagacaugcuaaccguauggaaucgcguguggauucaggagaacccauggauggaggacaaaacucccgucgaaaguugggaggaaauaccuuaccugggcaagcgggaggaucaguggugcgguucucucaucggguugaccagcagggcuacaugggccaagaauauucagacggcaaucaaccaagugcgaucccugauuggaaaugaagaguauaccgacuacaugccaucaaugaaaagauuccggagggaggaagaggaagccggcguucuuugguga

SEQ ID NO: 14275 - RNA, 9876 nt, Artificial Sequence
  derived and/or modified CDS sequence (opt3) from DENV-2__JX669477__SS-prME
accgccggcgugaucguaaugcugauucccacagcuauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaauacagugauccugcagaacgcuuggaagguuuccuguaccauucuugcggccgugucugucagcccacuguugcucacuuccucacagcagaaagcagacuggaucccucuggcucuaaccauaaagggccugaaucccacagccauuuuucuuacuacccucagccggacgaguaaaaagagaucuuggccacugaacgaggccaucauggcugugggcaugguuuccaucuuggcaagcucgcugcuaaagaaugacauuccgaugacagggccucucguggccggaggucugcuuaccgucugcuauguacugacuggcaggucagcggauuuggaacucgagcgagcugccgacgugaagugggaggaucaagcagaaauaucugggaguucccccauccugagcauuacaaucucugaggacggaagcauguccauuaaaaacgaagaggaggaacagacccuaacuauccugauacgcacaggccuucucguuaucucagguguguucccagucaguauucccaucaccgccgcugcaugguaccugugggaggugaagaagcagcgggccgggguauugugggaugugccuagcccacccccugucggaaaagcggaauuagaggacggcgcuuauagaauuaagcagaggggcauccugggguacucucaaauaggagccgguguuuauaaagaaggcacguuucacacuauguggcaugugacccguggggcagugcucaugcaccgcggaaagcggauugagccguccugggccgaugucaaaaaggaccugaucucauacggcgguggguggaaacuugagggagaauggaaagagggcgaagaggugcagguucuggcuuuggaaccaggcaagaaucccagagccguacagacaaaaccugggaucuucaagaccaacacaggaacuauuggugcagugagucuagauuuuagcccaggcaccuccgggucucccaucgucgacaggaaaggaaaggugguuggccuguacgguaaugggguggucacgcgaucgggagcuuaugugagcgccauagcgcagacagagaagucaauugaggauaacccugaaaucgaggacgauauuuuccggaaaaagcgccucacuaucauggaccugcauccgggcgccggcaaaaccaagagauaccuucccgcaauaguaagggaagcuauuaaacggggguuacgaacacugauccucgccccaaccagagucguggcugcagagauggaagaggccuugcgcggacugccuaucagguaucaaacucccgccauucgugcugagcacaccggucgggaaaucguugaccucaugugucaugcgacauucacgaugagacugcuuuccccagugagggucccuaacuacaaucugauuauaauggaugaggcacacuuuacugaccccgccaguaucgcugcccgcggcuauauuucuacccgaguggaaaugggggaggcagccggaaucuucaugacagcuaccccaccgggcagcagagauccuuuuccccaguccaacgcgccaaucauggacgaggaacgggagauucccgaaaggucauggaacucuggucacgaguggguuacugauuucaaggggaagacagugugguuugucccuagcauaaaagccggaaacgacaucgcagcuugcuugcgcaagaauggcaaaaaggugauucagcuaagucguaaaaccuucgauuccgaauacguaaagacgagagccaacgacugggauuuugugguuacuacagacaucagcgagaugggcgcaaauuucaaggccgagcgggucauugauccaaggcgcuguaugaaacccgugauccugaccgacggggaagaacgagugauacucgcuggaccuaugccggucacccauucuucagccgcgcaaagacgggguaggaucggccgcaacccaaagaaugaaaacgaccaguauauuuacaugggggagcccuuagaaaaugaugaggacugcgcacacuggaaagaggccaagaugcugcuugauaacaucaauacuccugaaggaauuauccccuccauguuugagccagaaagagagaaaguagacgcuauagauggcgaauacaggcugcggggugaggcccguaagacauucguggaccucaugcgccgaggggauuugccuguuuggcuggcuuauaaaguggcagccgagggcauuaacuacgcugacagaaagugguguuuugauggaaucaagaauaaccagauucucgaagagaacgucgaaguggagaucuggaccaaagagggcgaaaggaagaaacugaagccccgguggcuugacgcccgcauauauagugauccacuagcacugaaagaguucaaggaguucgcggccgggagaaagagcuugacauuaaaucugaucacugagaugggaaggcucccuacguuuaugacccagaaagcucggaacgcccuggacaaucuugcaguucugcauacagcugaaguggguggcaaggcccacacucacgcacucucggaguugccggagacccuggaaacacuacugcuccuuacccuguuagccgcugucacugggggaauuuucuuguuucugaugucuggcaaagguaucgggaagaugacgcucggcaugugcugcauuaucaccgcguccauacugcuuugguacgcccaaauucagccccauuggaucgcagcuagcaucauucuggaguucuuucucaucguguugcugauaccagaaccugagaaacagcgaacaccccaggauaaccaauuaacuuauguagugauugccauccuaaccguugucgccgcaacaauggcuaaugaaaugggauuccuggagaagaccaagaaagaccucggcuuugggucaauuacuacacaggagagugaaucuaacauccuugacauagaucugagaccagccuccgcguggacguuguacgcuguggccaccacuuucgugacaccuaugcugcgccacagcaucgaaaauucaagugucaacguuagccucaccgcaauugccaaucaggcuaccgugcugaugggacuugguaagggcuggccccucuccaaaauggacaucgggguaccgcuguuggcaauuggauguuauucucaggugaacccaaucacacugacugccgcguuacuacugcucgucgcucauuacgccauuaucggcccuggucuucaagcaaaggccacgagggaagcucagaaacgggccgcagcugggauaaugaagaaucccaccguggauggcauuacaguuaucgaccuggagccaauccccuacgauccuaaguuugaaaaacaguugggacaggugaugcugcucauucugugcgucacucaaguacuuaugaugcguaccacaugggccuuaugugaggcgcugacccucgccacuggcccgauaagcacguugugggaggggaaccccggaagauucuggaauacaaccaucgcaguguccauggcuaacauuuuuaggggcucauaucuggccggugcagggcuacuguucucuaucaugaagaauacuaccaacacacgccggggaacuggcaauguuggugaaacccucggcgagaaauggaagagucgacuuaacgcucuggggaaaucggaauuucagauuuacaagaaaagcggaauccaggagguggacagaacauuggccaaggagggcauaaagagaggggaaacggaucaccaugccgucucccgcggaucugcgaaacugcggugguucguggagagaaacauggucaccccagaaggcaaggugguugaccucgguugcgggcguggaggcuggucauauuacugugguggccugaaaaaugugagggagguaaagggguuaacuaaaggaggcccugggcacgaggaaccaaucccuaugagcacauauggauggaaccuugugcggcugcaauccggcgucgauguuuucuuuaccccacccgagaagugcgacacucuccuaugugauauuggugaaaguucuccuaauccaacaaucgaggcugggcgcacccugcgaguguugaaccuggucgaaaauuggcucaacaauaacacgcaguucugcauuaaggugcuuaaucccuacaugccgagcguaaucgagaaaauggaaacccugcagagaaaguauggaggcgcauuggugaggaacccucugucaagaaauuccacacacgagauguacuggguuaguaacgccacuggcaauauagugagcucugucaacaugauuucccgcaugcucaucaauagauuuaccaugaaacauaagaaagcuacauacgagccagacguggauuuagggucaggaacuaggaacaucgguauugaaagcgagauacccaaccuggacaucauuggcaagcgaaucgaaaagauuaaacaggagcacgaaaccucguggcauuaugaccaagaucacccuuacaagacaugggccuaucacgggucuuacgagaccaaacagacuggaagugcauccagcauggucaauggcgugguucggcuucugacgaagccaugggacguagugcccauggucacacagauggccaugaccgauacuaccccguucggucagcaacguguguuuaaagagaagguugacacaagaacgcaggaaccuaaggaggggaccaaaaagcuaaugaaaaucacugcugaauggcucuggaaggagcugggaaaagagaagacaccccgcauguguaccagggaagaguucacucggaaagugagaucaaacgcggccuugggcgcagucuuuacagaugaaaauaaguggaaguccgcucgcgaggccguggaagacggcagguucugggagcugguagaucgagagcggaaccuccaucuugaagggaaaugcgagaccuguguguauaauaugaugggaaagagagagaaaaagcugggugaguuuggcaaagcaaaggggucuagggccauaugguacaugugguuaggagcucgcuuccuggaauuugaggccuugggcuuccucaacgaggaccacugguuuagccgugaaaauagucuguccgguguugagggggaaggacuacaucggcuuggcuauauccugagagaugucagcaagaaagagggcggggcgauguacgcagacgauacagccggaugggacacuaggauuacccucgaagaccugaagaacgaggagauggugacgaaucacaugaaaggugaacauaagaaauuggcugaggccaucuucaagcugaccuaccagaacaaggugguccgcguucagcgaccaacaccucggggcacugugauggauauuaucucuagaaaagaccaaagggggucaggacagguaggcaccuauggucucaauacauucacuaacauggaagcacagcuuauucgccaaauggagggggagggaauauuuagaaguauccagcaccugaccgcuacggaagagauugccgugcagaauugguuagcucgggucggcagggaacgucugucccgaauggccaucagcggcgaugacugcgugguuaagcccaucgaugaccgcuucgcaucugcguugacagcccucaacgauauggggaaagugagaaaggacauucagcaaugggagccaucgcggggauggaaugauuggacccagguccccuuuugcucacaccauuuccacgaacuggugaugaaagacgguagggucuuaguugugccuugucgcaaccaggaugagcuuauaggcagagcucggaucagccagggggccggauggucccugaaggagacugcaugccucggcaagaguuacgcucaaauguggacacugauguauuuucauaggcgagacuugcguuuagccgcaaacgccauuuguucugcggucccaagccacugggugccgaccuccagaacuaccuggucaauccacgcuaaacaugaauggaugacaacggaggauaugcuggccguguggaaucgcgucuggauucaggaaaaccccuggauggaggacaagaccccuguugaaaguugggaggaggugccauaccucgguaaacgggaagaccaguggugcgggucucuuaucggacugacuagcagggcaacaugggccaagaauauacagaccgcuaucaaccaaguaagaucccuaauuggcaaugagggcuauacugauuacaugcccucaaugaaacgcuuccggagggaagaggaagaggccggggugcugugguga

SEQ ID NO: 14276 - RNA, 9876 nt, Artificial Sequence
  derived and/or modified CDS sequence (opt3) from DENV-2__JX669478__SS-prME
accgcaggcgugaucgucaugcugauucccacagcaauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcaucuuuggguacucucaaauaggagccgguguuuauaaagaaggcaccuuccacacgauguggcaugugacucguggggcagugcugaugcaccgcggaaagcggauugagccguccugggcugaugucaaaaaggaccucaucucauacggcgguggguggaagcuggagggagaauggaaagagggcgaagaggugcagguucuugcccuggaaccaggcaagaaucccagagcaguacagaccaaaccugggaucuuuaagacaaacaccggaacaauuggugcugugaguuuggauuucagcccaggcacuuccgggucucccaucgucgacaggaaaggaaaggugguuggccuauacgguaaugggguggucacccgaucgggagccuaugugagcgcgauagcccagacggagaagucaauugaggauaacccugaaaucgaggacgauauuuuccggaaaaagcgccugacaaucauggaccuccauccgggcgcaggcaaaacuaagagauaccugcccgcuauaguaagggaagccauuaaacgggggcuucgaaccuuaauccuggcuccaacaagagucguggcagccgagauggaagaggcccuccgcggauugccuaucagguaucaaacccccgcuauucgugcggagcacacuggucgggaaaucguugaccugaugugucaugcaaccuuuacaaugagacuccuguccccagugagggucccuaacuacaaucuuauuauaauggaugaggcccacuucacggaccccgcuaguaucgccgcacgcggcuauauuucuacucgaguggaaaugggggaggccgcuggaaucuuuaugaccgcgacaccaccgggcagcagagauccuuucccccaguccaacgccccaaucauggacgaggaacgggagauucccgaaaggucauggaacucuggucacgaguggguuaccgauuuuaaggggaagacugugugguucgucccuagcauaaaagcaggaaacgacaucgcugccugccugcgcaagaauggcaaaaaggugauucaguugagucguaaaacauuugauuccgaauacguaaagaccagagcaaacgacugggauuucgugguuacgacugacaucagcgagaugggcgccaauuuuaaggcugagcgggucauugauccaaggcgcuguaugaaacccgugauccuaacagacggggaagaacgagugauacuggccggaccuaugccggucacccauucuucagcggcacaaagacgggguaggaucggccgcaacccaaagaaugaaaacgaccaguauauuuacaugggggagccccucgaaaaugaugaggacugcgcccacuggaaagaggcuaagauguuacuggauaacaucaauaccccugaaggaauuauccccuccauguucgagccagaaagagagaaaguagacgccauagauggcgaauacaggcuucggggugaggcucguaagacuuuuguggaccugaugcgccgaggggaucucccuguuugguuggcauauaaaguggccgcugagggcauuaacuacgccgacagaaagugguguuucgauggaaucaagaauaaccagauucuggaagagaacgucgaaguggagaucuggacaaaagagggcgaaaggaagaaacucaagccccgguggcuggacgcacgcauauauagugauccacuugcgcuaaaagaguucaaggaauuugccgcugggagaaagagccugaccuugaauuuaaucacagagaugggaaggcugccuacuuucaugacgcagaaagcccggaacgcacucgacaaucuggcuguucuucauaccgccgaaguggguggcaaggcauacacacacgcccugucggagcucccggagacuuuggaaacccugcuacugcucacacuucuggcugcggucaccgggggaauauuuuuauucuugaugucuggcaaagguaucgggaagaugacucugggcaugugcugcauuaucacggccuccauacuccugugguaugcacaaauucagccccacuggaucgcugccagcaucauucuugaguuuuuccugaucgugcucuugauaccagaaccugagaaacagcgaaccccacaggauaaccaacugacauacguagugauugccaucuuaacuguugucgcagcuaccauggccaaugaaaugggauuucuagagaagacaaagaaagaccugggcuucgggucaauuaccacucaggagagugaaucuaacauccucgacauagaucuuagaccagcguccgcuuggacacuguaugccguggcaacgaccuuugugacuccuauguugcgccauagcaucgaaaauucaagugucaacguuagccugacagccauugcuaaucaggcaaccgugcucaugggacuggguaagggcuggccccuuuccaaaauggacaucgggguaccgcuccuggccauuggauguuacucucaggugaacccaaucaccuugacagcggcucuguuacuacuggucgcccacuacgcaauuaucggcccuggucuccaagccaaggcuacuagggaagcccagaaacgggcagcugccgggauaaugaagaaucccacgguggauggcauuaccguuaucgaccuugagccaauccccuaugauccuaaguucgaaaaacagcugggacaggugauguugcugauucucugcgucacacaaguacugaugaugcguacuaccugggcgcuuugugaggccuuaacacuggcaaccggcccgauaagcacucucugggaggggaaccccggaagauuuuggaauacgacaaucgcuguguccauggccaacauuuucaggggcucauacuuggccggugcugggcugcuauuuucuaucaugaagaauaccacuaacacccgccggggaacaggcaauguuggugaaacucugggcgagaaauggaagagucgacucaacgcccuugggaaaucggaguuccagauuuauaagaaaagcggaauccaggagguggacagaacccuggccaaggagggcauaaagagaggggaaacagaucaucacgcggucucccgcggaucugcuaaauugcggugguucguggagagaaacauggucacgccagaaggcaaggugguugaccuggguugcgggcguggaggcuggucauacuauugugguggccucaaaaaugugagggagguaaaggggcugaccaaaggaggcccugggcaugaagaacccaucccuaugagcacuuacggauggaacuuagugcggcuucaauccggcgucgauguauuuuucacaccacccgagaagugcgacacccugcucugugauauuggugaaaguucuccuaauccaacuaucgaggcagggcgcacacuacgagugcugaacuuggucgaaaauuggcugaacaauaacacccaguuuugcauuaaggugcucaaucccuauaugccgagcguaaucgagaaaauggaaacgcuucagagaaaguacggaggcgcccuggugaggaacccuuugucaagaaauuccacccacgagauguacuggguuaguaacgcuacaggcaauauagugagcucugucaacaugauuucccgcaugcugaucaauagauucacuaugaaacacaagaaagccaccuaugagccagacguggaucucgggucaggaacaaggaacaucgguauugaaagcgagauacccaacuuagacaucauuggcaagcgaaucgaaaagauuaaacaggagcaugaaacuucguggcacuacgaccaagaucauccuuauaagaccugggcauaccacgggucuuaugagacaaaacagaccggaagugccuccagcauggucaauggcgugguucggcugcuuacuaagccaugggacguaauccccauggugacgcagauggcuaugacagauaccacuccguuuggucagcaacgugucuucaaagagaagguggacaccagaacacaggaaccuaaggaggggacgaaaaagcugaugaaaauaaccgcggaauggcuauggaaggagcucggaaaagagaagacuccccgcauguguacaagggaagaguuuacccggaaaguuagaucaaacgccgcacugggcgcuguguucacugaugaaaauaaguggaaguccgcccgcgaggcagucgaagacggcagguuuugggaguugguggaucgagagcggaaccugcaccucgaagggaaaugcgagacauguguauacaauaugaugggaaagagagagaagaaacuuggugaguucggcaaagccaaagggucuagggcuaucugguauauguggcugggagcccgcuuuuuagaguucgaggcgcugggcuuuuugaacgaggaccauugguucagccgugguaauagucucuccgggguggaaggagagggccugcaccggcuaggcuacauucuuagagaaguugggaagaaagagggaggugcaauguacgccgaugacaccgcuggcugggauacaaggaucacucuggaagaccucaagaacgaggagauggucaccaaucauaugaaaggggaacacaagaaacuggccgaggcaauuuucaaguugacguaucagaacaagguggugcgcguccagcgaccaaccccucggggaacaguuauggacaucauuagcagaaaagaucaaaggggcucuggucagguggggacuuacggacugaauaccuuuacaaacauggaagcucagcucauacgccaaauggagggcgagggcaucuucaagucaauucagcaucuuacugccaccgaagagaucgcuguacagaauuggcuggccagaguggggcgggaaagguuaagucguauggcaaucuccggagacgauugcgucgugaaacccauugacgaucgauuugcgagcgcccugacggcuuugaacgacauggguaagguucgcaaagauauacagcaaugggagccaucuagaggcuggaaugacuggacacaggugcccuucugcucgcaccacuuucaugaacucgucaugaaggaugggcgggugcugguaguuccuuguaggaaccaggacgagcuaaucggacgcgccagaauuucacagggcgcagguuggagccuuaaggagaccgcuugccuggggaaauccuaugcccaaauguggacucucauguacuuccaccggagggaucugcgauuggcagccaacgcgaucuguagugcugugccaucucauugggucccgacaagccguaccacuugguccauucacgccaagcacgaauggaugaccacagaggacauguuagcaguguggaauagaguguggauccaggaaaaccccuggauggaggauaaaacgccugucgaaucaugggaggagguuccauaucugggaaagcgcgaagaccaguggugcggcagucucauaggccuuaccucucgggccacuugggcuaaaaauauccagacagccauuaaccaagugaggagccugaucgggaaugagggauacauugacuauaugcccuccaugaagagauuucgccgggaagaggaagaggcugguguucuaugguga

SEQ ID NO: 14277 - RNA, 9876 nt, Artificial Sequence
  derived and/or modified CDS sequence (opt3) from DENV-2__JX669480__SS-prME
accgccggcgugaucauuaugcugauacccaccgcuauggcuuuccaccucacuacgagaaauggggaaccucauaugaucgucggaagacaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucgugcucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaggaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcacuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguauuuugugacucuaaacugaugagcgccgcaauaaaggauaaucgggccgugcacgcugacaugggguauuggauugaguccgcccuuaacgauaccuggaaaauggaaaaggcaucauucaucgagguaaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaagugagacccaccuucgcggccgguuugcuguuaaggaagcucacaucuaaagagcugaugauggcuaccauugggaucacucuucugagccagucaacaauaccugaaaccauccuagagcucacagacgcccuggcauugggaaugaugguccugaagauugugcgcaacauggaaaaauaccaguuagcuguuacuaucauggccauuaguugcgugcccaaugcagucauccuccugaacgccuggaagguguccuguaccauacuugcugcgguuucugugagcccacuguugcucacguccucacaacagaagacagauuggauuccucuggcccuaaccaucaaaggccugaaucccacugcaaucuuucuuaccacacucagccggacaaguaagaaaagaucuuggccacugaacgaggcugucauggccguaggcaugguguccauuuuggccagcucgcuguuaaagaaugacauaccgaugaccgggccucucguugcuggaggucugcuuacggugugcuauguccugacaggcaggucagcagacuuggagcucgaacgagccgcggaugugaaaugggaggaccaggcugaaaucucugggaguucccccauucugagcaucaccauuucugaggauggaagcauguccaucaagaacgaggaagaggaacagacucuaacaauacugauccgcaccggccuucucguaauuucagguguguucccagucaguauccccauuacugccgcagccugguaccugugggagguuaaaaagcaacgggcugggguguugugggacgugccuagcccacccccugucggaaaggcagaauuagaggauggcgccuauagaaucaaacagaggggcauacugggguacucucagauuggagcggguguguauaaggagggcacauuucacaccauguggcauguuacgcguggggcuguacucaugcaccgcggaaaacggaucgaaccguccugggccgacgugaagaaagaucugaucucauacggcgguggguggaaacuugagggagaauggaaggagggcgaagagguccaggugcuggcauuggagccaggcaaaaaucccagagccguucaaacuaagccugggcuauucaaaaccaacacaggaaccauuggugcugugagucuggacuuuagcccaggcacauccgggucucccaucgucgauaggaagggaaaagugguaggccucuacgguaauggggucgugacucgaucgggagccuauguuagcgcaauagcucagaccgaaaagucaauugaggacaacccugaaaucgaggaugacauuuuccggaagaaacgccugacgaucauggaucuucauccgggcgccggcaagacaaaaagauacuuacccgcgauagugagggaagccauuaagcgggggcugcgaacucucaucuuggcaccaaccagagucguggcugccgagauggaggaagcucugcgcggacucccuaucagguaucagacacccgcaauucgugccgagcacaccggucgggaaaucguugaccugaugugucaugccacuuucaccaugagacuucuguccccagugagggucccuaacuacaauuugauuauaauggacgaggcucacuuuacagaucccgcgaguaucgcagcccgcggcuauauuucuacgcgaguggagaugggggaagcugccggaaucuucaugacugcaaccccaccgggcagcagagacccuuuuccccaguccaacgccccaaucauggaugaggaacgggagauucccgaaaggucauggaacucuggucacgaguggguaacagacuucaaagggaagaccgugugguuuguuccuagcauaaaggcuggaaacgauaucgcggccugccuacgcaaaaauggcaagaaagucauucaacugagucguaagacuuucgacuccgaguacgugaaaacaagagcaaacgauugggacuuuguggucaccacggauaucagcgaaaugggcgcuaauuuccgggccgagaggguaauugacccacgccgauguaugaagcccgugauccucacugauggggaagagagaguuauauuagcaggaccuaugccggugacacauucuucagccgcucagcggaggggucgcgucggcagaaacccaaagaaugaaaacgaccaguauaucuacaugggggagccccuggagaaugacgaagauugcgcccacuggaaagaggcgaagaugcuucuggacaacauuaauaccccugaaggaaucauucccuccauguuugagccagaaagggagaaaguggaugcaaucgacggcgaguaccggcuccguggugaagcccgcaagaccuucguugauuugaugcgaagaggggaccugccuguguggcucgcuuauagggucgccgcugagggcauaaacuacgcagaucggcgcugguguuuugacggaauuaaaaauaaccaaauccuggaagagaacguggagguagaaauuuggacuaaggagggcgaaaggaagaaacuuaagcccagguggcuagaugcccggaucuauagugacccacuggcuuugaaagaguucaaggaguucgccgcagggcgaaagagcuuaacacugaaucucauaaccgagaugggaagacugccuacauuuaugacucagaagacgcgcgaugcgcuugacaaccuggccgugcuccauaccgcugaggccgguggcagggcauacaaucacgcuuugucggaacugccggagacacuagaaacucugcuccuucugaccuuauuggccacaguuaccgggggaaucuuccuguuucucaugucuggcaaagguauugggaagaugacucugggcaugugcugcaucauuacggcauccauccuucugugguaugcccagauacagccccacuggauugcugcgagcaucauccucgaguucuuuuugauuguccuguuaaucccagaaccugagaagcaacggacaccccaggauaaccagcuaacauacguggugauagccauucugacugucguugcagcuaccauggccaaugagaugggauuccucgagaaaacuaagaaagaccuuggccuggggucaaucaccacucaggaaagugaaucuaacauuuuggacaucgaucugcguccagccuccgcauggacacucuaugcuguggccacgaccuuuguaacuccuaugcugagacauagcauagaaaauucaagugugaacgucagccuuacagcgaucgcuaaucaagccaccgugcucaugggacuggguaagggcuggcccuuguccaaaauggacauugggguuccgcuguuagcaaucggauguuacucucaggugaacccaauuacccuaacagccgcucugcuccuucuggucgcacacuacacuaucauuggcccugguuugcaggccaaggcgacgagggaagcucagaagcgcgccgcagccgggaucaugaaaaaucccaccguagauggcauaacagugauugaccuggagccaauccccuaugauccuaaguucgagaaacaacucggacagguuaugcugcuuaucuuaugcgugacucagguccugaugaugcggaccacaugggcucucugugaagccuugacccuggcaacuggcccgauuagcacgcuaugggaggggaaccccggacgauuuuggaauacaaccauagcuguguccauggccaacaucuucagaggcucauaccuggcgggugccgggcuccuauuuucuauuaugaagaauacuaccaacacaaggcgcggaacuggcaauaucggugaaacccugggcgagaaauggaagagucgguugaacgcacuggggaagucggaguuccagauuuauaaaaagagcggaauccaagaagucgacagaacacucgcuaaagagggcauaaagcguggggaaacggaucaucacgccguguccaggggaucugcaaaacugcggugguuuguugagcgcaacauggugaccccagaaggcaagguaguggacuuagguugcgggcgaggaggcuggucauacuauugugguggccuuaaaaaugucagagagguuaaggggcugacuaagggaggcccugggcaugaggaacccaucccuaugagcacauacggauggaaccucgugaggcuacaguccggcgucgauguguucuucaccccacccgagaaaugcgacacucuguugugugauauuggugaaaguucuccuaauccaacaaucgaggcugggcggacccugcgcguacucaaccuuguggaaaauuggcugaacaauaacacgcaguuuugcauuaagguuuugaaucccuauaugccgagcgugaucgagaaaauggagacccugcaaagaaaguacggaggcgcccucgucaggaacccuuuaucacgaaauuccacacacgaaauguacugggugaguaacgccacuggcaauauagucagcucugugaacaugauuucccggaugcugaucaaucguuucaccaugaaacacaagaaggcgacauaugagccagacguugaucuugggucaggaacuagaaacaucgguauugaaagcgagauacccaaccuggacaucauuggcaaacgcaucgaaaagauuaaacaggagcaugagaccucguggcacuacgaccaggaucauccuuauaagacaugggcuuaccacgggucuuaugaaaccaaacagacuggaagugcauccagcaugguaaauggcguggucaggcuacucacgaagccaugggacgugguucccauggugacacaaauggccaugaccgauacuaccccguuuggucagcagcgggucuucaaggagaaaguggacacaagaacgcaggaaccuaaggaggggaccaaaaagcugaugcgcaucacugcugagugguuguggaaagaacugggaaagaagaaaacacccaggauguguacccgagaggaauuuacucggaagguaagaucaaacgccgcacucggcgccauauucacagaugagaauaaauggaaguccgcuagggaagcgguggaggacucucgcuuuugggagcuuguugaucgugaacggaaccugcacuuagagggcaaaugcgaaaccugugucuacaauaugauggggaagagagagaaaaagcugggagaguucgguaaggccaaaggcagcagggcaaucugguauaugugguugggggcucgcuuucucgaguucgaggcccugggauuucuaaacgaagaccauugguucagucgaggcaauucccuuagcgguguggagggggaaggacugcaccggcucggcuacauucugagagaugugucuaagaaagagggcggggcaauguacgccgacgauacagcuggaugggacacuaggaucaccuuggaagaccugaagaacgaggagauggucacgaaucauaugaaaggugaacacaagaagcucgccgaggcgauuuuuaaacuuaccuaucaaaacaagguugugcgcguacagagaccaacaccucggggcacugugauggauaucauuucaaggcgugaccagcgagggaguggacaggucggcaccuacggucugaauacauucacuaacauggaagcacaauuaauacgccagauggagggggagggaaucuucaaauccauucagcaucugaccgugacggaagagaucgccguucaaaauugguuggcuagagugggccgggaaaggcucagccgcauggccaucucuggcgaugacugcgucgugaagccccuggaugacagauuugcaucggcucuaacagcccuuaacgauauggggaaaguacggaaggacauucagcagugggagccaucaaggggauggaaugauuggacccagguucccuucugcagccaccacuuucaugaacuggugaugaaggacggucgaguccucguggugccuugucguaaccaagaugagcugauaggcagagcucgcaucucccagggggccggauggaguuugaaagagacugcaugcuuaggcaagucuuaugcgcagauguggacacugauguacuuccaccggagggaccucagacuugccgcuaacgccauuuguagcgcagucccaucccauuggguuccgaccucacgcacuaccuggaguauccacgcuaaacacgaauggaugacaacggaggauaugcuggccguguggaaucggguauggauucaggaaaaccccuggauggaggacaagaccccuguggaaucuugggaggaggucccauaucuagguaaaagggaagaccaauggugcgggagccugaucggacucacuucccgagcaacaugggccaagaauauacagaccgcgaucaaccaggugagaucauugauuggcaaugaggaauacacugauuauaugcccagcaugaagcgguuuaggcgcgaggaagaggaggcuggcguucugugguga

SEQ ID NO: 14278 - RNA, 9876 nt, Artificial Sequence
  derived and/or modified CDS sequence (opt3) from DENV-2__JX669483__SS-prME
accgccggcgugaucauuaugcugauacccacagcuauggcuuuccaccucacuacgcgaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccaggacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugaggugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaggaacaggacaaacgauuuaucugcaagcauucuaugguggaucggggcugggguaacggguguggacuuuucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuaaaguacaguaugagggugaugggucuccaugcaagauacccuucgaaaucauggaccucgagaaaagacauguucugggcagguuaauuaccgugaacccgaucgucacggaaaaggauuccccugugaacaucgaggcugagcccccauuuggagacagcuacauuauaaucggcgucgaaccugggcagcugaaacuaaauugguucaagaagggaucgucuauuggucagauguuugagaccacaaugcggggcgccaaacgaauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacucccgcucuaccagccugucagucagucucgugcugguuggcguggucacgcuuuaucugggugcuauggugcaggccgauuccggguguguagugagcuggaagaauaaagaauugaagugcggaucuggcaucuucauaacagacaacguucacaccuggacugagcaguacaaguuucagcccgaaucaccaaguaaacucgcaagcgccauucaaaaggcucaugaggaggguaucuguggcauuagauccgucacaaggcuggaaaauuuaauguggaaacagaucacccccgagcugaaccacauacuaucugaaaaugaggugaagcucacuaucaugaccggggauauuaaaggaaucaugcaggccggcaagcggucgcugcgcccucagccaacagaacuuaaauauagcuggaagacgugggggaaggcaaaaauguuguccaccgagucacauaaccaaacuuuccugauugacggaccggagacagcggaaugccccaauaccaacagagcuuggaauagucucgagguggaagauuacggcuuuggugucuucacaacuaacaucuggcugaaguuaagggagaaacaggacguauuuugugacucuaagcugaugagcgccgcaauaaaagauaaucgugccgugcacgcugacaugggguauuggauugaguccgcccuuaacgauaccuggaagauggaaaaggcaucauucaucgaggugaaaagcugccacuggccuaagucucauacguugugguccaauggaguacucgaaagugagaugaucauucccaagaauuucgcuggccccgucagccagcacaacuaccggccugguuaucauacacagaccgccggcccauggcaccuggggaagcuagaaauggacuuugauuucugugagggaacuaccgugguugugacagaggacugcggcaaucgagggcccucucugagaacuaccacagcguccggaaaacucaucacggaauggugcuguaggucaugcacccugccgccucuucgcuaccggggcgaggaugguuguugguacgggauggaaauuagaccauugaaggagaaggaagagaaccuggucaauaguuuagugacugccggacauggccaaauagacaacuuuagccucgguguucugggcauggcucuuuuccuggaggaaauguugaggacacgcguggggaccaaacacgcaauccuccugguagccgucucguuugugacucuaauuacaggaaauauguccuuccgagaucugggccgggugauggucaugguuggggugaccaugacggacgauaucggaaugggcguaacuuaucucgcucugcuugccgcauuuaaggugcgucccaccuucgcggccgguuugcuguuaagaaaacucacaucuaaggagcugaugauggcuaccauugggaucacucuucugagccagucaacaauaccugaaaccauccuagagcucacagacgcccuggcauugggaaugaugguccugaaaauugugaggaacauggaaaaguaccaguuagcuguuacuaucauggccauuaguugcgugcccaaugcagucauccuccugaacgccuggaagguguccuguaccauacuugcugcgguuucugugagcccacuguugcucacguccucacaacagaaaacagauuggauuccucuggcccuaaccaucaagggccugaaucccacugcaaucuuucuuaccacacucagccgcacaaguaaaaagcggucuuggccacugaacgaggcugucauggccguaggcaugguguccauuuuggccagcucgcugcuaaagaaugacauaccgaugaccgggccucucguugcuggaggucugcuuacggugugcuauguccugacaggcagaucagcagacuuggagcucgaaagggccgcggaugugaagugggaggaccaggcugaaaucucugggaguucccccauucugagcaucaccauuucugaggauggaagcauguccaucaaaaacgaggaagaggaacagacucuaacaauacugauccgaaccggccuucucguaauuucagguguguucccagucaguauccccauuacugccgcagccugguaccugugggagguuaagaagcaacgcgcugggguguugugggacgugccuagcccacccccugucggaaaagcagaauuagaggauggcgccuaucggaucaagcagagaggcauacugggguacucucagauuggagcggguguguauaaagagggcacauuucacaccauguggcauguuacgagaggggcuguacucaugcaccguggaaagcgcaucgaaccguccugggccgacgugaaaaaggaucugaucucauacggcgguggguggaaacuugagggagaauggaaagagggcgaagagguccaggugcuggcauuggagccaggcaagaauccccgggccguucaaacuaaaccugggcuauucaagaccaacacaggaaccauuggugcugugagucuggacuuuagcccaggcacauccgggucucccaucgucgauagaaaaggaaaggugguaggccucuacgguaauggggucgugacuaggucgggagccuauguuagcgcaauagcucagaccgaaaagucaauugaggacaacccugaaaucgaggaugacauuuucagaaagaagcggcugacgaucauggaucuucauccgggcgccggcaaaacaaagcgcuacuuacccgcgauagugagagaagccauuaaaagggggcugcggacucucaucuuggcaccaacccgagucguggcugccgagauggaggaagcucugagaggacucccuauccgcuaucagacacccgcaauuagggccgagcacaccggucgugaaaucguugaccugaugugucaugccacuuucaccaugcggcuucuguccccagugagagucccuaacuacaauuugauuauaauggacgaggcucacuuuacagaucccgcgaguaucgcagccaggggcuauauuucuacgcgcguggagaugggggaagcugccggaaucuucaugacugcaaccccaccgggcagccgagacccuuuuccccaguccaacgccccaaucauggaugaggaaagagagauucccgaacggucauggaacucuggucacgaguggguaacagacuucaaggggaagaccgugugguuuguuccuagcauaaaagcuggaaacgauaucgcggccugccuaaggaagaauggcaaaaaggucauucaacugagucgcaaaacuuucgacuccgaguacgugaagacacgugcaaacgauugggacuuuguggucaccacggauaucagcgaaaugggcgcuaauuucagagccgagcggguaauugacccaaggcgcuguaugaagcccgugauccucacugauggggaagaacgaguuauauuagcaggaccuaugccggugacacauucuucagccgcucagagacgggguagggucggccgcaaccccaaaaaugaaaacgaccaguauaucuacaugggggagccacuggagaaugacgaagauugcgcccacuggaaggaggcgaaaaugcuucuggacaacauuaauaccccugaaggaaucauucccuccauguuugagccagaaagagagaagguggaugcaaucgacggcgaguacaggcuccggggugaagcccguaaaaccuucguugauuugaugcgccgaggggaccugccuguguggcucgcuuauagagucgccgcugagggcauaaacuacgcagauaggcggugguguuuugacggaauuaagaauaaccaaauccuggaagagaacguggagguagaaauuuggacuaaagagggcgaacgcaagaaacuuaaacccagauggcuagaugccaggaucuauagugacccacuggcuuugaaggaguucaaagaguucgccgcagggagaaagagcuuaacacugaaucucauaaccgagaugggacgacugccuacauuuaugacucagaaaacgagagaugcgcuugacaaccuggccgugcuccauaccgcugaggccgguggccgcgcauacaaucacgcuuugucggaacugccggagacacuagaaacucugcuccuucugaccuuauuggccacaguuaccgggggaaucuuccuguuucucaugucuggcaaggguauugggaagaugacucugggcaugugcugcaucauuacggcauccauccuucugugguaugcccagauacagccccacuggauugcugcgagcaucauccucgaguucuuuuugauuguccuguuaaucccagaaccugagaaacaaaggaccccacaggauaaccagcuaacauacguggugauagccauucugacugucguugcagcuaccauggccaaugagaugggauuccucgaaaagacuaaaaaggaccuuggccuggggucaaucaccacucaggagagugaaucuaacauuuuggacaucgaucugcggccagccuccgcauggacacucuaugcuguggccacgaccuuuguaacuccuaugcugcgucauagcauagaaaauucaagugugaacgucagccuuacagcgaucgcuaaucaagccaccgugcucaugggacuggguaaaggcuggcccuuguccaagauggacauugggguuccgcuguuagcaaucggauguuacucucaggugaacccaauuacccuaacagccgcucugcuccuucuggucgcacacuacacuaucauuggcccugguuugcaggccaaggcgacgagagaagcucagaaaagggccgcagccgggaucaugaagaaucccaccguagauggcauaacagugauugaccuggagccaauccccuaugauccuaaauucgagaagcaacucggacagguuaugcugcuuaucuuaugcgugacucagguccugaugaugcgcaccacaugggcucucugugaagccuugacccuggcaacuggcccgauuagcacgcuaugggaggggaaccccggacgguuuuggaauacaaccauagcuguguccauggccaacaucuuccgaggcucauaccuggcgggugccgggcuccuauuuucuauuaugaaaaauacuaccaacacaagaaggggaacuggcaauaucggugaaacccugggcgagaaguggaagagucgcuugaacgcacuggggaaaucggaguuccagauuuauaagaaaagcggaauccaagaagucgaccggacacucgcuaaggagggcauaaaaagaggggaaacggaucaucacgccgugucccguggaucugcaaagcugaggugguuuguugagcggaacauggugaccccagaaggcaaaguaguggacuuagguugcgggcgcggaggcuggucauacuauugugguggccuuaagaauguccgagagguuaaggggcugacuaaaggaggcccugggcaugaggaacccaucccuaugagcacauacggauggaaccucgugagacuacaguccggcgucgauguguucuucaccccacccgagaagugcgacacucuguugugugauauuggugaaaguucuccuaauccaacaaucgaggcugggaggacccugcggguacucaaccuuguggaaaauuggcugaacaauaacacgcaguuuugcauuaaaguuuugaaucccuauaugccgagcgugaucgagaagauggagacccugcaacgcaaauacggaggcgcccucgucagaaacccuuuaucaagaaauuccacacacgaaauguacugggugaguaacgccacuggcaauauagucagcucugugaacaugauuucccgaaugcugaucaaucgguucaccaugaagcacaagaaagcgacauaugagccagacguugaucuugggucaggaacucguaacaucgguauugaaagcgagauacccaaccuggacaucauuggcaagagaaucgagaaaauuaagcaggagcaugagaccucguggcacuacgaccaggaucauccuuauaaaacaugggcuuaccacgggucuuaugaaaccaagcagacuggaagugcauccagcaugguaaauggcgugguccgccuacucacgaagccaugggacgugguucccauggugacacaaauggccaugaccgauacuaccccguuuggucagcagagggucuucaaagagaagguggacacacggacgcaggaaccuaaagaggggaccaagaaacugaugagaaucacugcugagugguuguggaaggaacugggaaagaaaaagacaccccgcauguguaccagggaggaauuuacucgaaaaguacggucaaacgccgcacucggcgccauauucacagaugagaauaaguggaaauccgcuagagaagcgguggaggacucuagguuuugggagcuuguugaucgcgaacguaaccugcacuuagagggcaagugcgaaaccugugucuacaauaugauggggaaacgggagaagaagcugggagaguucgguaaagccaagggcagcagagcaaucugguauaugugguugggggcuagguaccucgaguuugaggcccugggauuccuaaacgaagaccauugguuuagucgcggcaauucccuuagcgguguggagggggaaggacugcaccgacucggcuacauucugcgggaugugucuaaaaaggagggcggggcaauguaugccgacgauacagcuggaugggacacuagaaucaccuuggaagaccugaaaaacgaggagauggucacgaaucauaugaagggugaacacaagaaacucgccgaggcgauuuucaaacuuaccuaccaaaacaaaguugugaggguacagcgcccaacaccuagaggcacugugauggauaucauuucacggagggaccagcgugggaguggacaggucggcaccuauggucugaauacauuuacuaacauggaagcacaauuaauacgacagauggagggggagggaaucuucaaguccauucagcaucugaccgugacggaagagaucgccguucaaaauugguuggcucgcgugggcagagaacggcucagcaggauggccaucucuggcgaugacugcgucgugaaaccccuggaugaccgcuucgcaucggcucuaacagcccuuaacgauauggggaagguaagaaaggacauucagcagugggagccaucacggggauggaaugauuggacccagguucccuuuugcagccaccacuuccaugaacuggugaugaaagacgguaggguccucguggugccuugucgaaaccaagaugagcugauaggccgugcuagaaucucccagggggccggauggaguuugaaggagacugcaugcuuaggcaaaucuuacgcgcagauguggacacugauguauuuucaccgccgggaccucaggcuugccgcuaacgccauuuguagcgcagucccaucccauuggguuccgaccucaagaacuaccuggaguauccacgcuaagcacgaauggaugacaacggaggauaugcuggccguguggaaucgcguauggauucaggaaaaccccuggauggaggacaaaaccccuguggaaucuugggaggaggucccauaccuagguaagcgggaagaccaauggugcgggagccugaucggacucacuuccagggcaacaugggccaagaauauacagaccgcgaucaaccaggugcgaucauugauuggcaaugaggaauauacugauuacaugcccagcaugaaaagauuccggagggaggaagaggaggcuggcguucugugguga

SEQ ID NO: 14279 - RNA, 9876 nt, Artificial Sequence
  derived and/or modified CDS sequence (opt3) from DENV-2__JX669484__SS-prME
accgccggcgugaucauuaugcugauacccacugcuauggcuuuccaccucacuacgcggaacggggaaccucauaugaucgucggaaggcaggaaaaagguaaaagccuucuguuuaaaaccgaagacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccaggacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaaaaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuuggugucuucacaacuaacaucuggcugaaguuacgugaaaaacaggacguauuuugugacucuaagcugaugagcgccgcaauaaaagauaaucgggccgugcacgcugacaugggguauuggauugaguccgcccuuaacggaaccuggaagauggagaaggcaucauucaucgaagugaaaagcugccacuggccuaagucucauacguugugguccaauggcguacucgagagugaaaugaucauucccaaaaauuucgcuggucccgucagccagcacaacuaccgaccuggcuaucauacacagaccgccgggccauggcaccugggaaagcuagagauggauuuugacuucugugaaggcacuaccgugguugugacagaggauugcgggaauagaggacccucucugaggacuaccacagcguccggcaaacucaucacggaguggugcugucgcucaugcacccugccgccucuucgguacagaggugaagacggguguugguacggaauggagauuaggccauugaaggaaaaggaggaaaaccuggucaauaguuuagugacugccggccauggucaaauagauaacuuuagccucggcguucuggggauggcucuuuuccuggaggagauguugcgcacacgagugggaaccaaacacgcaauccuccugguagccgucucguuugugacucuaauuacaggcaauauguccuucaaggaccuggggcgggugauggucaugguuggaguggcuaugaccgaugacaucggcauggguguaacguaucucgcccugcuugcagcguuuaaagugcgucccacuuucgccgcuggguugcuguuaagaaagcucaccucuaaagaacugaugauggccacaauuggaaucacccuucugagccagucaacuauaccugagacaauccuagaacucaccgaugcacuggcuuugggcaugaugguccugaagauugugaggaacauggagaaguaccaguuagccguuacaaucaugacuauuaguugcgugcccaaugcagucauccuccugaacgccuggaaaguguccuguaccauacuugcugcgguuucugugagcccacuguugcucacguccucacaacagaagacagacuggauuccucuggcccuaaccaucaaaggccugaaucccacugcaaucuuucuuaccacacucagccgcacaaguaagaaacggucuuggccacugaacgaagcugucauggccguagggaugguguccauuuuggccagcucgcuguuaaagaaugauauaccgaugaccggaccucucguugcugguggccugcuuacggugugcuauguccugacagggagaucagcagacuuggagcucgagagggccgcggacgugaaaugggaagaucaggcugagaucucuggaaguucccccauucugagcaucaccauuucugaagacggcagcauguccaucaagaacgaggaggaagaacagacucuaacaauacugauccgaaccggucuucucguaauuucagggguguucccagucaguauccccauuacugccgcagccugguaccugugggaaguuaagaaacaacgcgcuggaguguugugggaugugccuagcccacccccugucggcaaggcagaguuagaagacggcgccuaucggaucaaacagagagggauacugggauacucucagauuggugcgggcguguauaaggaggggacauuucacaccauguggcauguuacgaggggagcuguacucaugcaccguggcaaacgcaucgagccguccugggccgaugugaagaaggaccugaucucauacggugggggauggaaacuugaaggcgaguggaaggaaggcgaggaaguccaggugcuggcauuggagccagggaaaaauccccgggccguucaaacuaagccuggacuauucaaaaccaacacagguaccauuggcgcugugagucuggauuuuagcccagggacauccggaucucccaucgucgacagaaagggcaaggugguaggucucuacgggaauggagucgugacuaggucgggcgccuauguuagcgcaauagcucagaccgagaaaucaauugaagauaacccugagaucgaagacgauauuuuccgaaagaaacggcugacgaucauggaccuucauccgggcgccgggaagacaaaacgcuacuuacccgcgauagugagagaggccauuaagaggggacugcggacucucaucuuggcaccaacccgagucguggcugccgaaauggaggaggcucugagaggucucccuauccgcuaucagacacccgcaauuagggccgaacacaccggccgugagaucguugaucugaugugucaugccacuuucaccaugcggcuucuguccccagugagagucccuaacuacaauuugauuauaauggacgaagcucacuuuacagaccccgcgaguaucgcagccaggggguauauuucuacgcgcguggagaugggagaggcugccggcaucuucaugacugcaaccccaccggguagccgagauccuuuuccccaguccaacgccccaaucauggacgaagagagagaaauucccgagcggucauggaacucugggcacgaauggguaacagauuucaagggaaaaaccgugugguuuguuccuagcauaaaggcuggcaacgacaucgcggccugccuaaggaaaaauggcaagaaagucauucaacugagucgcaagacuuucgauuccgaguacgugaagacacgugcaaacgacugggauuuuguggucaccacggacaucagcgagaugggggcuaauuucagagccgaacggguaauugauccaaggcgcuguaugaaacccgugauccucacugacggagaggaacgaguuauauuagcagguccuaugccggugacacauucuucagccgcucagagacggggcagggucgggcgcaacccaaagaaugagaacgaucaguauaucuacaugggagaaccccuggagaaugacgaggacugcgcccacuggaaagaagcgaagaugcuucuggauaacauuaauaccccugagggcaucauucccuccauguuugaaccagagagagaaaaaguggacgcaaucgauggugaguacaggcucagaggggaagcccguaagaccuucguugacuugaugcgccgaggcgaucugccuguguggcucgcuuauagagucgccgcugaaggaauaaacuacgcagacaggcggugguguuuugauggcauuaaaaauaaccaaauccuggaggaaaacguggagguagagauuuggacuaaggaaggggagcgcaagaaacuuaagcccagauggcuagacgccaggaucuauagugauccacuggcuuugaaagaguucaaggaguucgccgcaggacgaaagagcuuaacacugaaucucauaaccgaaaugggucggcugccuacauuuaugacucagaaggcgagagacgcccuugauaaccuggcugugcuccauacggccgaggcaggcgggcgcgcuuacaaucacgccuugucggagcugccggaaacccuagagacacugcuccuucugacuuuauuggcaaccguuacaggaggcaucuuccuguuucucaugucugguaagggggucggcaaaaugacccugggaaugugcugcauuaucacugccuccauucuucugugguaugcucagauccagccccacuggauagcggccagcauuauccucgaguucuuuuugaucgugcuguuaauuccagagccugaaaagcaaaggacgccccaggacaaccagcuaaccuacguggucaucgcaauacugacaguuguggcugccacuauggccaaugagaugggcuuccucgagaaaaccaagaaagaucuugggcugggaucaauuacaacccaggaaagugagucuaacaucuuggacauugaccugcggccagcauccgcuuggacucucuaugccguagcgacaacguuugugaccccuaugcugcgucauagcaucgaaaauucaagugucaacgugagccuuacugcuauagccaaucaagcaacaguucucaugggucugggcaagggguggcccuuguccaagauggauaucggagugccgcuguuagccauuggcuguuacucucaggucaacccaaucacccuaaccgcugcacugcuccuucugguagcccacuacgcgauuaucgguccuggguugcaggcuaaagccacaagagaggcacagaagagggccgcugccggcauuaugaaaaaucccacuguggacggaaucacgguuauagaucuggaaccaauucccuaugacccuaaguucgagaaacaacucggccaggugaugcugcuuaucuuaugcgucacccaggugcugaugaugcgcacaacuugggcacucugugaggcuuugacccuggccacagggccgaucagcacccuaugggaaggaaaccccggccgguuuuggaauacuacgauugcggucuccauggccaacauauuccgagguucauaccuggcaggggcuggacuccuauuuucuaucaugaagaauacaaccaacacuagaaggggcaccgguaauauuggcgagacacugggggaaaaguggaaaagucgcuugaacgcccugggaaagucggaguuccagaucuauaaaaagagcggcauucaagagguggaucggacucucgcaaaagaagggaucaagagaggagagaccgaccaucacgcuguuucccguggcucugccaaacugaggugguuuguggaacggaacaugguaacaccagaggguaagguggucgauuuagggugcggacgcggcgguuggucauacuauuguggcgggcuuaagaauguucgagaagugaaaggacugacgaagggcgggccuggacaugaggagcccauaccuaugagcaccuacggcuggaaccucgucagacuacaguccgguguggacguauucuucacuccacccgaaaaaugcgauacacuguugugugacaucggggagaguucuccuaauccaaccauugaagccggaaggacucugcgggugcucaaccuuguugagaauuggcugaacaauaacacacaguuuugcaucaagguguugaaucccuauaugccgagcgucauugagaaaauggagacccugcaacgcaaguacggcggcgcgcucgugagaaacccuuuaucaagaaauuccacgcacgagauguacugggucaguaacgcuaccgggaauaucgugagcucuguuaacaugauaucccgaaugcugauuaaucgguucacaaugaagcacaaaaaggcaacuuaugaaccagauguagaccuuggaucagguacccguaacaucggcaucgagagcgaaauucccaaccuggauauaaucgggaaaagaauugagaagaucaaacaggaacaugagacaucguggcacuacgaccaggaccauccuuauaagacuugggccuaccacggaucuuaugagaccaagcagacaggcagugcuuccagcauggugaauggugucgugcgccuacucaccaaaccaugggauguugugcccauggucacucaaauggccaugacggacacaaccccguuugggcagcagaggguguucaaggaaaaaguagauacucggacccaggagccuaaggaaggaacgaaaaagcugaugagaauuacagcagagugguuguggaaggagcugggcaaaaagaaaaccccacgcauguguacuagggaagaguuuacacgaaaggugcggucaaacgccgcucucggcgcgaucuucaccgacgaaaauaaauggaaguccgccagagaggcaguugaagauucuagguuuugggagcuugucgaccgcgagcguaaccugcacuuagaagggaaaugcgagacuuguguguacaauaugaugggaaagcgggaaaagaaacugggugaguucggcaaggcuaaagggagcagagccauaugguauaugugguugggagcaagguuucucgaguucgaggcccugggcuuucuaaacgaggaucauugguucagucgcgguaauucccuuagcgggguggaaggagagggccugcaccgacucggcuacauccugcgggacgucucuaagaaagaagggggagcuauguacgccgaugacacagcggguugggauaccagaauuacauuggaggaccugaagaacgaagagaugguuaucaaucauaugaagggcgagcacaaaaagcucgcagaagccauuuuuaaacuuacuuaucaaaacaaggugguaagggugcagcgcccaaccccuagagggacggucauggacaucauuucacggagggaucagcguggaaguggccagguggguaccuacgggcugaauacauucacuaacauggaggcucaauuaauacgacagauggaaggagagggcaucuucaaauccauucagcaucugaccguuacagaggaaaucgccgugcaaaauugguuggcacgcgucggcagagagcggcucagcaggauggcuaucucuggggacgauugcgugguaaagccccuggacgaucgcuuugccucggcucuaacugcccuuaacgacaugggaaagguuagaaaagauauucagcagugggaaccaucacgggguuggaaugacuggacccaggugcccuucugcagccaccacuuucaugagcuggucaugaaggauggcagggugcucguggucccuugucgaaaccaagacgaacugauagggcgugcaagaaucucccagggagcgggcuggaguuugaaagagacggccugcuuagguaagucuuaugcucagauguggacacugauguacuuccaccgccgggaucucaggcuugccgcaaacgcuauuuguagcgccguuccaucccauugggugccgaccucaagaacuacauggaguauccacgcaaaacacgaguggaugaccacugaagacaugcuggccguauggaaucgcguguggauucaggagaaccccuggauggaagauaagaccccugucgagucuugggaagaggugccauaucuagggaagcgggaggaccaauggugcggaagccugaucggccucacauccagggcgacgugggcuaaaaauauacagaccgccaucaaccagguucgaucauugauuggcaaugaagaguacacugacuauaugcccagcaugaagagauuucggagggaagaggaagaggcaggggugcugugguga

SEQ ID NO: 14280 - RNA, 9876 nt, Artificial Sequence
  derived and/or modified CDS sequence (opt3) from DENV-2__JX669485__SS-prME
accgccggcgugaucauuaugcugauacccacugcuauggcuuuccaccucacuacgaggaauggggagccucauaugaucgucggaaagcaggaaaaagguaagagccuucuguuuaaaaccgaggacggcguuaauaugugcacauugauggccauugauuuaggggaacugugugaggacacuaucaccuacaagugcccacuucucaggcaaaacgaaccggaggauauugacuguuggugcaauuccacaucuaccugggugacuuauggaacauguaccacgacuggcgagcaccggcgcgaaaaacgaucaguugcgcuggugccccaugucgguauggggcuugagacccguacagaaacuuggaugaguagcgagggagcuuggaagcacgugcagcggaucgagaccuggauacugaggcauccuggcuucgccaucauggcagccauuuuggcuuacacaaucggcaccacgcacuuucagcgggcacucauuuucauccugcugacugccguugcuccauccaugacaaugcgcugcauagggauuucuaacagggauuuuguggaaggagucucggguggcucauggguggacaucgugcucgagcacgggagcuguguuaccacuauggccaagaauaaacccacauuagauuucgaacugauuaagaccgaggcgaaacagccugcaacgcuuaggaaguauugcaucgaagccaaauugaccaacacaacuaccgagagucgguguccaacacaaggagagcccucccugaaugaggaacaggacaagcgcuuuaucugcaagcauucuaugguggaucgaggcugggguaacggguguggacuauucggcaaaggcgggauugucacuugcgcuauguuuaccugcaagaaaaauauggaaggaaagguggugcucccugagaaccuggaauacacaauagucaucaccccacacagcggugaggagcaugccguuggcaaugacacugggaaacacggaaaggaaauuaaaaucacgccgcaguccucaauaacagaggcagaacuuaccggcuaugguacugugaccauggaguguagucccagaacagggcuggauuucaacgaaaugguauugcuccagauggaggagaaggcuuggcuggugcacaggcaaugguuuuuagaccugccucucccauggcuucccggcgccgauacccagggaagcaauuggauucagaaggaaacucuggucacauucaaaaacccucaugcgaagaaacaggacgugguuguguugggcucucaagagggggccaugcacacggcacuaaccggagcuacugaaauccagauguccucagguaaucugcucuuuacaggccaucugaagugccggcuucguauggacaaacugcaguugaaggggaugagcuacaguauguguaccggaaaguucaaaaucgucaaggagauugccgagacacaacacggcacuaucgugauucgcguacaguaugaaggugaugggucuccaugcaaaauacccuucgagaucauggaccucgaaaagagacauguucugggcagguuaauuaccgugaacccgaucgucacggagaaagauuccccugugaacaucgaagcugagcccccauuuggagacagcuacauuauaaucggcgucgagccugggcagcugaagcuaaauugguucaagaaaggaucgucuauuggucagauguuugaaaccacaaugcggggcgccaagcgaauggcaauccucggggauacugccugggacuucggaucccugggcgguguguuuaccucaauugggaaagcacuucaccaaguuuucggcgcgaucuacggagcagccuuuaguggcgugagcuggacaaugaagauauugaucgggguaauuaucacuuggauuggaaugaacucccgcucuaccagccugucagucagucucgugcugguuggcguggucacgcuuuaucugggugcuauggugcaggccgauuccggguguguagugagcuggaaaaauaaggaguugaagugcggaucuggcaucuucauaacagacaacguucacaccuggacugaacaguacaaauuucagcccgagucaccaaguaagcucgcaagcgccauucaaaaagcucaugaagaggguaucuguggcauuagauccgucacaaggcuggagaauuuaauguggaagcagaucacccccgaacugaaccacauacuaucugagaaugaagugaaacucacuaucaugaccggggauauuaagggaaucaugcaggccggcaaacggucgcugcgcccucagccaacagagcuuaaguauagcuggaagacgugggggaaagcaaagauguuguccaccgaaucacauaaccaaacuuuccugauugacggaccggagacagcggagugccccaauaccaacagagcuuggaauagucucgaaguggaggauuacggcuuuggugucuucacaacuaacaucuggcugaaauuaagggaaaagcaggacguauuuugugacucuaaacugaugagcgccgcaauaaaggauaaucgugccgugcacgcugacaugggguauuggauugaguccgcccuuaacggaaccuggaagauggagaaagcaucauucaucgaaguaaagagcugccacuggccuaaaucucauacguugugguccaauggcguacucgagagugaaaugaucauuccaaagaacuucgcuggucccgucagccagcacaacuaccggccuggcuaucauacacagaccgccgggccauggcaccugggaaaacuagagauggauuuugacuucugugaaggcacuaccgugguugugacagaggauugcgggaaucgaggacccucucugagaacuaccacagcguccggcaagcucaucacggaguggugcuguaggucaugcacccugccgccucuucgcuaccggggugaagacggguguugguacggaauggagauuagaccauugaaggaaaaagaggaaaaccuggucaauaguuuagugacugccggccauggucaaauagauaacuuuagccucggcguucuggggauggcucuuuuccuggaggagauguugaggacacgcgugggaaccaagcacgcaauccuccugguagccgucucguuugugacucuaauuacaggcaauauguccuuccgagaccuggggcgggugaucgucaugguuggagugaccaugacggaugacauuggcauggguguaacuuaucucgcucugcuugccgcauuuaaagugcgucccaccuucgcggccggguugcuguuaagaaagcucacaucuaaagaacugaugauggcuaccaucggaauaacucuucugagccagucaacaaucccugagaccauucuagaacucacagaugcccuggcauugggcaugaugguccugaagaucgugaggaacauggagaaguaccaguuagcuguuacuauuauggccaucaguugcgugcccaaugcagucauacuccugaacgccuggaaaguguccuguaccauucuugcuguugugucugucagcccacuguugcucacguccucacaacagaagacagacuggaucccucuggcgcuaaccaucaaaggccugaaucccacugccauuuuucuuaccacacucagccgcacaaguaagaaacggucuuggccacugaacgaagcaguaauggcuguggggaugguuuccauauuggccagcucgcuguuaaagaaugauaucccgaugaccggaccucucguggccgguggccugcuuacggucugcuaugugcugacagggagaucagcugacuuggagcucgagagggcagccgacguaaaaugggaagaucaggcggagauuucuggaaguucccccauccugagcauuaccaucucugaagacggcagcauguccauaaagaacgaggaggaagaacagacucuaacaauccugauucgaaccggucuucucgugaucucaggggucuucccaguuaguauucccaucacugcugccgcaugguaccugugggaagugaagaaacaacgcgccggaguguugugggaugucccuagcccacccccuguggagaaggcugaauuagaggacggcgcauaucggauaaaacagagaggcauucugggguacucucagaucggagccgguguuuauaaggagggcacauuucacaccauguggcauguaacgagaggggcggugcucaugcaccguggaaaacgcaucgaaccguccugggcugaugucaagaaggaccugauuucauacggcgguggguggaaacuugagggagaauggaaggagggcgaagaggugcagguucuggccuuggagccaggcaaaaauccccgggcagugcaaacuaagccugggcuauucaaaaccaacacaggaaccaucggugccgucagucuggauuuuagcccaggcacauccgggucucccauaguggacagaaagggaaagguagucggccucuacgguaauggggugguuacuaggucgggagcuuaugugagcgccauugcacagaccgaaaaaucaaucgaggauaacccugaaauugaggacgauaucuuccgaaagaaacggcugacgauaauggaccuucauccgggcgcuggcaagacaaaacgcuacuuacccgccauugucagagaagcgaucaagagggggcugcggacucucaucuuggccccaacccgagugguugcagcugagauggaggaagcccugagaggacucccuauucgcuaucagacacccgcuaucagggcagagcacaccggucgugaaauuguggaucugaugugucaugccacuuucaccaugcggcuucuguccccagucagagugccuaacuacaauuugauaaucauggacgaggcccacuuuacagaccccgcuaguauugcggcaaggggcuauaucucuacgcgcguagagaugggggaagccgcuggaaucuucaugacugccaccccaccgggcagccgagauccuuuuccccaguccaacgcaccaauuauggacgaggaaagagagauacccgaacggucauggaacucuggucacgagugggugacagauuucaaggggaaaaccguuugguuugucccuagcaucaaggccggaaacgacauugcugcgugccuaaggaaaaauggcaagaaagugauccaacugagucgcaagacuuucgauuccgaguacgugaagacacgugccaacgacugggauuuugucguaaccacggacauuagcgaaaugggcgcaaauuucaaagcugagagagugaucgauccacggagguguaugaagcccguuauacucacugacggggaagaacgcgugaucuuagccggaccuaugccggucacacauucuucagcagcccagcgaagaggucgggugggcaggaaccccaaaaaugaaaacgaucaguauauuuacaugggggagccacuggagaaugacgaagacugcgcucacuggaaggaggccaaaaugcuucuggauaacaucaauaccccugaaggaauuauccccuccauguuugagccagaacgcgagaagguugacgcgauagauggcgaguacagacucaggggugaagcacggaaaaccuucguggacuugaugcgucgcggggaucugccugucuggcucgccuaucgaguggcugccgagggcauuaacuacgcugacagaaggugguguuuugauggaaucaagaauaaccaaauucuggaagagaacguagagguggaaaucuggacuaaggagggcgaacggaagaaacuuaaaccccgcuggcuagacgcaagaauauauagugauccacuggccuugaaagaguucaaagaguucgcugccgggagaaagagcuuaacacugaaucucaucaccgagaugggacggcugccuacauuuaugacucagaaggcacgagacgcgcuugauaaccuggccguucuccauacggcugaggccgguggcagagcauacaaucacgcuuugucggaacugccggagacccuagaaacacugcuccuucugacuuuauuggccaccgucacagggggaauuuuccuguuucucaugucuggcaaagguaucgggaagaugacccugggcaugugcugcauuaucacugcauccauacuucugugguaugcccagauucagccccacuggaucgcugcgagcaucauucucgaguucuuuuugaucgugcuguuaauaccagaaccugagaaacaacgcacgccccaggacaaccagcuaaccuacguggucauugccauccugacaguuguggcagcuacuauggccaaugagaugggauuccucgaaaagaccaaaaaggaucuuggccuggggucaauuacaacccaggagagugaaucuaacaucuuggacauagaccugaggccagccuccgcauggacucucuaugcuguagccacaacguuugugaccccuaugcugcggcauagcaucgaaaauucaagugucaacgugagccuuacugcgauugcuaaucaagccacaguucucaugggacuggguaagggcuggcccuuguccaaaauggauaucggggugccgcuguuagcaauuggauguuacucucaggucaacccaaucacccuaaccgccgcucugcuccuucugguagcacacuacgccauuaucggcccugguuugcaggcgaaggcuacacgugaagcccagaaaagagcagccgcugggauaaugaagaaucccacuguggacggcauuacgguuaucgaucuggagccaauccccuaugacccuaaauucgagaagcaacucggacaggugaugcugcuuauuuuaugcgucacccaggugcugaugaugaggacaacuugggcccucugugaagcauugacccuggcuacaggcccgauaagcacccuaugggaggggaaccccggacgcuuuuggaauacuacgaucgccgucuccauggcgaacauuuuccggggcucauaccuggccggugcagggcuccuauuuucuaucaugaagaauacaaccaacacucgaagaggaaccggcaauauuggugaaacacugggcgagaaauggaagaguagguugaacgcucuggggaaaucggaguuccagaucuauaagaaaagcggaauacaagaaguggaucgcacucucgccaaggagggcaucaaaagaggggaaaccgaccaucacgcaguuuccagaggaucugcuaagcugcguugguuuguggagaggaacaugguaacaccagaaggcaagguggucgauuuagguugcgggcggggaggcuggucauacuauugugguggccuuaaaaauguucgcgaggugaaggggcugacgaaaggaggcccugggcaugaggaacccauuccuaugagcaccuacggauggaaccucguccgacuacaguccggcguggacguauucuucacuccacccgagaagugcgauacacuguugugugacaucggugaaaguucuccuaauccaaccauugaggccgggagaacucugagggugcucaaccuuguugaaaauuggcugaacaauaacacacaguuuugcaucaaaguguugaaucccuauaugccgagcgucauagagaagauggagacccugcaacggaaguacggaggcgcccucgugcgcaacccuuuaucaagaaauuccacgcacgaaauguacugggucaguaacgcgaccggcaauauugugagcucuguuaacaugaucuccaggaugcugaucaaucgauucacaaugaaacacaagaaagcuacuuaugagcuugauguagaccuggggucaggaacccggaacauugguauagaaagcgagacaccaaaccuagauaucauuggcaagcguaucgagaagauuaagcaggagcaugagacuucguggcacuacgaccaggaccaucccuauaagaccugggcauaccacgggucuuaugaaacaaaacagaccggaagugccuccagcauggugaauggcgucgugagacuccugacuaagccuugggauguugugccaauggucacgcaaauggcuaugacagacaccacucccuuuggucagcagcgcguguucaaagagaagguagauaccaggacacaggaaccgaaagaggggacgaagaaguugaugcggaucaccgccgaguggcuguggaaagaacucggaaagaaaaagacuccuagaauguguacacgcgaggaauuuaccaggaaagugcgaucaaacgcagcccuuggcgcuauauucacugacgagaauaaguggaaauccgcgcgggaagccguugaggauucuagauuuugggagcuggucgacagggaacgcaacuuacaccuggagggcaagugcgaaacauguguguacaauaugauggggaagcgugagaaaaaguugggagaguucgguaaagcaaagggcagccgggcuaucugguauauguggcucggggccagauuucuggaguucgaggcacuaggauuucuuaacgaagaucauugguucaguaggggcaauucccugagcgguguggagggggaaggacuccaccgccugggcuacauuuugcgagacgucucuaaaaaggagggcggggccauguacgcugaugacaccgccggaugggauacacggaucacucuggaagaccucaagaacgaggagaugguuaccaaucauaugaaaggugaacacaagaaacuugcggaggcaauuuuuaagcugacguaucaaaacaaagugguaagagugcagaggcccaccccacgcggcacagucauggacaucauuucaagacgggaucagagggggaguggacaggugggcacuuacgguuuaaauaccuucacaaacauggaagcccaacugauacgucagauggagggggagggaaucuucaaguccauucagcauuugacuguuaccgaagagaucgcugugcaaaauuggcucgcccgagucggccgcgaaagacugagccggauggcaaucucuggcgacgauugcgugguaaagccucuagacgauagguuugcuucggcccuuacggcucugaacgacauggggaaaguucgcaaggauauucagcagugggagcccucaagaggauggaaugacuggacacaggugccauucugcagccaccacuuucaugaacucgucaugaaagauggucgggugcuggugguccccuguaggaaccaagacgaguugauaggccgagcccguaucucccagggggcaggauggaguuuaaaggagaccgcgugccugggcaaaucuuaugcccagauguggacucucauguacuuccacagacgcgaucuucggcuggcugccaacgcaauuuguagcgcuguuccuucccauugggugccaacaucaaggaccacuuggaguauccacgccaagcacgaauggaugaccacagaggacaugcuagcaguauggaauagaguguggauucaggaaaacccguggauggaggauaagacgcccgucgaaucuugggaggaggugccuuaucuggguaaacgcgaagaccaauggugcgggagccucaucggauugaccucccgggccacuugggcgaagaauauacagacagcuaucaaccagguuaggucacugauuggcaaugaggaauacaccgacuauaugccaagcaugaaacgauuuagacgggaggaagaggaggccggcgugcuuugguga

SEQ ID NO: 14281 - RNA, 9876 nt, Artificial Sequence
  derived and/or modified CDS sequence (opt3) from DENV-2__JX669486__SS-prME
accgccggcgugauaauuaugcugauacccacagcuauggcuuuccaccucacuacgagaaauggggagccucauaugaucgucggaagacaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucgugcucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggagaagagauuaaaaucacgccgcaguccucaauaacagaagcagagcuuaccggcuaugguacugugaccauggaauguagucccaggacagggcuggauuucaacgagaugguauugcuccagauggaggaaaaggcuuggcuggugcaccggcaaugguuuuuagaccugccucucccauggcuucccggcgccgauacccagggaagcaauuggauucagaaagagacucuggucacauucaagaacccucaugcgaagaaacaggacgugguuguguugggcucucaagaaggggccaugcacacggcacuaaccggagcuacugagauccagauguccucagguaaucugcucuuuacaggccaucugaagugccgucuucgcauggacaaacugcaguugaaggggaugagcuacaguauguguaccggaaaauucaagaucgucaaggagauugccgaaacacaacacggcacuaucgugauuagaguacaguaugagggugaugggucuccaugcaaaauacccuucgaaaucauggaccucgagaagaggcauguucugggccgguuaauuaccgugaacccgaucgucacggaaaaagauuccccugugaacaucgaggcugagcccccauuuggagacagcuacauuauaaucggcgucgaaccugggcagcugaagcuaaauugguucaaaaagggaucgucuauuggucagauguuugagaccacaaugcgaggcgccaagcgcauggcaauccucggggauacugccugggacuucggaucccugggcgguguguuuaccucaauugggaaagcacuucaccaaguuuucggcgcgaucuacggagcagccuuuaguggcgugagcuggacaaugaagauauugaucgggguaauuaucacuuggauuggaaugaacuccagaucuaccagccugucagucagucucgugcugguuggcguggucacgcuuuaucugggugcuauggugcaggccgauuccggguguguagugagcuggaaaaauaaggaauugaaaugcggaucuggcaucuucauaacagacaacguucacaccuggacugagcaguacaaguuucagcccgaaucaccaaguaagcucgcaagcgccauucaaaaagcucaugaggaggguaucuguggcauuagguccgucacacggcuggaaaauuuaauguggaagcagaucacccccgagcugaaccacauacuaucugaaaaugaggugaaacucacuaucaugaccggggauauuaagggaaucaugcaggccggcaaacgcucgcugagaccucagccaacagaacuuaaguauagcuggaaaacgugggggaaggcaaagauguuguccaccgagucacauaaccaaacuuuccugauugacggaccggagacagcggaaugccccaauaccaacagggcuuggaauagucucgagguggaagauuacggcuuuggugucuucacaacuaacaucuggcugaaauuacgugagaagcaggacguauuuugugacucuaaacugaugagcgccgcaauaaaggauaaucgggccgugcacgcugacaugggguauuggauugaguccgcccuuaacgauaccuggaaaauggaaaaggcaucauucaucgagguaaagagcugccacuggccuaaaucucauacguugugguccaauggaguacucgaaagugagaugaucauuccaaagaacuucgcuggccccgucagccagcacaacuaccgaccugguuaucauacacagaccgccggcccauggcaccuggggaaacuagaaauggacuuugauuucugugagggaacuaccgugguugugacagaggacugcggcaauagagggcccucucugaggacuaccacagcguccggaaagcucaucacggaauggugcugucgcucaugcacccugccgccucuucgguacagaggcgaggaugguuguugguacgggauggaaauuaggccauugaaagagaaggaagagaaccuggucaauaguuuagugacugccggacauggccaaauagacaacuuuagccucgguguucugggcauggcucuuuuccuggaggaaauguugcgcacacgaguggggaccaagcacgcaauccuccugguagccgucucguuugugacucuaauuacaggaaauauguccuuccgggaucugggccgugugauggucaugguuggggugaccaugacggacgauaucggaaugggcguaacuuaucucgcucugcuugccgcauuuaaagugagacccaccuucgcggccgguuugcuguuaaggaagcucacaucuaaagagcugaugauggcuaccauugggaucacucuucugagccagucaacaaccccugaaacaauacuagagcucacugacgcccuggcauugggaaugaugguccugaagaucgugcgcaacauggaaaaauaccaguuagcuguuaccauuaugacgauccucugcgugcccaaugccgucauucugcuuaacgcauggaaggugaguuguacaauccuggccguuguguccgucucuccauugcuccugaccagcucccaacagaagacugauuggauaccucuagcucugaccauuaaaggccuuaaucccacagcgaucuuucucacuacccugucacggacgagcaagaaaagaaguuggccauugaacgaggccguaauggcagugggcaugguuucuauccuggcuuccagcuuacucaagaaugacauuccgaugacagggccucugguggccggaggucuucugaccgucugcuauguguugacuggcaggucggccgaccucgagcuggaacgagcugcagauguaaaaugggaggaccaggccgaaauaucagggucuagucccauccuauccauuacaaucagcgaggauggaucuaugagcauuaagaacgaggaagaggaacagacccugacuauccuuauacgcacaggccuccuggugaucuccggugucuucccaguuucaauucccaucaccgcggcugccugguacuugugggaggugaaaaagcaacgggcagggguguuaugggacgucccuaguccacccccuguggaaaaggccgagcuggaggauggagcuuauagaauuaaacagaggggcauccucggcuacagccagauaggggcaggaguuuauaaggaagguacguuucacacuauguggcauguaacccguggcgccgugcugaugcaccgcgggaaacggauugagccgucuugggcggacgucaagaaagaucuuaucuccuacggaggcgguuggaagcuggaaggggaguggaaggaaggagaggaggugcagguuuuggcucuagaaccaggcaaaaaucccagagccgugcaaacaaagccuggccuguucaaaaccaacacagggacuaucggagcagucucacucgacuuuaguccagguaccagcggcucccccauuguggauaggaaggggaaaguagucggacuguacggcaauggugugguuacgcgaucuggggccuaugugucggcuaucgcccagacagaaaagagcauagaagacaacccugagauugaagaugacaucuuccggaagaaacgccuuacuauuauggauuuacauccgggagcaggcaagaccaaaagauaccugcccgcuaucgucagggaggccauaaagcggggccuccgaacauugauucuggcgccaaccagagugguugccgcagagauggaagaggcucuccgcgggcugccuaucagguaucagacucccgccauccgugcugaacacaccggacgggagauuguggaccuuaugugucaugcaacauucacgaugagacuguugucaccagucagggugccuaacuacaaucuaaucauuauggacgaggcccacuuuacugaucccgccuccauagcugcgcgcgguuauaucaguacccgaguagaaaugggcgaggcagccgggauuuucaugacagcuaccccaccgggaucuagagacccuuuuccccagagcaacgccccaaucauggaugaagaacgggaaauccccgagagguccuggaacucaggccacgagugggugacugacuucaaagguaagacaguuugguuugucccuucuauuaaggcagggaacgauauagccgcuugccugcgcaaaaauggaaagaaagugauccaacucagccguaagaccuucgacagugaauacgugaaaacgagagcgaacgauugggacuuugucguaacuacagauauuuccgagaugggcgccaauuuccgggcagaaagggugaucgacccacgccgauguaugaagcccguuauuuuaaccgauggcgaggaaagagugauccuggcugggccuaugccggucacccauagcucugccgcacagcggaggggacgcguggguagaaacccaaagaaugagaacgaccaguauauauacaugggcgagccccuugaaaaugacgaggauugcgcccacuggaaagaagcuaagaugcugcucgacaacaucaauacuccugaggggauuauccccucaauguuugaaccagagagggagaaaguugaugccauugacggagaauaccgguugcguggcgaggcgcgcaagacauucguggaucugaugcgaagaggugaccucccugucuggcuggcauauaggguggccgcugaagggaucaacuacgccgaucggcgcugguguuuugacggcaucaagaauaaccaaauucuugaggagaacguagaaguggagaucuggaccaaggaaggagagaggaagaagcuaaagcccagguggcuggaugcucggauuuauuccgacccauuggcauuaaaagaguucaaggaguucgccgcuggccgaaaaagucugacacucaaucugaucacugagauggggagacuuccuacguuuaugacccagaaggcccgcaacgcacuggauaaucucgcgguuuugcauacagccgaagcuggagguagggccuacaaccacgcacugagcgagcuaccggaaacucuggagacccuccuucuguuaacauugcuggcuaccgucacuggcgggauauuccucuuucugaugucgggaaaaggcaucgguaagaugacgcuugggaugugcugcauuaucaccgccucugugcugcucugguaugcacagauucagccccacuggaucgccgcuuccauaauuuuggaguucuuucugaucguguuacuaaucccagagccugagaagcaacggacaccccaggacaaucagcugacuuacgucguuauugcgauccucaccgugguagccgcaacaauggcuaacgaaaugggcuuccuugagaaaaccaagaaagaucugggauugggcagcauaacuacacaggaaucagagaguaauauucuggacaucgaccuccguccagccucugccuggacgcuguaugcaguggcuaccacuuuugucacaccuaugcuuagacauuccauugaaaacagcucagugaauguuagucucaccgccaucgcgaaccaagcuaccgugcugaugggguugggaaaggguuggccccugagcaaaauggauauaggcgucccguuacuagccaucggguguuacucccagguaaauccaauuacacugacugcagcccuccuucuguugguggcucacuacgcaaucauuggaccuggccugcaggccaaggcgacgagggaggcucagaagcgcgccgcagccgguaucaugaaaaaccccaccguugacgggauuacaguggucgaucucgagccaauccccuaugacccuaaguucgaaaaacaacugggccaggugaugcuuuuaauacugugcgucacucaggugcucaugaugcggaccacaugggcuuugugugaggcccugacccuagcaacuggaccgauuucuacgcugugggaaggcaaucccgggcgauuuuggaacacaaccaucgcuguuagcauggccaauaucuucagaggauccuaccucgcgggcgccggucuucuguuuucaauuaugaagaacacuaccaauacaaggcgcgggacuggaaacauaggcgagaccuugggugagaaauggaagucucggcugaacgcacucggcaagagugaguuccagaucuauaaaagaucggggauucaagagguggaucguacacuggcuaaggaaggaaucaaaaggggcgagacggaccaucacgccguaagccggggguccgcaaaguuacgcugguuuguggaacgaaauauggucaccccagagggaaaaguuguggaucuuggcugcgguagagggggauggucuuacuauuguggcggucugaagaacgucagggaggugaaaggccucacuaaagggggaccuggccaugaggaacccauuccuaugucaacauacggguggaaucuaguacggcugcagagcggaguggacguuuucuucaccccacccgaaaagugcgauacuuugcugugugacaucggcgaguccaguccuaacccaacaauagaagcuggucgcacccucagagugcuuaaucuggucgagaacugguugaauaacaauacgcaguuuugcaucaaagugcugaaccccuauaugccgucugucauugagaagauggaaacccuccaaaggaaauacgggggagccuuagugcgaaauccucugagccggaacucaacacacgagauguacuggguuuccaaugccacuggcaacaucguaaguagcgugaauaugauuucucguaugcuuaucaacagauucaccaugaagcacaaaaaggcgacauaugaaccagaugucgaccugggcuccgggacucgcaacauaggaauugagucagaaauccccaaucuagauaucauugguaagaggauagagaaaaucaagcaggagcaugaaaccagcuggcacuacgaccaggaccauccuuauaaaacaugggcuuaccacggcucguaugagaccaagcagacugggucugcaaguuccauggugaacggaguugugcggcuccugacgaaaccaugggaugucgugcccaugguaacacaaauggccaugaccgacacuaccccguuuggccagcagagaguguucaaggaaaagguugauacacgcacgcaggagccuaaagaggguaccaagaaauugaugaggauuacugcugaauggcuguggaaggagcucgggaaaaagaagacaccccgaauguguacccgggaagaguuuacuagaaaagucaggagcaaugccgcacuuggagccaucuucacagacgaaaacaaguggaaaucagcucgcgaggcgguggaggauucccguuuuugggaacugguggaccgggagagaaauuuacaccuggaaggcaagugcgagaccugugucuacaacaugaugggcaaaagggaaaagaaauugggggaguucggaaaggccaaggguucucgcgcaauuugguauauguggcucggcgcucgauuucuggaguucgaagcccuaggguuucuuaaugaggaucauugguucagccggggaaacagucuguccggcguugaaggugaggggcuccacagacugggauacaucuugagggacgugagcaaaaaggaaggcggcgcaauguacgccgaugacacagcugggugggauacucgcauaacccuggaggaccucaaaaaugaggaaaugguaacgaaccauaugaagggagagcacaagaaacuugccgaagcgguguuuaaacugaccuaucaaaauaaagucgugagaguucagcggccaacaccuagggguacugugauggacaucauuucucgucgagaucagcgcggcucagggcaggucggaaccuacggcuuaaacacauucacuaauauggaggcacaacugaucagacagauggagggugaagggauuuucaagaguauccagcauuugaccgugacggaggaaauugccguacaaaacuggcucgcucggguuggaagggagcgccuguccagaauggccauaagcggcgacgauugcguggucaaaccccuagacgaucgguuugcaucugcucuuacagcccugaaugacaugggcaaggugaggaaagauauccagcagugggaaccaucgcgaggguggaacgacuggacccaggugcccuucugcucacaccacuuucaugagcucgucaugaaggauggacguguucuggugguaccuuguagaaaccaagacgaguugauuggucgcgcucggaucagccagggcgccgggugguccuuaaaggaaacugcaugccugggaaaaaguuaugcgcagauguggacacucauguacuuccacaggagagaucuucgccuggccgcuaaugccaucuguucugcagugccaagccauugggucccgaccucccggacuaccuggucaauucacgcuaagcacgaguggaugacaacggaagacaugcuagccguguggaacaggguuuggauacaggagaaucccuggauggaagauaaaaccccuguggagaguugggaggaagucccauaucugggcaagcgagaggaccaauggugcgguucucucaucggguugacuagcagagcaacaugggccaaaaacauucagaccgcgaucaaucaggugcggucccugauuggaaacgaagaguacacugacuauaugcccucaaugaagagguuucgccgugaagaggaggaagcuggcguacuuugguga

SEQ ID NO: 14282 - RNA, 9876 nt, Artificial Sequence
  derived and/or modified CDS sequence (opt3) from DENV-2__JX669487__SS-prME
accgcaggcgugaucauuaugcugauaccaacggcuauggcuuuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuucuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauaaugaucaccccacacagcggugaggagcaugccgucggcaaugacacugggaagcacggaaaagaaauuaagaucacgccgcaguccucaauaacagaggcagaacuuaccggcuaugguacuguuaccauggaguguagucccaggacagggcuggauuucaacgaaaugguguugcuccagauggaggagaaggcuuggcugguacaccggcaaugguuuuuagaccugccucucccauggcuucccggcgccgauacccagggaagcaauuggauucagaaggaaacucuggugacauucaagaacccucaugcgaaaaagcaggacgucgugguuuugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgugaaagagauugccgagacacaacacggcacuaucgucauuagagugcaguaugaaggugaugggucuccaugcaagauacccuucgagaucauggaccucgagaagaggcauguacugggccgguuaauuaccguuaacccgaucgugacggagaaggauuccccugucaacaucgaagcugagcccccauuuggagacagcuacauuauaaucggcguggagccugggcagcugaaacuaaauugguucaagaagggaucgucuauuggucagauguuugaaaccacaaugcgaggcgccaaacgcauggcaauccucggggauacugccugggacuucggaucccugggcggugucuuuaccucaauugggaaggcacuucaccaaguguucggcgcgaucuacggagcagccuuuaguggcguuagcuggacaaugaaaauauugaucggggugauuaucacuuggauuggaaugaacuccagaucuaccagccugucaguaagucucguccuggugggcguugugacgcuuuaucugggugcuaugguccaggccgauuccgggugugugguaagcuggaagaauaaagaguugaagugcggaucuggcaucuucauaacagacaacgugcacaccuggacugaacaguacaaguuucagcccgagucaccaaguaaacucgcaagcgccauucaaaaggcucaugaagaggguaucuguggcauuagguccguuacacggcuggagaauuuaauguggaaacagaucacccccgaacugaaccacauacuaucugagaaugaagucaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuugguguguucacaacuaacaucuggcugaaguuacgugaaaaacaggacgucuuuugugacucuaagcugaugagcgccgcaauaaaagauaaucgggccguucacgcugacaugggguauuggauugaguccgcccuuaacgauaccuggaagauggagaaggcaucauucaucgaagugaaaagcugccacuggccuaagucucauacguugugguccaauggagugcucgagagugaaaugaucauucccaaaaauuucgcuggccccguaagccagcacaacuaccgaccugguuaucauacacagaccgccggcccauggcaccuggggaagcuagagauggacuuugauuucugugaaggaacuaccgucgugguuacagaggacugcggcaauagagggcccucucugaggacuaccacagcguccggaaaacucaucacggaguggugcugucgcucaugcacccugccgccucuucgguacagaggcgaagaugguuguugguacgggauggagauuaggccauugaaggaaaaggaggaaaaccuggugaauaguuuagucacugccggacauggccaaauagacaacuuuagccucggugugcugggcauggcucuuuuccuggaggagauguugcgcacacgaguugggaccaaacacgcaauccuccugguggccguaucguuugucacucuaauuacaggaaauauguccuuccgggaucugggccgugugauggugauggucgggguuaccaugacggacgauaucggaaugggcgugacuuaucucgcucugcuugccgcauuuaagguaagacccaccuucgcggccgguuugcuguuaaggaaacucacaucuaaggaacugaugauggcuaccauugggaucgcccuucugagccagucaacuauaccugagacaauccuagaacucaccgacgcacuggcuuugggaaugauggugcugcgcauuguccggaacauggagaaauaccaguuagccgugacaaucauggcaauuaguugcguucccaaugccgugauccuccugaacgcuuggaaggucuccuguacuauacuugcggccgugucuguuagcccacuguugcucaccuccucacaacagaagacggauuggauuccucuggcacuaacaaucaaaggccugaaucccaccgcuaucuuucuuacuacccucagcagaacaaguaagaaaaggucuuggccacugaacgaagccgugauggccgucggcaugguauccauuuuggcuagcucgcuguuaaagaaugacauaccgaugacugggccucucguggcaggaggucugcuuaccguuugcuaugugcugacgggccgaucagccgacuuggagcucgagcgcgcggcugaugucaaaugggaagaccaggccgagaucucugggaguucccccauucugagcaucacaauuucugaagauggaagcauguccaucaagaacgaggaggaagaacagacccuaacuauacugauccggacaggccuucucgugauuucagguguauucccagugaguauccccauuaccgcagccgcuugguaccugugggaagucaaaaagcaaagagcagggguuuugugggacgugccuagcccacccccuguggagaaggccgaauuagaggauggagcguauaggaucaaacagcguggcauacugggcuacucucagauuggggcuggagucuauaaggaggguacuuuucacacaauguggcaugugacccgcggcgccguucucaugcaccgggggaaaagaaucgaaccguccugggcagacguaaagaaagaucugaucucauacggaggcgguuggaaacuugagggggaauggaaggagggagaagaggugcagguccuggccuuggagccaggcaaaaaucccagggcugugcaaacgaagccuggccuauucaaaacuaacaccgggacaauuggagccaucagucuggacuuuagcccagguaccuccggcucucccauaguugaucgaaaggggaaaguggucggacucuacggcaauggugugguaacacggucgggggcauaugucagcgcuauugcccagacugaaaagucaaucgaggacaacccugaaauugaggaugacaucuuccgcaagaaaagacugaccauaauggaucuucauccgggagcgggcaagacgaaaagguacuuacccgccauugugcgggaagcaaucaagcgaggccugagaacacucaucuuggcuccaacucgcguuguggccgcugagauggaggaagcacugagggggcucccuauucguuaucagacccccgccauccgggccgagcacacaggaagagaaauugucgaccugaugugucaugcuaccuucacuaugaggcuucuguccccagugcgcguuccuaacuacaauuugauaaucauggacgaggcgcacuuuaccgaucccgcaaguauugccgcucgagguuauaucucuacaagaguggagaugggcgaagccgcagggaucuucaugacggccacuccaccgggaagccgggacccuuuuccccaguccaacgcuccaauuauggaugaggaaagggagauacccgaacgcucauggaacucuggccacgagugggucaccgacuucaaagguaagacagugugguuuguaccuagcaucaaggcggggaacgauauugccgcaugccuacguaaaaauggaaagaaagugauccaacugaguagaaagaccuucgacuccgaguacguuaaaacucgggcuaacgauugggacuuugucgugacaaccgauauuagcgaaaugggcgccaauuucagggcagagcgcgugaucgacccacgaagauguaugaagcccgucauacucacggauggcgaagaacggguaaucuuagccgggccuaugccggugacucauucuucagcugcccagaggcgcggaagaauugguaggaacccaaagaaugaaaacgaccaguauaucuacaugggcgagccccuggagaaugacgaagauugcgcgcacuggaaagaggcaaagaugcuucuggacaacauuaauacaccugaagggaucauacccuccauguuugagccagaacgggagaaaguugaugccauugacggagaguaccgucuccgcggcgaagcucgaaagaccuucguggauuugaugagaaggggugaccugccugucuggcucgccuaucggguggcugcagaggggaucaacuacgccgaucgcagaugguguuuugacggcauuaaaaauaaccaaauccuggaagagaacguugagguggaaauauggaccaaggagggagaaaggaagaaacuuaaaccccgguggcuagaugcucgaaucuauagugacccacuggccuugaaagaguucaaggaguucgcagcgggcagaaagagcuuaacucugaaucucauuacagagauggggcgccugccuaccuuuaugacacagaaggccagggaugcucuugacaaccuggccguccuccauacugcagaggcuggaggucgggccuacaaacacgcauugucggaacugccggagacgcuagaaacccugcuccuucugacauuauuggccacugugaccggcgggaucuuccuguuucucaugucuggaaagggcauugguaagaugacacuggggaugugcugcaucauaaccgcuuccauucuucugugguaugcgcagauccagccccacuggaucgccgcaagcauuauccucgaguucuuuuugauaguacuguuaauuccagaaccugagaaacaacguacuccccaggauaaucagcuaacguacgugguuaucgcuauucugaccgucguggccgccacaauggcaaacgagaugggcuuccucgaaaagacuaaaaaggaccuuggacugggcucaaucaccacacaggagagugaaucuaauauauuggacaucgaucugagaccagcuuccgccuggacccucuaugcgguggcuacuacauuugucacgccuaugcugaggcauagcauugagaacucaaguguuaaugugagccuuaccgccaucgcaaaccaagccacuguacucauggggcugggaaaagguuggcccuuguccaagauggacauuggcgugccgcuguuagcuaucggguguuacucucaggucaauccaauuacacuaaccgcagcccugcuccuucugguggcgcacuacgcuaucauaggaccuggcuugcaggccaaggcaacccgcgaagcccagaaacgggcugccgcagguauuaugaagaaccccacaguugaugggaucacugugaucgaccuggagccaauucccuaugauccuaaauucgagaagcaacucggccaggucaugcugcuuauauuaugcguaacacaggugcugaugaugcgaaccacaugggcucucugugaagccuugacucuggcgaccggaccgaucagcacacuaugggagggcaaucccgggagauuuuggaacaccacuauugccguuuccauggcaaauaucuucaggggaucauaccuggcuggcgccggucuccuauuuucuauuaugaaaaacacgacaaauacccgccgggggacuggaaacaucggcgaaacccugggugagaaguggaagaguagauugaaugcacugggcaaaucggaguuccagauauauaagaaaagcgggauccaagaaguggaccguacacucgcuaaggagggaauuaaaaggggcgaaacugaucaucacgccgucucccgggggucugccaagcugcgcugguuuguggagcgaaacauggucaccccagaaggaaaagugguugacuuaggcugcgguagagggggauggucauacuauuguggcggucuuaagaacgugagggagguaaagggccugacaaaagggggaccuggccaugaggaacccaucccuaugagcacguacggguggaaucucgugcggcuacaguccggagucgauguuuucuucaccccacccgagaagugcgacacucuguugugugauauuggcgaaaguucuccuaacccaacaaucgaggcgggucgcacccugagagugcucaaucuugcugaaaacuggcugaauaacaauacucaguuuugcauaaaagucuugaaccccuauaugccgagcgugauugagaagauggagacacugcaaaggaaauacgggggagcacucguacgaaauccuuuaucacggaacuccacccacgaaauguacugggugaguaaugccacgggcaacaucguuagcucugugaauaugaucucccguaugcugauuaacagauucaccaugaagcacaagaaagcuacauaugagccagacgucgaucuuggcucagggacucgcaauauaggaaucgaaagcgagauucccaaccuggacaucauugguaagaggaucgagaaaauaaagcaggagcaugagaccucguggcacuacgaccaggaucauccuuauaaaacaugggccuaccacggcucuuaugaaacuaagcagaccgggagugcauccagcauggugaacggagucgugcggcuacucacaaagccaugggacguuguacccauggugacccaaauggccaugacugauacgacaccguuuggccagcagagagucuucaaagagaagguggacacccgcacucaggaaccuaaagaggguaccaagaaacugaugaggaucacagcugagugguuguggaaggaacuggggaagaaaaagacgccccgaauguguacccgggaggaauuuacuagaaaaguuaggucaaaugcggcccucggagcaauuuucacagaugagaacaaguggaaauccgcucgcgaagccguggaggacucucguuuuugggagcuugucgaucgggaaagaaaucugcacuuagagggcaagugcgaaaccuguguguacaacaugaugggcaaaagggagaagaagcugggggaguucggaaaagcaaaggguagccgcgccaucugguauaugugguugggcgcucgauuucucgaguucgaggcccugggguuucuaaaugaagaccauugguucagucggggaaacucccuuagcggcguagagggugaagggcugcacagacucggauacauucugagggaugugucuaaaaaggagggcggcgcgauguacgcagacgauacugccgggugggacacacgcaucaccuuggaagaccugaaaaaugaggagaugguuacaaaccauaugaagggagaacacaagaaacucgcugaggccauuuuuaaacuuacuuaucaaaauaaagucgugagagugcagcggccaaccccuagggguacggucauggauauaaucucacguaaggaccagcgaggcagugggcagguuggaaccuacggccugaacacauucacuaauauggaagcacaauuaauucgccagauggagggugaggggaucuucaaauccauccagcaucugaccgugacagaagagauugcuguacaaaacugguuggccagagugggacgggaaaggcucagccgcauggcuauaucuggcgaugacugcgucgugaagccccuggaugacagauuugccucggcacuaacugcgcuuaaugauaugggcaagguucggaaagacauccagcagugggagccaucaaggggguggaacgauuggacccaggugcccuucugcagccaccacuuucaugaacuggucaugaaggacggacgagugcucguaguuccuugucguaaucaagaugagcugauugguagagcccgcaucucccagggcgcuggguggaguuugaaagagacggccugcuuaggaaagucuuaugcacagauguggacacugauguacuuccaccggagggaccucagacuugcugccaacgcaauuuguagcgccgugccaucccauugggucccgaccucacgcacuacauggaguauccacgcgaaacacgaauggaugaccacugaggauaugcuggcuguguggaaccggguguggauacaggaaaaucccuggauggaggacaagaccccugucgaaucuugggaggagguuccauaucuaggcaagagggaagaccaauggugcgguagccugaucgggcucacaucccgagccacgugggccaaaaacauucagaccgccaucaaucaggugagaucauugauuggaaacgaggaauacacugauuauaugcccagcaugaagcgguuuaggcgcgaggaagaggaggcuggcguacugugguga

SEQ ID NO: 14283 - RNA, 9876 nt, Artificial Sequence
  derived and/or modified CDS sequence (opt3) from DENV-2__JX669488__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagagcaggacaaacgauuuaucugcaagcauucuaugguggauagaggcugggguaacggguguggacuauucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaagcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgaaaaaaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcucuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuuggugucuucacaacuaacaucuggcugaaguuacgugaaaaacaggacguuuuuugugacucuaagcugaugagcgccgcaauaaaagauaaucgggccgugcacgcugacaugggguauuggauugaguccgcccuuaacgauaccuggaagauggagaaggcaucauucaucgaagugaaaagcugccacuggccuaagucucauacguugugguccaauggaguacucgagagugaaaugaucauuccaaaaaacuucgcuggccccgucagccagcacaacuaccgaccugguuaucauacacagaccgccggcccauggcaccuggggaagcuagagauggacuuugauuucugugaaggaacuaccgugguugugacagaggacugcggcaauagagggcccucucugaggacuaccacagcguccggaaaacucaucacggaguggugcugucgcucaugcacccugccgccucuucgguacagaggcgaagaugguuguugguacgggauggagauuaggccauugaaggaaaaggaggaaaaccuggucaauaguuuagugacugccggacauggccaaauagacaacuuuagccucgguguucugggcauggcucuuuuccuggaggagauguugcgcacacgaguggggaccaaacacgcaauccuccugguagccgcuucguuugucacucuaauuacaggaaauauguccuuccgggaucugggccgugugauggugauggucggggccaccaugacggacgauaucggaaugggcguuacuuaucucgcacugcuugcggccuuuaaggugagacccaccuucgcugccgguuugcuguuaaggaaacucacaucuaaggaacugaugauggcaaccauugggaucgcucuucugagccagucaacuauaccugagacaauccuagaacucaccgacgcccuggcauugggaaugaugguacugcgcauugugcggaacauggagaaauaccaguuagccgucacaaucauggcuauuaguugcgugcccaaugcgguuauccuccugaacgccuggaagguguccuguacuauacuugcagcugucucugugagcccacuguugcucaccuccucacaacagaagacggauuggauuccucuggcccuaacaaucaaaggccugaaucccaccgccaucuuucuuacuacccucagcagaacaaguaagaaaaggucuuggccacugaacgaagcuguuauggcagugggcauggucuccauuuuggccagcucgcuguuaaagaaugacauaccgaugacugggccucucguagcgggaggucugcuuaccgugugcuauguucugacgggccgaucagcugacuuggagcucgagcgcgccgcagaugugaaaugggaagaccaggccgagaucucugggaguucccccauucugagcaucacaauuucugaagauggaagcauguccaucaagaacgaggaggaagagcagacccuaacuauacugauccggacaggccuucucgucauuucagguguguucccaguaaguauccccauuaccgcugcagccugguaccugugggaagugaaaaagcaaagagcgggggucuugugggacguuccuagcccacccccuguggagaaggcugaauuagaggauggagccuauaggaucaaacagcguggcauacugggcuacucucagauuggggcaggaguguauaaggaggguacuuuucacacaauguggcaugucacccgcggcgccgugcucaugcaccgggggaaaagaaucgaaccguccugggcugacguuaagaaagaucugaucucauacggaggcgguuggaagcuugagggggaauggaaggagggagaagagguacaggugcuggccuuggagccaggcaaaaaucccagggcaguccaaacgaagccuggccuauucaaaacuaacaccgggacaauuggagcuaucagucuggacuuuagcccagguaccuccggcucucccauaguggaucgaaaggggaaaguugugggacucuacggcaauggugucgugacacggucgggggccuauguaagcgcgauugcccagacugaaaagucaaucgaggacaacccugaaauugaggaugacaucuuccgcaagaaaagacugaccauaauggaucuucauccgggagcaggcaagacgaaaagguacuuacccgcuauuguccgggaagccaucaagcgaggccugagaacacucaucuuggcuccaacucgcgugguugcagccgagauggaggaagcccugagggggcucccuauucguuaucagacccccgcuauccgggcggagcacacaggaagagaaauuguggaccugaugugucaugcaaccuucacuaugaggcuucuguccccaguccgcgugccuaacuacaauuugauaaucauggacgaggcccacuuuaccgaucccgcuaguauugccgcacgagguuauaucucuacaagaguugagaugggcgaagccgcugggaucuucaugacggcgacuccaccgggaagccgggacccuuuuccccaguccaacgccccaauuauggaugaggaaagggagauacccgaacgcucauggaauucuggccacgagugggugaccgacuucaaagguaagacagucugguuugugccuagcaucaaggcagggaacgauauugcugccugccuacguaaaaauggaaagaaaguaauccaacugaguagaaagaccuucgacuccgaguacgugaaaacucgggcaaacgauugggacuuuguugucacaaccgauauuagcgaaaugggcgccaauuucagggcugagcgcgugaucgacccacgaagauguaugaagcccgugauacucacggauggcgaagagcgggucaucuuagccgggccuaugccgguaacucauucuucagcggcacagaggcgcggaagaauugguaggaacccaaagaaugaaaacgaccaguauaucuacaugggcgagccccuggagaaugacgaagauugcgcccacuggaaagaggcuaagaugcuucuggacaacauuaauacaccugaagggaucauacccuccauguuugagccagaacgggagaaaguggaugccauugacggagaguaccgucuccgcggcgaagcucgaaagaccuucguugauuugaugagaaggggugaccugccuguguggcucgcauauaaagucgccgcugaggggaucaacuacgccgaucggcgcugguguuuugacggcauuaagaauaaccaaauccuggaagagaacguggagguugaaauauggaccaaagagggagaaagaaagaagcuuaaacccagguggcuagaugcacggaucuauagugacccacuggcguugaaggaguucaaagaauucgccgcuggccgaaagagcuuaacucugaaucucauuacagagauggggagacugccuaccuuuaugacacagaaagcccgcgaugcacuugacaaccuggcugugcuccauacugccgaggcaggagguagggccuacaagcacgcuuugucggaacugccggagacgcuagaaacccugcuccuucugacauuauuggcgacugucaccggcgggaucuuccuguuucucaugucuggaaagggcauugguaaaaugacacuggggaugugcugcaucauaaccgccuccauucuucugugguaugcacagauccagccccacuggaucgcugccagcauuauccucgaguucuuuuugauagugcuguuaauuccagaaccugagaagcaacggacuccccaggauaaucagcuaacguacguagugaucgccauucugaccguugucgcagcuacaauggccaacgagaugggcuuccucgaaaaaacuaagaaagaccuuggacugggcucaaucaccacacaggagagugaaucuaauauauuggacaucgaucugcguccagcguccgcuuggacccucuaugccguggcaacuacauuugugacgccuaugcugagacauagcauugagaacucaagugucaauguuagccuuaccgccaucgcuaaccaagcaacugugcucauggggcugggaaaggguuggcccuuguccaagauggacauuggcguaccgcuguuagccaucggguguuacucucaggugaauccaauuacacuaaccgcggcucugcuccuucuggucgcccacuacgcaaucauaggaccuggcuugcaggccaaagcuaccagggaagcccagaagcgcgcagcugccgguauuaugaaaaaccccacaguggaugggaucacuguuaucgaccuggagccaauucccuaugauccuaaguucgagaaacaacucggccaggugaugcugcuuauauuaugcgucacgcagguacugaugaugcggaccacaugggcgcucugugaagccuugacucuggcaaccggaccgaucagcacacuaugggagggcaaucccgggcgauuuuggaacaccacuauugcuguguccauggccaauaucuucagaggaucauaccuggcaggcgcuggucuccuuuuuucuauuaugaagaacacggccaauacaaggcgcgggaccggaaacaucggcgaaacucugggugagaaguggaaaagucgguugaaugcccugggcaagucggaguuccagauauauaaaaagagcgggauccaagaaguugacagaacccucgcgaaagagggaauuaagcguggcgaaacagaucaucacgcuguguccagggggucugcaaaacugcggugguuugucgagcgcaacauggugacuccagaaggaaaggucguggacuuaggcugcggucgagggggauggucauacuauuguggcggucuuaagaacguuagagaggugaaaggccugaccaaggggggaccuggccaugaggaacccaucccuaugagcacauacggguggaaucucguaaggcuacaguccggaguggaugucuucuucacgccacccgagaaaugcgacacccuguugugugauauuggcgaaaguucuccuaacccaacuaucgaggccggucggacacugcgcguucucaaucuugcugaaaacuggcugaauaacaauacccaguuuugcauaaagguguugaaccccuauaugccgagcgucauugagaaaauggagacucugcaaagaaaguacgggggagcccucgugaggaauccuuuaucacgaaacuccacacacgaaauguacuggguaaguaaugcaaccggcaacaucgugagcucuguuaauaugaucucccggaugcugauuaaccguuucacgaugaagcacaaaaaggccaccuaugagccagacguggaucuuggcucagggacaagaaauauaggaaucgaaagcgagauucccaaccuggacaucauugguaaacgcaucgaaaagauaaaacaggagcaugagacuucguggcacuacgaccaggaucauccuuauaagaccugggcuuaccacggcucuuaugaaacaaagcagacugggagugcguccagcauggucaacggaguggucaggcuacucaccaaaccaugggacgugguucccaugguaacacaaauggccaugaccgauacuacgccguuuggccagcagcggguguucaaggagaaagucgacacaagaacccaggaaccuaaggaggguacuaaaaagcugaugcgcaucaccgcagagugguuguggaaggaacuggggaaaaagaaaacacccaggauguguacgcgagaggaauuuacccggaaggugagaucaaaugcugcccucggagcaauuuucacugaugagaacaaauggaaguccgccagggaagcuguugaggacucucgcuuuugggagcuuguggaucgugaacggaaucugcacuuagagggcaaaugcgaaacaugugucuacaacaugaugggcaagagagagaagaaacugggggaauucggaaaggccaaagguagcagggcgaucugguauaugugguugggcgcacgcuuucucgaguucgaggcccugggguuucuaaaugaagaccauugguucagucgaggaaacucccuuagcggcguggagggugaagggcugcaccggcucggauacauucugagagauguaucuaagaaagagggcggcgcuauguacgccgacgauaccgcagggugggacacuaggaucacauuggaagaccugaagaaugaggagauggugaccaaccauauggaaggagagcacaagaaacucgcugaagccauuuuuaagcuuacauaucaaaauaaaguuguccgcgugcagagaccaacuccucgggguaccgugauggauauaaucucaaggaaggaccagcguggcagugggcaggucggaacguacggccugaacaccuucacaaauauggaggcucaauuaauucgacagauggagggugaagggaucuucaaauccauccagcaucugacuguuaccgaggaaauugccgugcaaaacugguuggcacgcguaggaagagagcggcucagcaggauggcgauaucuggcgaugacugcguggucaagccccuggaugaccgcuuugccucggcucuaacagcccuuaaugauaugggcaaggugagaaaagacauccagcagugggaaccaucacggggguggaacgauuggacucagguucccuucugcagccaccacuuucaugagcuggugaugaaggacggaaggguccucgugguaccuugucgaaaucaagaugagcugauuggucgugcaagaaucucccagggcgcuggguggaguuugaaagaaaccgccugcuuaggaaagucuuaugcacagauguggacgcugauguacuuccaccgccgggaccucaggcuugccgcgaacgcuauuuguagcgccguuccaucccauugggugccgacaucaagaaccacuuggaguauccacgcaaaacacgaguggaugacaaccgaagauaugcuggccgucuggaaccgcguguggauacaggagaaucccuggauggaagacaagacuccuguggagucuugggaggaagucccauaucuaggcaagcgggaggaccaauggugcgguagccugaucgggcucaccuccagggcuacaugggccaaaaacauucagacggcaaucaaucagguucgaucauugauuggaaacgaagaguacaccgauuauaugcccagcaugaagagauuucggagggaagaggaggaagcuggcgugcugugguga

SEQ ID NO: 14284 - RNA, 9876 nt, Artificial Sequence
  derived and/or modified CDS sequence (opt3) from DENV-2__JX669479__SS-prME
accgccggagugaucguaaugcugauucccacagcuauggcauuccaccucacuacgagaaauggggaaccucauaugauaguuggaaggcaggaaaaggguaaaucccuucuguuuaagaccgaagacggcgugaauaugugcacauugauggccaucgauuuaggggaacugugugaggacacuauuaccuacaaaugcccacuccuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagagcgagaaccucgaauacaccauagucaucacuccucacuccggugaggagcaugcuguuggcaaugacacggggaagcacggaaaagaaauuaagaucacaccacagucaaguaccacugaggccgaacugaccggcuaugguacagugaccauggaguguagcccgaggacugggcuugauuucaacgaaaugguacuguugcaaauggaggacaaagcauggcucgugcaccggcagugguuucuggauuuaccccugccuuggcucccaggcgcugacacacagggaucuaauuggauacagaaggagacgcuugucaccuucaagaacccccaugccaaaaagcaagacgugguugugcugggcucccaggaaggggcgaugcacacugccuugacaggagcaaccgagauucagaugucaagcgguaaucuacuguuuacaggccaucucaaaugccgucugcgcauggauaaacuucaacugaaagggaugaguuacucuauguguacuggaaaguucaagaucgucaaagaaaucgcugagacccagcacggcacgauugugaucagaguacaguaugagggugacggguccccuugcaagauuccauucgaaauaaccgauuuggagaaaaggcauguucucggccggcugaucacagugaaccccauugucacugaaaaggacagcccggugaacaucgaggccgaaccucccuuuggagauucguacaucauugucggcguggagccagggcaguuaaaacugaauugguucaagaagggaucuuccauaggucaaauguuugagaccacaaugcgaggcgcuaaacgcauggccauccuaggggacacugcaugggauuucggaucacucggcgguguuuuuaccaguauugggaaggcccugcaccagguguucggcgcuaucuacggagcggcauuuagcggcguauccuggacgaugaaaauucuuaucggggucauaaucacauggauuggaaugaacucuagaagcaccucauugagugugucccugguucucgugggcgucgugacucuguaucuuggugccaugguacaggcugacagcggguguaucgugucuuggaagaauaaagaacugaagugcggaucaggcauuuucaucacagauaacguucacaccuggacugagcaguacaaguuucaaccugaaagucccagcaaauuggccuccgcaauacagaaggcccaugaggaagguauuuguggcaucaggucugucacccggcucgagaaucugauguggaaacagauuacaccagaguuaaaccacauccugucggaaaaugaggugaagcuaacgauaaugaccggggacaucaaaggaauuaugcaggcuggcaagcgcagccucagaccccaaccuacugaacugaaauauuccuggaagacaugggggaaggccaaaaugcuuucaaccgagagucauaaccagacauucuugaucgauggaccagaaacugcagagugcccgaauaccaacagggcguggaacucucuggagguggaagacuacggcuuuggugucuucacgacaaacauuuggcucaagcugcgugagaaacaggacguauuuugugauagcaaguuaauguccgcugccaucaaagacaaucgggcagugcacgccgauaugggguauuggauagaaucagcucugaacgacaccuggaagauggagaaggccagcuucauugaggugaaaucuugccacuggcccaagucccauacucuuuggaguaauggaguauuggaaagcgagaugaucaucccuaaaaacuucgcaggcccagucucucagcacaacuaccgacccgguuaucauacccaaacagcuggcccuuggcaccucgggaagcuggaaauggauuuugacuucugugagggaacuaccgugguugugacagaagauugcggcaauagagggccaucccuaaggacgaccacugccucaggaaaacugauuacagaguggugcugucgcaguugcacccuacccccgcugcgguacagaggcgaggacgguuguugguacgggauggaaaucaggccucuuaaggagaaggaagagaacuuggucaauagccuggugacugcgggacauggccagauugauaacuuuucguuagguguucucggcauggcccuguuccuugaagagaugcugcgcacacgaguggggaccaaacacgcuauauugcucguagcacuguccuuugucacgcuaaucacuggaaauaugucuuuccgggaccugggccgugugauggugauggucggggccaccaugacagaugacauuggaaugggcguuaccuaucucgcucugcuugccgcauuuaaggugagaccaacuuucgcggccgguuugcuguuaaggaaacucacaagcaaggagcugaugauggcuaccaucgggauugcccuucugucacagaguacacuacccgaaacuauccucgagcugaccgaugcauuggcucugggaaugauggccuuaaaaauaguacgcaacauggaaaaguaccaacucgcagugacgaucauggccauuuccugcgucccuaaugcugugauccugcagaacgcguggaagguuucuuguacaauucuugccgcagugagcgucagcccccuguugcucaccucaagccagcagaaagcugacuggaucccacuggcccuaacuauaaagggccugaauccuaccgccauuuuucuuacaacucucagucggaccucuaaaaagagauccuggccccugaacgaggcuaucauggcagugggcaugguuagcaucuuggccucgucacugcuaaagaaugacauuccaaugacggggccgcucguggcgggaggucugcuuacagucugcuauguacugaccggcaggucugcugauuuggaacucgagcgagccgcagacgugaagugggaggaucaagccgaaauaaguggguccagcccuauccugucuauuacuaucagcgaggacggauccaugucaauuaaaaacgaagaggaggaacagacacuaaccauccugauacgcacuggccuucucguuaucagugguguguuccccgucagcauuccaaucacagcugcagccugguaccugugggaggugaagaagcagcgggcggggguauugugggaugugcccucuccuccacccgucgaaaaagcugaguuagaagacggagccuauagaauuaagcagaggggcauccugggcuacucccaaauaggggcaggaguuuauaaagaggguaccuuucacacgauguggcaugugacucguggcgccgugcucaugcaccgcgggaagcggauugagccuucaugggcugaugucaaaaaggaccugaucaguuacggaggcgguuggaaacuugaaggggaguggaaagaaggagaggaagugcagguucuggccuuggagccgggcaagaauccaagagcaguacagaccaaacccggcaucuucaagacaaacaccgggacaauuggagcugugagccuagauuuuuccccugguacuucuggcucgccaaucgucgacaggaaagggaaggugguuggacuguacggcaaugguguggucacccgaagcggggccuaugugucagcgauagcccagacggagaaguccauugaagauaaccccgagaucgaagacgauauuuuccggaaaaagcgccucacaaucauggaccugcauccuggagcaggcaaaacuaagagauaccuuccggcuauaguaagggaggccauuaaacggggcuuacgaacccugauccucgcucccacaagagucguggcagccgaaauggaggaggccuugcgcgggcugccaaucagguaucaaaccccugcuauucgugcggaacacacuggacgggagaucguugaccucaugugucaugcaaccuucacaaugagacugcuuagucccgugagggucccaaacuacaaucugauuauaauggaugaagcccacuuuacggacccugcuucuaucgccgcacgcgguuauauuagcacucgaguggagaugggcgaggccgcugggaucuucaugaccgcgacacccccaggauccagagauccguuuccucagucaaacgcccccaucauggacgaagaacgggaaauuccagagaggucuuggaauagcggccacgaauggguuaccgauuucaaggguaagacugugugguuuguccccaguauaaaagcagggaacgacaucgcugccugcuugcgcaagaauggcaagaaggugauucagcuaucccguaaaacauucgauagcgaguacguaaagaccagagcaaacgacugggauuuugugguuacgacugacaucucugagaugggcgccaauuucaaggcugaacgggucauugauccuaggcgcuguaugaaaccagugauccugacagacggcgaggaacgagugauacucgccgggcccaugccugucacccauucauccgcggcacaaagacggggaaggaucggucgcaacccgaagaaugagaacgaccaguauauuuacaugggcgaaccauuagagaaugaugaggacugcgcccacuggaaagaagcuaagaugcugcuugauaacaucaauacccccgaggggauuaucccuaguauguuugaacccgagagagaaaaaguagacgccauagauggagaguacaggcugcggggcgaggcucguaagacuuucguggaccucaugcgccgaggugauuugccaguuuggcuggcauauaaaguggccgcugaagggauuaacuacgccgacagaaagugguguuuugauggcaucaagaauaaccagauucucgaggaaaacgucgagguggagaucuggacaaaagaaggagagaggaagaaacugaagccucgguggcuugacgcacgcauauauagcgauccccuagcgcugaaagaguucaaggaguucgccgcuggcagaaagucguugaccuuaaaucugaucacagaaauggggaggcucccaacuuuuaugacgcagaaagcccggaacgcacuggacaaucuugcuguucugcauaccgccgaggugggaggucgagcauacacacacgcccucucugaguugccugaaacucuggagacccuacugcuccuuacacuguuagcugcggucaccggcgggauuuucuuguuucugauguccggaaagggcaucgguaaaaugacucucgggaugugcugcauuaucacggccagcauacugcuuugguaugcacaaauucagccgcacuggaucgcugccucaaucauucuggaguucuuucucaucguguugcugauacccgagccagaaaagcagagaaccccucaggauaaccaauuaacauacguagugauugccauccuaacuguugucgcagcuaccauggccaaugagaugggcuuccuggagaaaacaaagaaggaccucggauuuggcaguauuaccacucaggaaucugaguccaacauccuugacauagaucugcgccccgcgagcgcuuggacauuguaugccguggcaacgaccuucgugacuccaaugcugaggcauucaaucgaaaauaguagcgucaacguuucccucacagccauugcuaaucaggcaaccgugcugauggggcuuggaaaagguuggccucucucuaagauggacaucggcguaccccuguuggccauuggguguuacagccaggugaacccgaucacccugacagcggcuuuacuacugcucgucgcccacuacgcaauuaucggaccaggccuucaagccaaagcuacucgggaggcccagaagcgugcagcugccgguauaaugaaaaauccuacgguggaugggauuaccguuaucgaccuggaacccaucccauaugaucccaaguuugagaagcaguugggccaggugaugcugcucauucugugcgucacacaaguacuuaugaugagaacuaccugggcguuaugugaggcccugacacucgcaaccggaccuauauccacuuugugggaaggcaacccggggagguucuggaauacgacaaucgcugugucaauggccaacauuuuucgcggaucuuaccuggcaggcgcuggucuacuguucaguaucaugaaaaauaccacuaacacccggcgagggacaggaaauguuggcgagacucucggugaaaaguggaaaucgagacuuaaggcccugggcaaaagcgaguuucagauuuauaagaaauccgggauccaggagguggacaggaccuuggccaaggaaggaauaaagcgcggcgagacagaucaucacgcggucucucgggggucagcuaaacugagaugguucguggaacguaacauggucacgcccgagggaaaggugguugaccucggcugcgguaggggaggguggagcuacuauuguggcggucugaaaaacgugcgggaaguaaagggcuuaaccaaagggggaccaggccaugaggagccuauccccauguccacuuacggguggaaucuugugcgccugcaaaguggagucgauguuuucuuuacaccuccagaaaagugcgacacccuccuaugugauauuggcgagucuagccccaacccuacuaucgaagcaggucgaacacugagaguguugaaucuggucgagaacuggcucaauaacaauacccaguucugcauuaaggugcuuaacccauauaugcccucaguaaucgagaaaauggagacgcugcagaggaaguacgggggagccuuggugcggaauccgcugucccgcaacaguacccacgagauguacuggguuagcaaugcuacaggcaacauagugucuuccgucaauaugauuucaagaaugcucaucaacagguuuacuaugaaacacaagaaagccaccuaugaaccugacguggauuuaggcagcgggacacgaaauaucggaauugagucggaaauaccaaaccuggacaucauugguaagcggaucgagaagauuaaacaggaacaugagacuucuuggcacuacgaccaagaucaucccuauaagaccugggcauaccacggcaguuaugagacaaaacagaccggguccgccagcucaauggucaacggagugguucgucuucugacuaagccuugggacguagugccaauggucacgcagauggcuaugacagauaccacucccuucggccagcaaagaguguuuaaagaaaagguugacacccgcacacaggagccgaaggaagguacgaaaaagcuaaugaaaaucaccgcggaguggcucuggaaggagcuggggaaagaaaagacuccuaggauguguacacgggaggaguucaccagaaaagugcgcuccaaugccgcauugggagcugucuuuacugaugagaacaaguggaagucugccagggaagcaguggaggacggccgauucugggagcugguagaucgggaaagaaaucuccaccuugagggcaaaugcgaaacauguguguacaacaugauggggaagagggagaaaaagcugggagaauuugguaaagccaagggcagccgcgcuauaugguauaugugguuaggggcccguuuccuggaguuugaggcguugggauuccucaaugaagaccauugguuuagucggggcaacucccugagcgguguugagggggaaggacuacacagacuuggcuacauccugagggaggucggcaagaaagaagggggagcaauguacgccgaugacaccgcugguugggauacacgcauuacucucgaggaccugaagaaugaggaaauggugaccaaccauaugaaaggcgagcacaagaaauuggccgaagcaaucuucaagcugacguaucagaauaaggugguccgaguucagcggcccaccccaagagggacagugauggacauuaucucuaggaaagaucaacgcggaucaggccagguagguacuuacgggcucaacaccuucacaaauauggaggcucagcuuauuagacaaauggagggagaaggcauauuuaagaguauccagcaucugacugccaccgaggaaauugcugugcagaacugguuagcccgggucggcagggagcgucugucccgaauggcaaucagcggggacgauugcgugguuaaaccuaucgacgaucgcuucgcgucugccuugacggcucucaaugacaugggaaaggugagaaaagauauucagcaaugggaacccucgcgggguuggaacgacuggacacaggucccauuuugcucacaccacuuccaugagcuggugaugaaggauggcagggucuuaguugugcccugucgcaaucaggacgagcuuauagggagagcccggaucagccagggagcaggcuggucccugaaggaaaccgcuugccucgguaaaaguuaugcccaaauguggacucugauguacuuucacaggcgagauuugcguuuagcagccaacgcgauuuguucugcugucccuagccauugggugccaacauccagaaccacuuggucaauccacgccaagcacgaguggaugaccacagaagacaugcuggcaguguggaaccgcgucuggauucaggagaauccguggauggaagauaaaacgcccguugagaguugggaggaagugccuuaucucgggaagcgggaggaccaguggugcggaucucuuaucggccugaccagcagggccacuugggcuaaaaacauacagacagccaucaaucaaguaagaucccuaauuggcaacgaaggguacaccgacuauaugccaucaaugaagcgcuuccggagggaggaagaggaggcaggagugcugugguga

SEQ ID NO: 14285 - RNA, 9876 nt, Artificial Sequence
  derived and/or modified CDS sequence (opt3) from DENV-2__KF744403__SS-prME
accgccggcaugaucauuaugcugauacccaccgugauggcuuuccaccucacuacgagaaacggggagccucauaugaucgucagcagacaggaaaaggggaaaucccuucuguuuaagaccgaggacgguguuaauaugugcacauugauggcaauggauuuaggcgaacugugugaggacacuauuaccuacaaaugcccauuacuccggcaaaacgaaccggaggauaucgacuguuggugcaauucuacaucaaccugggugacuuaugggacauguaccacgacuggagagcaccgccgagaaaagcguaguguagcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcagccugcgaccuugcggaaauauugcaucgaagcaaagcugacaaauacuaccacagagucccgcuguccaacucaaggggagcccucucuaaacgaagaacaggacaaacgauuuguuugcaagcacagcaugguggauagaggauggggcaaugguuguggacucuucggaaagggcggcauugucacaugcgccauguuuacaugcaaaaagaacauggaagggaaaaucgugcagccugagaaucuggaauacaccaucgugauuacuccacauuccggagaggagcacgcugucgguaacgacacgggcaagcaugggaaagaaauaaagaucacaccgcagucaaguauuaccgaggccgaacuuacuggauauggcaccguuacaauggaguguagccccaggaccggucuggauuucaaugaaaugguguugcuccaaauggagaacaaagcauggcugguacaccggcagugguuuuuagaccugccucucccauggcuucccggggcugauacucagggcucuaauuggauccagaaggagacacuggugacguucaagaacccucacgccaaaaagcaagacgucgugguuuugggaucccaggaaggcgcgaugcauaccgcccuaacuggggcaacagagauacagaugucaagcggaaaccugcucuuuaccggucaccugaaaugccgucuucgcauggacaagcugcaauugaaaggcaugaguuacucuauguguacagggaaguucaagguggucaaagaaauugcugagacucagcauggaaccaucgugguaagaguucaguaugagggcgaugguuccccaugcaagauccccuucgaaauuauggaccucgagaaaaggcacgugcuggggcgguuaaucacggucaauccgauugugaccgaaaaggauagcccugucaacauagaggccgaacccccauuuggcgacucguacgugaucauuggaguugagccuggccagcugaaacuaaauugguucaagaaggggucuuccaucggacaaauguuugagacaacuaugcgaggugcuaaacgcauggccauccucggcgauaccgcaugggacuucgggucacugggaggcguguuuacaaguauugguaaggcccuucaucagguauucggggcuauauacggcgcggcauuuagcggagucuccuggacuaugaaaaucuugauuggcgugaucauuaccuggaucgggaugaacucuagaagcacgucacugaguguuucccucgugcuggucggagugguaacacuuuaucugggcgugguuguccaggccgauagcgguuguguggugucuuggaggaauaaggaauugaaaugcgggucaggaauauucaucaccgacaacguccacacuuggacagagcaguacaaguuucaacccgaaaguccaagcaagcucgcuuccgccauucagaaagcacaccaggagggcaucugugguauucggucuguuacccgccuggaaaauuuaauguggaagcagaucacucccgagcugaaccauauacuaucggagaaugaagugaaacucaccauuaugacaggcgauaucaaggggauuaugcacgccggaaaaagaagccugaggccucaaccaacggagcuucguuauuccuggaagaccuggggcaaagcuaagaucuugucaacugaaagucauaaccagacauuccugauagacgggccggagaccgccgaaugccccaauacaaaccgggcauggaacucucucgagguggaggauuacggauuuggcguauucacuaccaacaucuggcugcgauuaagagaaaagcaggacgcguuuugugacagcaaacugauguccgcugccauuaaggauaauagggcaguccacgccgacauggguuauuggaucgagucagcucuuaacgauacguggaaaauugaaaaggccagcuucaucgaggugaaaucuugccacuggccuaagucccauacauuguggaguaacgggguucucgagagcgaaaugauaauuccaaagaauuucgcaggacccgugucucagcacaacuaccgcccuggcuaucauacccaaacugcugguccauggcaccugggcaaacuagagauggacuuugauuucuguaaggggaccacagucgugguuacugaagacugcggaaaucggggccccucccugagaaccacaacggccucagggaaacucaucaccgaguggugcuguaggaguugcacucugccgccucuucgcuaccgaggagaagauggcuguugguacgguauggagauccggccauugaaggagaaagaagagaaccuggugagcucguuaguaacagcggggcauggacagauugacaauuuuucccucggcguccuggguauggcccuuuuccuggaagagauguugcguaccagagugggcacuaagcacgcuauccuccugguggcagucucuuuuguuacacuaauuaccgggaacaugagcuucagggaucugggacgcgugaugguaauggugggcgccacgaugacugacgauauagggaugggagucaccuaucucgcucugcuugccgcauuuaaggugcggcccacauucgcggccggcuugcuguuaagaaaacucaccucaaaggaacugaugaugacuacaaucgguauuguucuucugagucaguccaccaucccugagacaauucuagagcucacugacgcucuggccuuggggaugauggugcugaaaaucgucaggaagauggaacgauaccaauuagcagugaccauaauggcuauccucugcguucccaaugccgugauucugcagaacgcauggaaagucucuuguacgauccuugccguagugagcguuuccccacuguugcucacaucaagccagcagaaggcugauuggauuccucuggcgcuaaccaucaagggacugaaucccacugccauauuucuuaccacacucagucgcacuucuaaaaagcgguccuggccacugaacgaggcaauuauggcugugggcauggucagcaucuuggccucgucacugcuaaagaaugacaucccgaugaccggcccucucguggccgggggacugcuuacgguaugcuaugugcugacagguagaucugcugacuuggaacucgagaaggcagccgaugucaggugggaagaccaagcggagauuaguggcuccagccccauacugucuaucauuaucagcgaggauggguccaugucaauuaaaaacgaagaggaggaacagacccuaacuauccugauacguacaggacuucucguuaucaguggccuguucccagugagcauucccaucaccgcugccgcaugguacuugugggaggugaagaaacagcgcgccggugucuuaugggacgugccuucuccacccccuguugggaaggcugaacuggaggauggagcauaucggauuaagcagaaaggcauccucggcuacucccaaauaggggccggaguauauaaggaagguacuuuucacacaauguggcaugugaccagaggcgcgguccugaugcacaaagggaagaggauugagccgucaugggcugacgugaaaaaggaucuuaucaguuacggaggcgguuggaagcuggaaggggaguggaaagagggagaagagguucagguguuggcccuagaaccaggcaagaauccccgagcaguccagacgaaaccuggccuguucaagacuaacgccgggaccaucggagcugugagccucgacuuuuccccagguacaucuggcucgcccauuaucgauaaaaaggggaagguagucggacuguacggcaauggugugguuacccggaacgggagcuaugugucagccauagcacagacagagaaauccauugaagacaacccugagaucgaggaugacauuuuccgcaagaaaagacuuacuaucauggauuuacauccgggagcuggcaagaccaaaagguaccugcccgccauaguccgggaagcgauuaagcgaggccucagaacguugauccuggccccaacacgcgugguugcagcugagauggaagaggcccucagggggcugccuauccguuaucaaacucccgcuauucgggcagaacacaccggaagagagaucguggaccuuaugugucaugccacauucaccaugaggcuguugaguccaauucgcgucccuaauuacaaccuaauaaucauggacgaggcccacuuuacugaucccgcuucuauugcggcacgagguuauaucagcaccagaguggaaaugggcgaggccgcugggaucuucaugacagccacgccaccgggaucccgggacccuuuuccccagucaaaugcaccaauuauggaugaagagagggagauacccgaacgcucuuggaacagcggccacgaguggguaacugacuucaaggguaaaaccgugugguuuguuccuaguaucaaggccgggaaugauauugcugcgugccugcguaaaaacggaaagaaagucauccagcucuccagaaagacauucgacagcgaauacgugaagacccggacuaaugauugggacuuuguggucacaaccgauauuucugagaugggcgccaacuucaaagcagaaaggguaaucgacccacgccgauguaugaagcccgugauauuaacggauggcgaggagagaguuauccuggcugggccuaugccggugacucauucauccgccgcacaacggaggggacgcauugguagaaaucccaagaaugaaaaugaccaguauaucuacaugggcgagccccuugaaaacgacgaggauugcgcccacuggaaggaagcuaaaaugcugcucgacaauauuaacacaccugaggggaucauacccaguauguuugagccagaaagggagaaggucgaugccauugacggagaauaccgguugcguggcgaggcgcgcaaaaccuucguggaucugaugcgaagaggugaccucccuguuuggcuggcauauaagguggccgcugaagggaucaauuacgccgauaggcggugguguuuugacggcauucgcaacaaccagauccuugaggagaaugucgaaguggagauauggaccaaggaaggagagaggaaaaagcuaaaacccagguggcuggaugcucggaucuauagcgacccauuggcauuaaaggaguucaaagaguucgccgcuggccgaaagucgcugacucucaaccugauuacagagauggggagacuuccuaccuuuaugacacagaaggcccgcgaugcacuggacaaucucgcgguauugcauacugccgaagcuggagguagggccuacaaccacgcacugucugagcuaccggaaacgcuggagauccuccuucuguuaaccuugcuggcuacagugacuggcgggauuuuccucuuucugauguccggacggggcaucgguaaaaugacccuugggaugugcugcauaauuacagccagcauccugcucugguaugcacaaauccagccccacuggauugccgcuucaaucauauuggaguucuuucugauuguuuuacuaaucccagaaccugagaagcagcguaccccacaggauaaucaacugacuuacgucgugauugcgauccucacgguggucgccgcaaccauggcuaacgaaaugggcuuccuugagaaaacaaagaaagaccugggauugggcaguauaacuacccagcagccagaaucuaauauccuggacauugaucucagaccugccuccgccuggacacuguaugcaguugcuaccacuuuuaucacacccaugcuuaggcauagcauugagaacucaagugugaauguaagccucacggccaucgcgaaccaggcuaccgugcugaugggguugggaaaggguuggccgcuguccaagauggacauuggcgucccauuacuagccaucggguguuacucucaagugaauccuauaacucugacagcagcccuccuucuguugguugcucacuacgcaauuaucggacccggccugcaggccaaagcgacccgcgaggcucagaagcgggccgcagccgguaucaugaaaaacccaaccguggaugggauuacagucauagaccucgaucccaucccuuaugacccgaaguucgaaaaacagcugggccaaguaaugcuuuuagugcugugcguuacucaggugcucaugaugcgaacgaccugggcuuugugugaggcccugacacuagcaacuggacccauuagcacccugugggaaggcaauccagggagauuuuggaacacaaccaucgcugucuccauggccaauauuuucaggggaucauaccucgcgggcgccggucuucuguuuucuaucaugaagaacacuacgaauacacgccgggggaccggaaacauaggcgagacuuugggugaaaaguggaaaaguagacugaacgcacucggcaagucggaguuccagaucuauaaaaagagcgggauucaagagguggaucguacccuggcuaaagaaggaaucaagaggggcgagacagaccaucacgccgucucccgggggucugcaaaauuacgcugguuuguggaacgaaauaugauuacuccugagggaaagguuguggaucuuggcugcgguagagggggauggucauacuauuguggcggucugaagaacguaagggaggugaaaggccucaccaaaggcgggcccgggcaugaggaaccuaucccaaugagcacauacggguggaaucuaguccggcugcaguccggaguugacguguucuucacgcccccugaaaaaugcgauaccuugcugugugacauaggcgagaguucuccaaaccccacugucgaagcuggucgcacacucagagugcuuaaucugguagagaacugguugaauaacaauacccaguuuugcauuaaggugcugaacccguauaugccuagcguuaucgagaaaauggaagcccuccagaggaaguacgggggagccuuagugcgaaauccacugucacggaacuccacucacgagauguacugggucaguaaugcgagcggcaacaucgugucuuccgucaauaugauuucacguaugcuuauaaacagauucacaaugaagcacaaaaaggcuaccuaugaacccgauguggaccugggcagcgggacgcgcaacaucggaauugagucggaaguuccuaaucuagacaucauugguaaaaggaucgagaagauaaaacaagagcaugaaaccucuuggcacuacgaucaggaccauccauauaagacaugggcauaccacggcaguuaugagacuaagcagaccggguccgccagcucaaugguaaacggagugguccggcuccugacaaaacccugggaugugaucccgaugguuacucagauggcuaugaccgacacaaccccuuuuggccaacagagaguguucaaggaaaaagucgauacucgcacgcaggagcccaaggaagguaccaaaaaguugaugaagauuaccgccgaguggcuguggaaagagcucgggaagaaaaagacuccaaggauguguacccgagaagaguuuacacggaaagugagauccaaugcagcccuuggagcuaucuucacggacgaaaacaaguggaaaucugcgagggaggccguagaggauagccgcuuuugggaacugguggacaaggagcguaauuuacaccuggaaggcaagugcgagaccuguguuuacaacaugaugggcaaacgggaaaagaaauugggggaguucggaaaggcaaaagguaguagagcuauuugguauauguggcucggcgccagguuucuggaguucgaagcacuaggguuucuuaaugaggaucauugguucucccgcgaaaacagccugucuggagucgagggcgaaggucuccacaagcugggguacaucuugcgagacgugucaaagaaagagggaggcgccauguacgcugaugacacugccggcugggacacacggauuacccuggaggaucucaagaaugaagagauggugacuaaccauauggaaggggagcacaagaaacuugcggaagcaauauuuaaacugacauaucagaauaaagucguuagagugcaaaggccuacaccccgcggaacaguaauggacaucauuaguagacgggaucagagggguuccggccagguggggacuuacggauuaaacaccuucacgaauauggaggcccaacugauccgucagauggagggcgaaggugucuucaagagcauccagcauuugaccgcuacagaggaaauugccgugcagaacuggcucgcacgaguugggcgcgagagacugucucggauggcuauaucgggagacgauugcguggucaaaccacuagacgauagguuugccucagcucuuacugcccugaaugacaugggcaaggugcgcaaagauauccaacagugggagcccagcaagggcuggaacgacuggacccagguaccuuucugcucccaccacuuucaugaacucauuaugaaagaugggagaguucugguggucccaugucggaaccaggacgaguugaucggaagggcacgaauuagucaaggugcgggcuggucuuuacgugaaacagccugccugggaaagagcuaugcucagauguggucccucauguacuuccacagacgcgaucuucggcuggccgcaaaugcuaucuguucagccgugccgagucauugggugcccacuucuaggaccacguggagcauacacgcaaagcacgaguggaugacaaccgaagacaugcuaacugucuggaacagaguuuggauccaggagaauccuuggauggaggacaaaacaccaguggaauccugggaggaaauucccuaucugggaaagcgcgaggaucaguggugcggcucacucaucgguuugaccagccgggccacuugggcgaaaaacauucaaaccgcuaucaaucagguaaggucucugauagggaacgaagaguacacagacuauaugccuuccaugaagcgauuuagacgggaggaagaggaagccggagugcuuugguga

SEQ ID NO: 14286 - RNA, 9876 nt, Artificial Sequence
  derived and/or modified CDS sequence (opt3) from DENV-2__KF744406__SS-prME
accgccggcaugaucauuaugcugauacccaccgugauggcuuuccaccucacuacgagaaacggggagccucauaugaucgucagcagacaggaaaagggaaaaucccuucuguuuaagaccgaggacgguguuaauaugugcacauugauggcaauggauuuaggcgaacugugugaggacacuauuaccuacaaaugcccauuacuccggcaaaacgaaccggaggauaucgacuguuggugcaauucuacaucaaccugggugacuuaugggacauguaccacgacuggagagcaccgccgagaaaagcguaguguagcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcagccugcgaccuugcggaaauauugcaucgaagcaaagcugacaaauacuaccacagagucccgcuguccaacucaaggggagcccucucuaaacgaagaacaggacaaacgauuuguuugcaagcacagcaugguggauagaggauggggcaaugguuguggacucuucggaaagggcggcauugucacaugcgccauguuuacaugcaaaaagaacauggaagggaaaaucgugcagccugagaaucuggaauacaccaucgugauuacuccacauuccggagaggagcacgcugucgguaacgacacgggcaagcaugggaaagaaauaaagaucacaccgcagucaaguauuaccgaggccgaacuuacuggauauggcaccguuacaauggaguguagccccaggaccggucuggauuucaaugaaaugguguugcuccaaauggagaacaaagcauggcugguacaccggcagugguuuuuagaccugccucucccauggcuucccggggcugauacucagggcucuaauuggauccagaaggagacacuggugacguucaagaacccucacgccaaaaagcaagacgucgugguuuugggaucccaggaaggcgcgaugcauaccgcccuaacuggggcaacagagauacagaugucaagcggaaaccugcucuuuaccggucaccugaaaugccgucuucgcauggacaagcugcaauugaaaggcaugaguuacucuauguguacagggaaguucaagguggucaaagaaauugcugagacucagcauggaaccaucgugguaagaguucaguaugagggcgaugguuccccaugcaagauccccuucgaaauuauggaccucgagaaaaggcacgugcuggggcgguuaaucacggucaauccgauugugaccgaaaaggauagcccugucaacauagaggccgaacccccauuuggcgacucguacgugaucauuggaguugagccuggccagcugaaacuaaauugguucaagaaggggucuuccaucggacaaauguuugagacaacuaugcgaggugcuaaacgcauggccauccucggcgauaccgcaugggacuucgggucacugggaggcguguuuacaaguauugguaaggcccuucaucagguauucggggcuauauacggcgcggcauuuagcggagucuccuggacuaugaaaaucuugauuggcgugaucauuaccuggaucgggaugaacucuagaagcacgucacugaguguuucccucgugcuggucggagugguaacacuuuaucugggcgugguuguccaggccgauagcgguuguguggugucuuggaggaauaaggaauugaaaugcgggucaggaauauucaucaccgacaacguccacacuuggacagagcaguacaaguuucaacccgaaaguccaagcaagcucgcuuccgccauucagaaagcacaccaggagggcaucugugguauucggucuguuacccgccuggaaaauuuaauguggaagcagaucacucccgagcugaaccauauacuaucggagaaugaagugaaacucaccauuaugacaggcgauaucaaggggauuaugcacgccggaaaaagaagccugaggccucaaccaacggagcuucguuauuccuggaagaccuggggcaaagcuaagaucuugucaacugaaagucauaaccagacauuccugauagacgggccggagaccgccgaaugccccaauacaaaccgggcauggaacucucucgagguggaggauuacggauuuggcguauucacuaccaacaucuggcugcgauuaagagaaaagcaggacgcguuuugugacagcaaacugauguccgcugccauuaaggauaauagggcaguccacgccgacauggguuauuggaucgagucagcucuuaacgauacguggaaaauugaaaaggccagcuucaucgaggugaaaucuugccacuggccuaagucccauacauuguggaguaacgggguucucgagagcgaaaugauaauuccaaagaauuucgcaggacccgugucucagcacaacuaccgcccuggcuaucauacccaaacugcugguccauggcaccugggcaaacuagagauggacuuugauuucuguaaggggaccacagucgugguuacugaagacugcggaaaucggggccccucccugagaaccacaacggccucagggaaacucaucaccgaguggugcuguaggaguugcacucugccgccucuucgcuaccgaggagaagauggcuguugguacgguauggagauccggccauugaaggagaaagaagagaaccuggugagcucguuaguaacagcggggcauggacagauugacaauuuuucccucggcguccuggguauggcccuuuuccuggaagagauguugcguaccagagugggcacuaagcacgcuauccuccugguggcagucucuuuuguuacacuaauuaccgggaacaugagcuucagggaucugggacgcgugaugguaauggugggcgccacgaugacugacgauauagggaugggagucaccuaucucgcucugcuugccgcauuuaaggugcggcccacauucgcggccggcuugcuguuaagaaaacucaccucaaaggaacugaugaugacuacaaucgguauuguucuucugagucaguccaccaucccugagacaauucuagagcucacugacgcucuggccuuggggaugauggugcugaaaaucgucaggaagauggaacgauaccaauuagcagugaccauaauggcuauccucugcguucccaaugccgugauucugcagaacgcauggaaagucucuuguacgauccuugccguagugagcguuuccccacuguugcucacaucaagccagcagaaggcugauuggauuccucuggcgcuaaccaucaagggacugaaucccacugccauauuucuuaccacacucagucgcacuucuaaaaagcgguccuggccacugaacgaggcaauuauggcugugggcauggucagcaucuuggccucgucacugcuaaagaaugacaucccgaugaccggcccucucguggccgggggacugcuuacgguaugcuaugugcugacagguagaucugcugacuuggaacucgagaaggcagccgaugucaggugggaagaccaagcggagauuaguggcuccagccccauacugucuaucauuaucagcgaggauggguccaugucaauuaaaaacgaagaggaggaacagacccuaacuauccugauacguacaggacuucucguuaucaguggccuguucccagugagcauucccaucaccgcugccgcaugguacuugugggaggugaagaaacagcgcgccggugucuuaugggacgugccuucuccacccccuguugggaaggcugaacuggaggauggagcauaucggauuaagcagaaaggcauccucggcuacucccaaauaggggccggaguauauaaggaagguacuuuucacacaauguggcaugugaccagaggcgcgguccugaugcacaaagggaagaggauugagccgucaugggcugacgugaaaaaggaucuuaucaguuacggaggcgguuggaagcuggaaggggaguggaaagagggagaagagguucagguguuggcccuagaaccaggcaagaauccccgagcaguccagacgaaaccuggccuguucaagacuaacgccgggaccaucggagcugugagccucgacuuuuccccagguacaucuggcucgcccauuaucgauaaaaaggggaagguagucggacuguacggcaauggugugguuacccggaacgggagcuaugugucagccauagcacagacagagaaauccauugaagacaacccugagaucgaggaugacauuuuccgcaagaaaagacuuacuaucauggauuuacauccgggagcuggcaagaccaaaagguaccugcccgccauaguccgggaagcgauuaagcgaggccucagaacguugauccuggccccaacacgcgugguugcagcugagauggaagaggcccucagggggcugccuauccguuaucaaacucccgcuauucgggcagaacacaccggaagagagaucguggaccuuaugugucaugccacauucaccaugaggcuguugaguccaauucgcgucccuaauuacaaccuaauaaucauggacgaggcccacuuuacugaucccgcuucuauugcggcacgagguuauaucagcaccagaguggaaaugggcgaggccgcugggaucuucaugacagccacgccaccgggaucccgggacccuuuuccccagucaaaugcaccaauuauggaugaagagagggagauacccgaacgcucuuggaacagcggccacgaguggguaacugacuucaaggguaaaaccgugugguuuguuccuaguaucaaggccgggaaugauauugcugcgugccugcguaaaaacggaaagaaagucauccagcucuccagaaagacauucgacagcgaauacgugaagacccggacuaaugauugggacuuuguggucacaaccgauauuucugagaugggcgccaacuucaaagcagaaaggguaaucgacccacgccgauguaugaagcccgugauauuaacggauggcgaggagagaguuauccuggcugggccuaugccggugacucauucauccgccgcacaacggaggggacgcauugguagaaaucccaaaaaugaaaaugaccaguauaucuacaugggcgagccccuugaaaacgacgaggauugcgcccacuggaaggaagcuaaaaugcugcucgacaauauuaacacaccugaggggaucauacccaguauguuugagccagaaagggagaaggucgaugccauugacggagaauaccgguugcguggcgaggcgcgcaaaaccuucguggaucugaugcgaagaggugaccucccuguuuggcuggcauauaagguggccgcugaagggaucaauuacgccgauaggcggugguguuuugacggcauucgcaacaaccagauccuugaggagaaugucgaaguggagauauggaccaaggaaggagagaggaaaaagcuaaaacccagguggcuggaugcucggaucuauagcgacccauuggcauuaaaggaguucaaagaguucgccgcuggccgaaagucgcugacucucaaccugauuacagagauggggagacuuccuaccuuuaugacacagaaggcccgcgaugcacuggacaaucucgcgguauugcauacugccgaagcuggagguagggccuacaaccacgcacugucugagcuaccggaaacgcuggagaucucccuccuucugaccuuauuggcuacagugacuggcgggauuuuccuguuucucaugagcggacggggcaucgguaaaaugacccuggggaugugcugcauaauuacagccucaauccuucugugguaugcacaaauccagccccacuggauugccgcuaguaucauacucgaguucuuuuugauuguucuguuaaucccagaaccugagaagcagcguaccccacaggauaaucaacuaacuuacgucgugauugcgauccugacgguggucgccgcaaccauggcuaacgaaaugggcuuccucgagaaaacaaagaaagaccuuggacugggcucuauaacuacccagcagccagaauccaauaucuuggacauugaucugagaccugccagcgccuggacacucuaugcaguugcuaccacuuuuaucacacccaugcugaggcauucaauugagaacaguagcgugaauguaucccuuacggccaucgcgaaccaggcuaccgugcucauggggcugggaaaggguuggccguugucuaagauggacauuggcgucccacuguuagccaucggguguuacagccaagugaauccuauaacucuaacagcagcccugcuccuucugguugcucacuacgcaauuaucggacccggcuugcaggccaaagcgacccgcgaggcucagaagcgggccgcagccgguaucaugaaaaacccaaccguggaugggauuacagucauagaccuggaucccaucccuuaugacccgaaguucgaaaaacagcucggccaaguaaugcugcuuguguuaugcguuacucaggugcugaugaugcgaacgaccugggcucucugugaggccuugacacuggcaacuggacccauuuccacccuaugggaaggcaauccagggagauuuuggaacacaaccaucgcugucucaauggccaauauuuucaggggaucuuaccuggcgggcgccggucuccuuuuuaguaucaugaagaacacuacgaauacacgccgggggaccggaaacauaggcgagacucugggugaaaaguggaaaucgagauugaacgcacugggcaagagcgaguuccagaucuauaaaaaguccgggauucaagagguggaucguacccucgcuaaagaaggaaucaagaggggcgagacagaccaucacgccgucucucgggggucagcaaaacugcgcugguuuguggaacgaaauaugauuacuccugagggaaagguuguggauuuaggcugcgguagagggggauggagcuacuauuguggcggucuuaagaacguaagggaggugaaaggccugaccaaaggcgggcccgggcaugaggaaccuaucccaauguccacauacggguggaaucucguccggcuacagaguggaguugacguguucuucacgcccccugaaaaaugcgauacccuguugugugacauaggcgagucuagcccaaaccccacugucgaagcuggucgcacacugagagugcucaaucuuguagagaacuggcugaauaacaauacccaguuuugcauuaagguguugaacccguauaugccuucaguuaucgagaaaauggaagcccugcagaggaaguacgggggagcccucgugcgaaauccauuaucccggaacaguacucacgagauguacugggucagcaaugcgucuggcaacaucguguccucagucaauaugauuagccguaugcugauaaacagauucacaaugaagcacaaaaaggcuaccuaugaacccgauguggaccuuggcucggggacgcgcaacaucggaauugagucugaaguuccuaaucuggacaucauugguaaaaggaucgagaagauaaaacaagagcaugaaaccaguuggcacuacgaucaggaccauccauauaagacaugggcauaccacggcuccuaugagacuaagcagaccgggagcgccucauccaugguaaacggagugguccggcuacucacaaaacccugggaugugaucccgaugguuacucagauggcuaugaccgacacaaccccuuuuggccaacagagaguguucaaggaaaaagucgauacucgcacgcaggagcccaaggaagguaccaaaaagcugaugaagauuaccgccgagugguuguggaaagagcuggggaagaaaaagacuccaaggauguguacccgagaagaguuuacacggaaagugagaucuaaugcagcccucggagcuaucuucacggacgaaaacaaguggaaaagcgcgagggaggccguagaggauagucgcuuuugggaacuuguggacaaggagcguaaucugcacuuagaaggcaagugcgagaccuguguuuacaacaugaugggcaaacgggaaaagaaacugggggaguucggaaaggcaaaagguuccagagcuauuugguauaugugguugggcgccagguuucucgaguucgaagcacugggguuucuaaaugaggaucauugguucagccgcgaaaacucucuuucaggagucgagggcgaaggucugcacaagcucggguacauccugcgagacgugaguaagaaagagggaggcgccauguacgcugaugacacugccggcugggacacacggauuaccuuggaggaucugaagaaugaagagauggugacuaaccauauggaaggggagcacaaaaagcucgcggaagcaauauuuaaacuuacauaucagaauaaggucguuagagugcaaaggccuacaccccgcggaacaguaauggacaucauuuccagacgggaucagagggguagcggccagguggggacuuacggacugaacaccuucacgaauauggaggcccaauuaauccgucagauggagggcgaaggugucuucaagucuauccagcaucugaccgcuacagaggaaauugccgugcagaacugguuggcacgaguugggcgcgagagacucucgcggauggcuauaucaggagacgauugcguggucaaaccacuggacgauagguuugccagcgcucuaacugcccuuaaugacaugggcaaggugcgcaaagauauccaacagugggagcccuccaagggcuggaacgacuggacccagguaccuuucugcagucaccacuuucaugaacugauuaugaaagaugggagaguucucguggucccaugucggaaccaggacgagcugaucggaagggcacgaauuucucaaggugcgggcuggagcuugcgugaaacagccugcuuagggaaguccuaugcucagauguggucacugauguacuuccacagacgcgaucuccggcuugccgcaaaugcuaucuguagugccgugccgucucauugggugcccacuagcaggaccacgugguccauacacgcaaagcacgaguggaugacaaccgaagacaugcugacugucuggaacagaguuuggauccaggagaauccuuggauggaggacaaaacaccaguggaaucaugggaggaaauucccuaucuaggaaagcgcgaggaucaguggugcggcagccugaucggucucaccucucgggccacuugggcgaaaaacauucaaaccgcuaucaaucagguaagguccuugauagggaacgaagaguacacagacuauaugccuaguaugaagcgauuuagacgggaggaagaggaagccggagugcugugguga

SEQ ID NO: 14287 - RNA, 9876 nt, Artificial Sequence
  derived and/or modified CDS sequence (opt3) from DENV-2__KF744404__SS-prME
accgccggcaugaucauuaugcugauacccacagugauggcuuuccaccucacuacgagaaacggggaaccucauaugaucgucagcagacaggaaaagggaaaaucccuucuguuuaagaccgaagacgguguuaauaugugcacauugauggcaauggauuuaggcgaacugugugaggacacuauuaccuacaaaugcccauuacuccggcaaaacgaaccggaggauaucgacuguuggugcaauucuacaucaaccugggugacuuaugggacauguaccacgacuggagagcaccgccgagaaaagcguaguguagcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcagccugcgaccuugcggaaauauugcaucgaagcaaagcugacaaauacuaccacagagucccgcuguccaacucaaggggagcccucucuaaacgaagaacaggacaaacgauuuguuugcaagcacagcaugguggauagaggauggggcaaugguuguggacucuucggaaagggcggcauugucacaugcgccauguuuacaugcaaaaagaacauggaagggaaaaucgugcagccugagaaucuggaauacaccaucgugauuacuccacauuccggagaggagcacgcugucgguaacgacacgggcaagcaugggaaagaaauaaagaucacaccgcagucaaguauuaccgaggccgaacuuacuggauauggcaccguuacaauggaguguagccccaggaccggucuggauuucaaugaaaugguguugcuccaaauggagaacaaagcauggcugguacaccggcagugguuuuuagaccugccucucccauggcuucccggggcugauacucagggcucuaauuggauccagaaggagacacuggugacguucaagaacccucacgccaaaaagcaagacgucgugguuuugggaucccaggaaggcgcgaugcauaccgcccuaacuggggcaacagagauacagaugucaagcggaaaccugcucuuuaccggucaccugaaaugccgucuucgcauggacaagcugcaauugaaaggcaugaguuacucuauguguacagggaaguucaagguggucaaagaaauugcugagacucagcauggaaccaucgugguaagaguucaguaugagggcgaugguuccccaugcaagauccccuucgaaauuauggaccucgagaaaaggcacgugcuggggcgguuaaucacggucaauccgauugugaccgaaaaggauagcccugucaacauagaggccgaacccccauuuggcgacucguacgugaucauuggaguugagccuggccagcugaaacuaaauugguucaagaaggggucuuccaucggacaaauguuugagacaacuaugcgaggugcuaaacgcauggccauccucggcgauaccgcaugggacuucgggucacugggaggcguguuuacaaguauugguaaggcccuucaucagguauucggggcuauauacggcgcggcauuuagcggagucuccuggacuaugaaaaucuugauuggcgugaucauuaccuggaucgggaugaacucuagaagcacgucacugaguguuucccucgugcuggucggagugguaacacuuuaucugggcgugguuguccaggccgauagcgguuguguggugucuuggaggaauaaggaauugaaaugcgggucaggaauauucaucaccgacaacguccacacuuggacagagcaguacaaguuucaacccgaaaguccaagcaagcucgcuuccgccauucagaaagcacaccaggagggcaucugugguauucggucuguuacccgccuggaaaauuuaauguggaagcagaucacucccgagcugaaccauauacuaucggagaaugaagugaaacucaccauuaugacaggcgauaucaaggggauuaugcacgccggaaaaagaagccugaggccucaaccaacggagcuucguuauuccuggaagaccuggggcaaagcuaagaucuugucaacugaaagucauaaccagacauuccugauagacgggccggagaccgccgaaugccccaauacaaaccgggcauggaacucucucgagguggaggauuacggauuuggcguauucacuaccaacaucuggcugcgauuaagagaaaagcaggacgcguuuugugacagcaaacugauguccgcugccauuaaggauaauagggcaguccacgccgacauggguuauuggaucgagucagcucuuaacgauacguggaaaauugaaaaggccagcuucaucgaggugaaaucuugccacuggccuaagucccauacauuguggaguaacgggguucucgagagcgaaaugauaauuccaaagaauuucgcaggacccgugucucagcacaacuaccgcccuggcuaucauacccaaacugcugguccauggcaccugggcaaacuagagauggacuuugauuucuguaaggggaccacagucgugguuacugaagacugcggaaaucggggccccucccugagaaccacaacggccucagggaaacucaucaccgaguggugcuguaggaguugcacucugccgccucuucgcuaccgaggagaagauggcuguugguacgguauggagauccggccauugaaggagaaagaagagaaccuggugagcucguuaguaacagcggggcauggacagauugacaauuuuucccucggcguccuggguauggcccuuuuccuggaagagauguugcguaccagagugggcacuaagcacgcuauccuccugguggcagucucuuuuguuacacuaauuaccgggaacaugagcuucagggaucugggacgcgugaugguaauggugggcgccacgaugacugacgauauagggaugggagucaccuaucucgcucugcuugccgcauuuaaggugcggcccacauucgcggccggcuugcuguuaagaaaacucaccucaaaggaacugaugaugacuacaaucgguauuguucuucugagucaguccaccaucccugagacaauucuagagcucacugacgcucuggccuuggggaugauggugcugaaaaucgucaggaagauggaacgauaccaauuagcagugaccauaauggcuauccucugcguucccaaugccgugauucugcagaacgcauggaaagucucuuguacgauccuugccguagugagcguuuccccacuguugcucacaucaagccagcagaaggcugauuggauuccucuggcgcuaaccaucaagggacugaaucccacugccauauuucuuaccacacucagucgcacuucuaaaaagcgguccuggccacugaacgaggcaauuauggcugugggcauggucagcaucuuggccucgucacugcuaaagaaugacaucccgaugaccggcccucucguggccgggggacugcuuacgguaugcuaugugcugacagguagaucugcugacuuggaacucgagaaggcagccgaugucaggugggaagaccaagcggagauuaguggcuccagccccauacugucuaucauuaucagcgaggauggguccaugucaauuaaaaacgaagaggaagaacagacccuaacuauccugauacguacaggacuucucguuaucaguggccuguucccagugagcauucccaucaccgcugccgcaugguacuugugggaggugaagaaacagcgcgccggugucuuaugggacgugccuucuccacccccuguugggaaggcugaacuggaggauggagcauaucggauuaagcagaaaggcauccucggcuacucccaaauaggggccggaguauauaaggaagguacuuuucacacaauguggcaugugaccagaggcgcgguccugaugcacaaagggaagaggauugagccgucaugggcugacgugaaaaaggaucuuaucaguuacggaggcgguuggaagcuggaaggggaguggaaagagggagaagagguucagguguuggcccuagaaccaggcaagaauccccgagcaguccagacgaaaccuggccuguucaagacuaacgccgggaccaucggagcugugagccucgacuuuuccccagguacaucuggcucgcccauuaucgauaaaaaggggaagguagucggacuguacggcaauggugugguuacccggaacgggagcuaugugucagccauagcacagacagagaaauccauugaagacaacccugagaucgaggaugacauuuuccgcaagaaaagacuuacuaucauggauuuacauccgggagcuggcaagaccaaaagguaccugcccgccauaguccgggaagcgauuaagcgaggccucagaacguugauccuggccccaacacgcgugguugcagcugagauggaagaggcccucagggggcugccuauccguuaucaaacucccgcuauucgggcagaacacaccggaagagagaucguggaccuuaugugucaugccacauucaccaugaggcuguugaguccaauucgcgucccuaauuacaaccuaauaaucauggacgaggcccacuuuacugaucccgcuucuauugcggcacgagguuauaucagcaccagaguggaaaugggcgaggccgcugggaucuucaugacagccacgccaccgggaucccgggacccuuuuccccagucaaaugcaccaauuauggaugaagagagggagauacccgaacgcucuuggaacagcggccacgaguggguaacugacuucaaggguaaaaccgugugguuuguuccuaguaucaaggccgggaaugauauugcugcgugccugcguaaaaacggaaagaaagucauccagcucuccagaaagacauucgacagcgaauacgugaagacccggacuaaugauugggacuuuguggucacaaccgauauuucugagaugggcgccaacuucaaagcagaaaggguaaucgacccacgccgauguaugaagcccgugauauuaacggauggcgaggagagaguuauccuggcugggccuaugccggugacucauucauccgccgcacaacggaggggacgcauugguagaaaucccaaaaaugaaaaugaccaguauaucuacaugggcgagccccuugaaaacgacgaggauugcgcccacuggaaggaagcuaaaaugcugcucgacaauauuaacacaccugaggggaucauacccaguauguuugagccagaaagggagaaggucgaugccauugacggagaauaccgguugcguggcgaggcgcgcaaaaccuucguggaucugaugcgaagaggugaccucccuguuuggcuggcauauaagguggccgcugaagggaucaauuacgccgauaggcggugguguuuugacggcauucgcaacaaccagauccuugaggagaaugucgaaguggagauauggaccaaggaaggagagaggaaaaagcuaaaacccagguggcuggaugcucggaucuauagcgacccauuggcauuaaaggaguucaaagaguucgccgcuggccgaaagucgcugacucucaaccugauuacagagauggggagacuuccuaccuuuaugacacagaaggcccgcgaugcacuggacaaucucgcgguauugcauacugccgaagcuggagguagggccuacaaccacgcacugucugagcuaccggaaacgcugcaaaucucccuccuucugaccuuauuggcuacagugacuggcgggauuuuccuguuucucaugagcggacggggcaucgguaaaaugacccuggggaugugcugcauaauuacagccucaauccuucugugguaugcacagauccagccccacuggauugccgcuaguaucauacucgaguucuuuuugauuguucuguuaaucccagagccugaaaagcagcguaccccacaagauaaucagcuaacuuacgucgugauugcgauccugacgguggucgccgcaaccauggcuaacgagaugggcuuccucgagaaaaccaagaaagaccuuggacugggcucuauaacuacccagcagccagaguccaauaucuuggacauugaucugagaccugccagcgccuggacacucuaugcaguugcuaccacuuuuaucacacccaugcugaggcauucaauugaaaacaguagcgugaauguaucccuuacggccaucgcgaaccaagcuaccgugcucauggggcugggaaaggguuggccguugucuaagauggacauuggcgucccacuguuagccaucggguguuacagccaggugaauccuauaacucuaacagcagcccugcuccuucugguugcucacuacgcaauuaucggacccggcuugcaggccaaagcgacccgcgaggcucagaagcgggccgcagccgguaucaugaaaaacccaaccguggaugggauuacagucauagaccuggaucccaucccuuaugacccgaaguucgagaaacaacucggccagguaaugcugcuuguguuaugcguuacucaggugcugaugaugcgaacgaccugggcucucugugaagccuugacacuggcaacuggacccauuuccacccuaugggagggcaauccagggagauuuuggaacacaaccaucgcugucucaauggccaauauuuucaggggaucuuaccuggcgggcgccggucuccuuuuuaguaucaugaagaacacuacgaauacacgccgggggaccggaaacauaggcgaaacucugggugagaaguggaaaucgagauugaacgcacugggcaagagcgaguuccaaaucuauaaaaaguccgggauucaggagguggaucguacccucgcuaaagagggaaucaagaggggcgaaacagaccaucacgccgucucucgggggucagcaaaacugcgcugguuuguggagcgaaauaugauuacuccugaaggaaagguuguggauuuaggcugcgguagagggggauggagcuacuauuguggcggucuuaagaacguaagggaggugaaaggccugaccaaaggcgggcccgggcaugaggaaccuaucccaauguccacauacggguggaaucucguccggcuacagaguggaguugacguguucuucacgcccccugagaaaugcgauacccuguugugugacauaggcgaaucuagcccaaaccccacugucgaggcuggucgcacacugagagugcucaaucuuguagaaaacuggcugaauaacaauacccaguuuugcauuaagguguugaacccguauaugccuucaguuaucgagaaaauggaggcccugcaaaggaaguacgggggagcccucgugcgaaauccauuaucccggaacaguacucacgaaauguacugggucagcaaugcgucuggcaacaucguguccucagucaauaugauuagccguaugcugauaaacagauucacaaugaagcacaaaaaggcuaccuaugagcccgauguggaccuuggcucggggacgcgcaacaucggaauugaaucugagguuccuaaucuggacaucauugguaaaaggaucgaaaagauaaaacaggagcaugagaccaguuggcacuacgaucaggaccauccauauaagacaugggcauaccacggcuccuaugaaacuaagcagaccgggagcgccucauccaugguaaacggagugguccggcuacucacaaaacccugggaugugaucccgaugguuacucaaauggcuaugaccgacacaaccccuuuuggccagcagagaguguucaaggagaaagucgauacucgcacgcaggaacccaaggaggguaccaaaaagcugaugaagauuaccgccgaaugguuguggaaagagcuggggaagaaaaagacuccaaggauguguacccgagaggaauuuacacggaaagugagaucuaaugcagcccucggagcuaucuucacggacgagaacaaguggaaaagcgcgagggaagccguagaggauagucgcuuuugggagcuuguggacaaggaacguaaucugcacuuagagggcaagugcgaaaccuguguuuacaacaugaugggcaaacgggagaagaaacugggggaguucggaaaggcaaaagguuccagagcuauuugguauaugugguugggcgccagguuucucgaguucgaggcacugggguuucuaaaugaagaucauugguucagccgcgagaacucucuuucaggagucgaaggcgagggucugcacaagcucggguacauccugcgagacgugaguaagaaagaaggaggcgccauguacgcugaugacacugccggcugggacacacggauuaccuuggaggaucugaagaaugaggaaauggugacuaaccauauggagggggaacacaaaaagcucgcggaggcaauauuuaaacuuacauaucaaaauaaggucguuagagugcagaggccuacaccccgcggaacaguaauggacaucauuuccagacgggaucagagggguagcggccaaguggggacuuacggacugaacaccuucacgaauauggaagcccaguuaauccgucagauggagggcgagggugucuucaagucuauccagcaucugaccgcuacagaagagauugccgugcaaaacugguuggcacgaguugggcgcgaaagacucucgcggauggcuauaucaggagacgauugcguggucaaaccacuggacgauagguuugccagcgcucuaacugcccuuaaugacaugggcaaggugcgcaaagauauccagcagugggagcccuccaagggcuggaacgacuggacccagguaccuuucugcagucaccacuuucaugagcugauuaugaaagaugggagaguucucguggucccaugucggaaccaagacgaacugaucggaagggcacgaauuucucagggugcgggcuggagcuugcgugagacagccugcuuagggaaguccuaugcucagauguggucacugauguacuuccacagacgcgaucuccggcuugccgcaaaugcuaucuguagugccgugccgucucauugggugcccacuagcaggaccacgugguccauacacgcaaagcacgaauggaugacaaccgaggacaugcugacugucuggaacagaguuuggauccaggaaaauccuuggauggaggacaaaacaccaguggagucaugggaagagauucccuaucuaggaaagcgcgaagaucaauggugcggcagccugaucggucucaccucucgggccacuugggcgaaaaacauucagaccgcuaucaaucagguaagguccuugauagggaacgaggaauacacagacuauaugccuaguaugaagcgauuuagacgggaggaggaagaggccggagugcugugguga

SEQ ID NO: 14288 - RNA, 9876 nt, Artificial Sequence
  derived and/or modified CDS sequence (opt3) from DENV-2__KF744407__SS-prME
accgccggcaugaucauuaugcugauacccacagugauggcuuuccaccucacuacgagaaacggggaaccucauaugaucgucagcaggcaggaaaaggggaaaucccuucuguuuaagaccgaggacgguguuaauaugugcacauugauggcaauggauuuaggcgaacugugugaggacacuauuaccuacaaaugcccauuacuccggcaaaacgaaccggaggauaucgacuguuggugcaauucuacaucaaccugggugacuuaugggacauguaccacgacuggagagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcacccugcgaccuugcggaaauauugcaucgaagcaaagcugacaaauacuaccacagccucccgcuguccaacucagggggagcccucucuaaacgaggaacaagacaaacgauuuguuugcaagcauagcaugguggauagaggauggggcaaugguuguggacucuucggaaagggcggcauuguaaccugcgcuauguuuacaugcaaaaagaacauggaggggaaaguggugcagccugaaaaucuggaguacaccaucgucaucacuccacacuccggagaagaacaugccguugguaacgacacgggcaagcacgggaaagagauuaagauaacaccgcagucaaguaucaccgaagcagagcuuacuggauauggcaccgugacaauggaauguagccccaggaccggucuggauuucaaugagaugguauugcuccagauggaaaacaaggcuuggcuggugcaccggcaaugguuuuuagaccugccucucccauggcuucccggggccgauacucagggcucuaauuggauucagaaggagacacuggucacguucaagaacccucaugcgaaaaagcaggacgugguuguguugggaucccaagagggcgccaugcacaccgcacuaacuggggcuacagaaauccagaugucaagcggaaaccugcucuuuaccggucaucugaaaugccgucuucgcauggacaagcugcaguugaaaggcaugaguuacucuauguguacagggaaguucaaggucgugaaagagauagccgaaacucaacacggaaccauuguaguuagagugcaguaugagggcgaugguuccccaugcaagauccccuucgagaucauggaccucgagaagaggcauguccuggggcgguuaauuacggugaauccgaucgucaccgagaaggauagcccugugaacauugaagcugagcccccauuuggcgacucguacguuauaaucggaguggaaccuggccagcugaaacuaaauugguucaagaaggggucuuccauuggacagauguuugagacaacuaugcgaggugccaaacgcauggcaauccucggcgauaccgccugggacuucgggucacugggaggcguauuuacaaguaucgguaaggcacuucaccaagucuucggggcgauuuacggcgcagccuuuagcggaguguccuggacuaugaaaauauugaucggcguuauuaucaccuggauugggaugaacucuagaagcacgucacugagugugucccucguccuggugggaguagugacacuuuaucugggcguuaugguccaggcugauagcgguuguguggccucuuggaagaauaaagaguugaagugcgggucaggaaucuucauaaccgacaacgugcacacuuggacagaacaguacaaguuucagcccgagaguccaagcaaacucgcauccgccauccaaaaggcucaucaggaaggcauuugugguaucaggucugucacccggcuggagaauuuaauguggaaacagauuacucccgaacugaaccacauccuaucggagaaugagguuaagcucaccauaaugacaggcgauauuaaagggaucaugcaugccggaaagcgcagccugagaccucagccaacggaacuuagguauuccuggaaaaccuggggcaaggcaaagauuuugucaacugagagucacaaccaaacauuccugaucgacgggccggaaaccgcggagugccccaauacaaaccgugcuuggaacucucucgaaguggaggauuacggauuuggcguguucacuaccaacauauggcugcgguuacgagagaaacaggacgccuuuugugacagcaagcugauguccgcagccaucaaagauaauagagcuguacacgccgacauggguuauuggauugaaucagcacuuaacgauacguggaagaucgagaaagcuagcuucauugaagucaagucuugccauuggccuaagucccacacauuguggaguaacggggugcucgagagcgagaugaucauacccaaaaauuucgccggacccguuucucagcauaacuacaggccuggcuaucacacccagacugcggguccauggcaucugggcaagcuagaaauggacuuugauuucugugaggggaccacaguggucgugacugaagacugcggaaaucgcggccccucccugcggaccacaacggccucagggaaacucauuaccgaguggugcuguagaaguugcacucugccgccucuuagguaccgcggagaagauggcuguugguacgguauggagauccgaccauugaaggagaaagaagagaaccugguuagcucguuagugacagcugggcacggacaaaucgacaauuuuucccucggcguacuggguauggcacuuuuccuggaagagauguugcggacccgugucggcacuaagcacgccauucuccugguggcugugucuuuugucacacuaaucaccgggaacaugagcuucagagaucugggaaggguuauggugaugguaggcgccacgaugacugacgauauugggaugggagugaccuaucucgcacugcuugcggccuuuaagguccgccccacauucgcugccggcuugcuguuacggaaacucaccucaaaggaacugaugaugacuacaauagguaucgugcuucugagucaguccaccauuccugagacaauccuagagcucacugacgcacuggcuuuggggaugaugguucugaaaauugugagaaauauggaaaaguaccaguuagccgucaccaucauggcaauacucugcgugcccaacgccguuauccugcaaaaugcuuggaaagugucuuguacgauucuugcggucguaagcguguccccacuguugcucacaucaagccagcagaaggccgauuggaucccucuggcacuaaccauuaagggacugaaccccacugcuaucuuucuuaccacacucaguaggacuucuaaaaagcgauccuggccacugaaugaggccauaauggccguuggcauggugagcauuuuggcuucgucacugcucaaaaaugacaucccgaugaccggcccucuagucgcagggggacugcuuacggugugcuauguacugacaggucgcucugccgacuuggaacucgagaaggcggcugaugugcggugggaagaacaggccgagaucaguggcuccagccccauucugucuauaaucauuagcgaagacggguccaugucaaucaaaaaugaggaagaggagcaaacccuaacuauucugaucagaacaggacuucucgucauaaguggccuguucccaguuagcauccccauuaccgcagccgcuugguacuugugggaagugaagaaacagagggcugguguguuaugggaugucccuucuccacccccuguggggaaggccgagcuggaagacggagcguaucguaucaagcagaaaggcauucucggcuacucccagaucggggcuggaguuuauaaggaggguacuuuucauacaauguggcacguaacccgcggcgccgugcugaugcauaaagggaagcggauagaaccgucaugggcagaugucaaaaaggaccuuauuaguuacggaggcgguuggaagcuggagggggaguggaaagaaggagaggaagugcaaguuuuggcccuagagccaggcaagaaccccagagcugugcagacgaaaccuggccuguucaagacuaaugccgggaccaucggagcagucagccucgauuuuuccccagguacaucuggcucgcccaucauugacaaaaaggggaaggugguaggacuguacggcaacggugucgugaccaggaacgggagcuauguuucagcuaucgcccagacagaaaaauccauagaggauaauccugagauugaagacgauaucuuccgaaagaaacggcuuacuauuauggacuuacacccgggagcgggcaagaccaaacgcuaccugcccgccaucgugagagaggcaauaaagaggggccuccggacguugauucuggcuccaacacgagucguggccgcugaaauggaggaagcacucagagggcugccuauccgcuaucagacucccgccaucagggccgagcauaccggacgugagauuguugaucuuaugugucacgcuacauucaccaugcggcuguugaguccaaucagagugccuaacuacaaucuaauuauaauggacgaagcgcacuuuacugaccccgcaucuaucgccgcuagggguuauauuagcacccgcgucgagaugggcgaagccgcagggaucuucaugacagccacgccaccgggaucccgagauccuuuuccccaaucaaacgcuccaaucauggacgaggagagagaaauucccgagcggucuuggaauagcggccaugaaugggugacugauuucaaggguaaaaccguaugguuugugccuaguauaaaggcggggaacgacaucgccgcaugccugaggaaaaauggaaagaaaguuauucagcucucccgcaagacauucgauagcgaguacgucaagacccguacuaacgacugggauuuuguggugacaaccgacaucucugaaaugggcgcuaauuucaaagccgagagagucauugauccacggagguguaugaagcccguaaucuuaacggacggcgaggaacgcgugauacuggcagggccuaugccgguuacucacucauccgccgcucagcgaagaggacggaucgguaggaaccccaaaaaugagaacgaucaauauauuuacaugggcgaaccacuugagaaugacgaagacugcgcccauuggaaggaggcgaaaaugcugcucgauaacaucaauacaccugaggggauuauccccaguauguuugaaccagagcgcgaaaagguggacgcaauagauggagaguacagauugaggggcgaagcccggaaaaccuucgucgaccugaugcgucgcggugaucucccuguguggcuggcuuauaagguugccgcugaggggauuaacuacgcagaccgaagaugguguuuugauggcaucaggaacaaucagauucuugaggaaaacguggaggucgaaaucuggaccaaggagggagagcggaaaaagcuaaaaccccgcuggcuggacgccagaauauauagcgauccauuggcuuuaaaggaguucaaagaguucgccgcaggcaggaagucgcugacucucaaucugaucacagaaauggggcggcuuccuaccuuuaugacacagaaggcgcgagacgcccuggauaaccucgcuguguugcacacugccgaggcaggagguagagcuuacaaucacgcccugucugaacuaccggagacgcuggagacccuccuucuguuaacauugcuggcaacuguaaccggcgggauuuuccucuuucugauguccggaaaaggcaucgguaagaugacacuugggaugugcugcauuaucaccgccagcgugcugcucugguaugcucagauacaaccccauuggauugcggccucaaucaucuuggaguucuuucugauuguuuuacuaaucccagagccugaaaaacagcgcacuccccaggacaaccagcugacguacgucgugauagcaauucucaccguggucgcugccacaauggccaaugagaugggcuuccuugaaaagacuaaaaaggauuuuggacugggcaguaucgcaacccaacagccagagucuaacauuuuggacaucgaccugaggccugcuuccgccuggacacucuaugcgguugcuaccacuuucauaacacccaugcugcggcacagcaucgaaaauucaagugugaacguaagccuuacggccauugcaaaucaggccaccgugcucauggggcugggaaaggguuggccguuguccaaaauggauaucggcgucccacuguuagcuauuggguguuacucucaggugaacccuaucacucuaacagcagcccugcuccuucugguugcgcauuacgcuauuaucggacccggcuugcaagccaaggcaacccgugaagcccagaaaagagcugccgcagguauaaugaagaauccaaccguggacgggauuacagucaucgaucuggaccccaucccuuaugauccgaaauuugagaagcagcucggccagguaaugcugcuuguguuaugcguuacucaagugcugaugaugaggacgaccugggcucucugugaagccuugacacuggcgacuggacccauuagcacccuaugggagggcaacccagggcgcuucuggaauacaaccauagccgucuccauggcaaacaucuuucggggaucauaccuggcuggcgccggucuccuuuucucuauuaugaagaauacuacgaacacacgaagagggaccggaaacaucggcgaaacucugggugagaaauggaagaguagguugaaugcacugggcaaaucggaguuucagauuuauaagaaaagcgggauccaggaaguggaccgcacccucgcuaaggagggaauaaaacggggcgaaacagaucaccaugccgucuccagagggucugccaagcugcguugguucguggagaggaacaugaucacuccugagggaaagguuguggacuuaggcugcggucgcgggggauggucauacuauuguggcggucuuaaaaauguacgggaagugaagggccugaccaaagggggacccggccacgaggaaccuauuccaaugagcacauacggguggaaccucguccgacuacaauccggaguugauguguucuuuacgcccccugagaagugcgacacccuguugugugauaucggcgaaaguucuccaaaucccacugucgaggcggguagaacacugagggugcucaaccuuguagagaauuggcugaacaauaacacccaguucugcauuaaaguguugaauccguauaugccuagcguuaucgaaaagauggaggcucugcagcggaaguacgggggagcacucgugcgcaacccauuaucaagaaauuccacucacgaaauguacugggucaguaacgccagcggcaauauagugucuuccgucaacaugauuucaaggaugcugaucaaccgauuuacaaugaaacauaagaaagcuaccuaugagcccgacguggaucuuggcagcgggacgcggaauaucggaauugaaucggagguuccuaaccuggacauaaucgguaagcguauugagaaaaucaagcaggaacacgagaccucuuggcauuacgaccaagaucacccauauaagacaugggccuaccacggcaguuaugaaacuaaacagaccggguccgcaagcucaaugguaaauggaguggucagacuacucacaaagcccugggacgugauuccgaugguuacucagauggccaugaccgauacaaccccuuucggccagcaacgcguguuuaaagagaaggucgacacuaggacgcaggaacccaaagaggguacaaagaagcugaugaaaaucaccgcugagugguuguggaaggaacuggggaaaaagaaaacuccacggauguguaccagagaggaguucacacgcaaggugagguccaacgcggcccucggagcaauauuuacggaugagaauaaauggaagucugcucgagaggccguagaagacagccgguucugggagcuuguggauaaggaaagaaaccugcauuuagagggcaaaugcgaaaccuguguuuacaauaugaugggcaagagggagaaaaagcugggggaguuuggaaaagcaaaggguagucgcgccaucugguauaugugguugggcgcucguuuccucgaauuugaggcccugggguuccuaaacgaagaccacugguuuucccgggagaauagccuuucuggagucgaaggcgagggucugcauaagcucggguacauucugagagaugugagcaagaaagagggaggcgcgauguacgcagacgauacugccggcugggacacaaggaucaccuuggaagaccugaaaaacgaggaaauggugacuaaucacauggagggggaacauaagaaacucgcugaggccauuuucaaacuuacauaucagaacaaagucguucgcgugcagcgaccuaccccacggggaacaguaauggauaucauuaguagaagggaccaacgcgguuccggccagguggggacuuacggacugaauaccuucacgaacauggaggcacaguuaauaagacaaauggaaggcgagggugucuuuaaaagcauccagcaccugaccgcuacagaagagauugccgugcagaauugguugacucggguugggagggagcgucucucucgaauggcuaucucgggagaugacugcguggucaagccacuggaugaccgcuucgccucagcacuaaccgcgcuuaacgauaugggcaaagugagaaaggacauccagcaaugggaacccagcaaaggcuggaacgauuggacacagguaccuuuuugcucccaccauuuccacgagcugauuaugaaggacgggcggguucucguggucccauguaggaaucaggaugaacugauaggacgcgccagaaucagucagggugcuggcuggucuuugcgggagacugccugcuuagggaagucauaugcacaaauguggucccugauguacuuucauaggcgagaccuccgucuugcugccaacgcaauuuguucagccgugccgagucacugggugcccaccucuagaacgacauggagcauccacgcgaaacaugaauggaugaccacugaggauaugcugacagucuggaaucgcguuuggauucaggagaacccuuggauggaagacaagaccccaguggaguccugggaagagauccccuaucuaggaaaacgggaagaccaguggugcggcucacugauaggucucacuagcagggcuaccugggccaagaauauccagacagcaauuaaccaaguaagaucuuugaucgggaaugaggaguacacggauuauaugccuuccaugaaacgcuuccggagggaagaggaagaggccggagugcugugguga

SEQ ID NO: 14289 - RNA, 9876 nt, Artificial Sequence
  derived and/or modified CDS sequence (opt3) from DENV-2__KF744399__SS-prME
accgcaggcaugaucauuaugcugauaccaacugugauggcuuuccaccucacuacgcggaauggggaaccucauaugaucgucagcaggcaggaaaaggggaaaucccuucuguuuaagaccgaggacgguguuaauaugugcacauugauggcuauggauuuaggcgaacugugugaggacacuauuaccuacaaaugcccacuacuccggcaaaaugaaccggaggauaucgacuguuggugcaauucuacaucaaccugggugacuuaugggacauguaccacgacuggggagcaccgccgagaaaagcguagugucgcccuggugccccaugucggcaugggucuugagaccagaacagaaacuuggaugagcuccgagggggcguggaaacacgcucagaggauugagaccuggauccugcggcauccuggauucacauugauggccgcaauacucgccuacaccaucggcacgacuaacuuucagcgcgcucugauuuucauccugcucacagcaguggccccaucuaugaccaugagaugcauuggcaucucgaauagggauuuuguugaaggggugucaggagguagcugggucgacauaguguuagagcacggcaguuguguaacuacaauggcuaagaacaagcccacccuggauuucgaacuuauuaaaacggaggccaagcacccugcgaccuugcggaaauauugcaucgaagcaaagcugacaaauacuaccacagagucccgcuguccaacucagggggagcccucucuaaacgaagaacaagacaaacgauuuguuugcaagcauagcaugguggauagaggauggggcaaugguuguggacucuucggaaagggcggcauuguaaccugcgccauguuuacaugcaaaaagaacauggaagggaaaaucgugcagccugagaaucuggaauacaccaucgugauuacuccacacuccggagaggagaacgcugucgguaaugacacgggcaagcaugggaaagaaauaaagguuacaccgcagucaaguaucaccgaggccgaacuuacuggauauggcaccgugacaauggaguguagccccaggaccggucugggguucaacgaaaugguauugcuccagauggagaauaaagcauggcuggugcaccggcaaugguuuuuagaucugccucucccauggcuucccggcgcugacacucagggaucuaacuggauucagaaggagacacuggucacguucaagaacccucacgccaaaaagcaggaugugguuguguugggcucccaagaaggggcgaugcauaccgcccuaacuggagcaacagagauccagaugucaagcgguaaucugcucuuuaccggccaccugaaaugccgucuucgcauggacaagcugcaguugaaagggaugaguuacucuauguguacaggaaaguucaaggucgugaaagaaauagcugagacucaacauggcaccauuguaguuagagugcaguaugagggugacggguccccaugcaagauccccuucgaaaucauggaucucgagaaaaggcacguccugggccgguuaauuacggugaacccgaucgucaccgaaaaggacagcccugugaauauugaggccgaacccccauuuggagauucguacguuauaaucggcguggagccugggcagcugaaacuaucuugguucaagaagggauccucaauuggucagauguuugagacaacuaugcgaggcgcuaaacgcauggccauccucggggacaccgcaugggauuucggaagucugggcgguguauuuacaagcaucgggaaggcccuucaucaagucuucggcgcuauuuacggagcggcauuuuccggcgugucuuggacuaugaaaauauugaucgggguugugauuaccuggaucggaaugaacagcagaucaacgagucuguccgucagccucgugcugguaggcgugguuacacuuuaucugggugucauggugcaggccgacucuggguguguggucucauggaagaauaaagaauugaagugcggaaguggcauuuucaucaccgauaacguucacacuuggacagagcaguacaaguuucagcccgaaagcccauccaaacucgcuucugccauacaaaaggcacaccaggaggguaucuguggcauuaggucggugacccggcuggaaaauuuaauguggaaacagaucacucccgagcugaaccauauucuaagcgagaaugaagugaagcucaccaucaugacaggggacauaaaaggaauuaugcacgccggcaagcgcucccugagaccucagccaacggagcuuagguauucauggaaggcuugggggaaagccaagaucuugaguaccgaacugcauaaccaaacuuuccucauugauggaccggagacagcagaaugccccaauaccaaccgugcguggaacucucuggagguagaggacuacggcuuuggugucuucacaacuaacaucugguuaaaacugcgggaaaagcaggaugcuuuuugugacagcaaacuuauguccgccgcaauaaaggacaaucgagccgugcacgcugauaugggguauuggaucgagucagccuugaacgacaccuggaaaauugaaaaggccagcuucaucgagguuaagucuugccacuggccuaaaucccauacgcucuggaguaacggagugcuggagagcgaaaugauuaucccaaagaauuucgcuggccccgucucucagcacaacuacagaccugguuaucauacacagaccgccggcccauggcaccuagggaaacuggagauggauuuugacuucuguaagggaacuaccgugguugugacagaagauugcggcaauagggggcccucccuccgcacuaccacagcgucaggaaaacugauaacggaguggugcugucggaguugcacccuuccgccuuugagauacaggggcgaagacgguuguugguacgggauggagauucgcccacugaaggagaaggaagagaacuuaguaaauagccucgucacugccggacauggccaaaucgauaacuuuucgcugggugugcuuggcauggcucuguucuuggaagagaugcuccgaacacggguggggaccaaacacgcaauccugcuagucgccguuuccuuugugacucugauuacaggaaauaugucuuuccgugaccucggcagaguaauggugauggucggggcuaccaugacggaugacaucggaaugggcgugacuuaucuggcccuuuuggcagcguuuaagguuaggcccaccuucgccgcuggucuguuacuccgcaaacugacaagcaaggaacuuaugaugaccacuauugggauagugcugcuaucacagaguacaaucccugagaccauucucgagcugacagaugccuuggcacugggaaugauggucuuaaaaaucgugcggaagauggaaagauaccagcucgcuguuacuauuauggccauccugugcgugcccaacgcagucauacuucaaaaugccuggaagguauccuguaccauccuggcugugguuucugugagcccauugcuccugacguccucacagcagaaagcggacuggauuccucuagcccugacaaucaagggccuuaaccccaccgcaauuuuucucacuacccugagcaggacaaguaaaaagcgaucuuggccauugaaugaggcuaucauggccgucggcaugguguccauacuggccagcucguuacucaaaaacgauauuccgaugacugggccucugguagcuggaggucuucugaccgugugcuaugucuugacgggccgcucagcagaccucgaacuggagaaggccgcggacguucggugggaagaacaggcugagaucucugggaguucccccauccuaagcauuauaaucucugaagauggaagcauguccauuaaaaaugaggaagaggagcaaacacugaccauccuuauuagaacuggccuccuggugaucucagguuuguucccagugaguauacccaucacagccgcagccugguacuuaugggaagucaagaagcagagggcuggggugcugugggacguuccuagcccacccccuguaggaaaagcagagcucgaagauggcgccuaucguauuaagcagaaaggcauccugggguacucucagauuggagcggguguguauaaggagggcaccuuucacacuauguggcaugucacacgcggggcugugcuuaugcacaaaggaaagcggcuggaaccguccugggccgacguuaagaaagauuugaucucauacggcgguggguggaagcuagagggagaguggaaagaaggcgaggaagugcaaguccuggcacucgagccaggcaagaaccccagagccgugcagaccaaaccugggcuguucaagacgaauacuggaaccauaggugcuguaagucuugacuuuagcccaggcacauccgggucucccauuaucgauaagaaaggaaaggucgugggcuuauacgguaacgggguugugaccaggaacggaucguaugucagcgccaucgcacagacagaaaaaucaauugaggacaauccugagaucgaagaugacauauuccgaaagaaacggcugacuauuauggaucuccauccgggcgcuggcaagaccaagcgcuacuugcccgccaucgugagagaggcgauuaaaagggggcugcggacgcucauccuggccccaacacgaguuguggcagcugaaauggaggaagcccuuagaggacugccuauacgcuaucagacucccgcuauuagggcagagcacaccggucgugagaucgucgacuugaugugucaugccacauucaccaugcggcuacuguccccaaucagagugccuaacuacaaucucauuaucauggaugaagcccacuuuacugaccccgcuaguauugcggcaaggggcuauauaucuacccgcguagagaugggggaagccgcuggaaucuucaugacagccacgccaccgggcagccgagacccuuuuccccaauccaacgcaccaauuauggaugaggagagagaaauccccgagcggucauggaacucuggucacgaaugggugacugacuucaaggggaaaaccguuugguuugucccuagcaucaaggccggaaacgauauugcugcgugcuuaaggaaaaauggcaagaaggugauacagcugagucgcaaaacauucgacuccgaguacgugaagacccguacuaacgauugggacuuugucguaacaaccgauaucagcgaaaugggcgccaauuucaaagcagagagagugauugacccacggagguguaugaagcccguuauccuuacggauggggaggaacgcgugauucuggcuggaccuaugccggucacucauucuucagccgcacagcgaagaggucggaucggcaggaaccccaaaaaugagaacgaccaauauauauacaugggggaaccccucgagaaugaugaagacugcgcccacuggaaggaggcuaaaauguugcuggacaacaucaauacaccugagggaauuauccccuccauguuugaaccagagcgcgaaaagguggaugccauugacggcgaguacagacucaggggugaagcgcggaagaccuucguugaucugaugcgucgcggggaccuuccuguguggcuagcauauaaagucgccgcugagggcaucaacuacgccgaucgaagaugguguuuugacggaauaaggaacaaucagauucuggaggaaaacguggagguagaaaucuggaccaaggagggcgagcggaaaaaguugaaaccccgcugguuagaugcuagaauuuauagugacccacuggcacucaaggaguucaaggaguucgccgcugggaggaaaagccugacucuuaaucugaucacagaaaugggacggcucccuaccuuuaugacacagaaggcccgagaugcauuggacaaccuggcggugcuacauacugccgaggcugguggcagagccuacaaucacgcacugucggaacucccggagacgcuugagacccuguuauugcugacacuccuggcuacuguuaccgggggaauauuccuuuuucugaugucuggcaaagguaucgggaagaugacacucggcaugugcugcauuaucaccgccuccgucuugcugugguaugcacagauucaaccccacuggaucgccgcuagcauaauuuuagaguucuuucuaaucgugcugcucaucccagagccugaaaaacagcgcacuccccaggauaaccagcuuacguacguggucauugcgauccugaccguuguggccgcaacaauggcuaaugagaugggauucuuggaaaagacuaagaaagacuuuggccuggggucaauagccacccaacagccagagaguaacauucucgauaucgaccugaggccugccucugcauggacacuuuaugcuguagccaccacuuucauuacacccaugcuccggcauuccaucgagaauagcucagugaacgucagucugacggcgauagcuaaucaggccaccguguugaugggacuggguaagggcuggccguuaagcaaaauggacaucgggguuccacuacuggcaauuggauguuacucccaggugaacccuaucacucucacagccgcacuucuguugcuggucgcacacuacgccauuaucggccccggucuccaagcgaaggcuacccgugaagcccagaaaagagcagccgcugggauuaugaagaauccaaccguagauggcaucacagugauagaccuggaucccauuccuuaugacccgaaguuugagaaacagcuuggacagguuauguuacuggugcucugcgucacucaaguguugaugaugaggacgaccugggcccugugugaagcacuaacacuggcuacuggccccaucucuacccucugggaggggaacccaggacgcuucuggaauacaaccaucgccgucagcauggcgaacauuuuucggggcuccuaccuugccggugcagggcuguuguucucaauaaugaagaauacuacgaacacacgaagaggaaccggcaacaucggugaaacucugggcgagaaauggaagucuaggcucaaugcucuggggaaaagugaguuucagauuuauaagaaaucgggaauccaggaaguggaucgcaccuuagccaaggagggcauuaagagaggggaaacagaccaucacgcaguuagcagaggauccgcuaaacuucguugguucguggagaggaacaugguaacuccugagggcaagguggucgaucuggguugcgggcggggaggcuggucuuacuauugugguggccucaaaaauguucgcgaagugaaggggcuaaccaaaggaggccccgggcaugaggaaccuaucccaaugucaacauacggauggaaccugguccgauugcaaagcggcguggacguauucuuuacgcccccugagaagugcgauacccugcucugugacauaggugaauccaguccaaaucccacuguggaggccgggagaacacuuaggguucugaacuugguggagaauuggcugaacaauaacacccaguucugcaucaagguccucaauccguauaugccuucugugauugagaaaauggaggccuuacagcggaaguacggaggcgcgcugguccgcaacccacuuagcagaaauucaacucacgaaauguacuggguguccaacgcuaguggcaauaucguuagcucuguaaacaugauuuccaggaugcugaucaaccgauuuacaaugcggcacaaaaaggcaaccuaugagcccgauguggaccuagggucaggaacgcguaauauagguauugaaagcgagaucccuaaccucgauaucauuggcaaaagaauagagaagaucaagcaggaacaugagaccucguggcacuacgaccaagaccauccauauaaaacaugggccuaccacgggucuuaugaaacuaagcagaccggaagugcuuccagcauggucaauggcgugguucgccuguugacaaaacccugggaugugauuccgauggucacucagauggccaugaccgacacaaccccuuucggucagcaaaggguguuuaaggagaaaguagauacucggacgcaggaacccaaggaggggacaaagaaacugaugaagaucaccgcagaguggcucuggaaagaacuuggaaagaaaaagacuccaagaauguguacccgcgaggaguucacaaggaaagugcgaucaaacgccgcucugggcgcgauuuuuacggacgagaauaaguggaaguccgcccgggaggcaguugaagauucuagauucugggaguuagucgacaaagaaaggaaccugcacuuggagggcaagugcgaaaccuguguguacaauaugauggggaaacgcgagaagaaacucggagaguuugguaaggcuaagggcagccgugccaucugguauauguggcugggggcacgguuccuagaauuugaggcccuuggauuccugaacgaagaucauugguuuaguagagaaaauucccucagcggcguggaaggugaggggcugcacaaauugggauacauacugagggaggucucuaagaaagaaggcggcgcuauguacgccgacgauacugcggggugggacacacgcaucacccucgaggaucuuaagaacgaagagaugguuacuaaucauauggaaggagagcacaaaaagcuggcagaggccauuuucaaguuaacauaucagaacaaagugguacgagugcagcggccuacccccagagguacagucauggacaucauuucaaggcgcgaccaaagaggcaguggacaggugggaacuuacggccugaauaccuucacgaacauggaagcucaguugauccggcaaauggagggugaagggguuuuuaaguccauucagcaucucaccgccacagaggagaaugcagugcagaacuggcuggcuagggucggacgugaacgacuaagccgcauggccauaucuggcgaugacugcgugguaaaaccacuugaugacagauucgcuucggcccugacugcacucaacgauaugggcaagguucggaaagacauccagcaaugggagcccucaaggggguggaaugauuggacccaggugccuuuuugcagccaccacuuccaugaacugauuaugaaggacggacgcgucuugguggugccauguagaaaccaggaugaguuaaucggucgggcgaggaucucccagggcgccggguggagucugcgagaaacagcuugccucggaaagucuuaugcccaaauguggagccuuauguacuuucaccguagagaccugcgccuagcagcuaaugccauuuguuccgcagucccgucacauuggguucccacaagucggaccacguggucuauacacgccaaaaacgaguggaugacaaccgaggauaugcugacuguguggaauaggguauggauccaggaaaacccuuggauggaggacaagacaccaguggaaagcugggaggaaauucccuaucucggcaaaagagaggaucaguggugcgguuccuugaucgggcugaccucacgcgcgacuugggcuaagaauauucagaccgccaucaaccaaguccggagccuuauaggaaaugaggaauacacagacuauaugccuucuaugaaaagguuccgaagagaggaagaggaagcaggcgugcugugguga

SEQ ID NO: 14290 - RNA, 9876 nt, Artificial Sequence
  derived and/or modified CDS sequence (opt3) from DENV-2__JX286516__SS-prME
accgccggcgugaucguaaugcugauucccacagcuauggcauuccaccucacuacgcggaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguauagugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauagucggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccggguguauugugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcacugucguuugucacccuaauuacgggaaauauguccuuccgggaccugggccgugugauggugauggucggggccacuaugaccgaugacaucggaaugggcguuacauaucucgcucugcuugccgcauuuaaggugagacccaccuucgcggccgguuugcuguuaaggaaacucacuucuaaggagcugaugauggcuacaauugggaucgcccuucugagccagucaacccuaccugaaacaauacucgagcugacugaugcauuggcucugggaaugauggccuuaaaaaucguacgcaacauggaaaaguaccaacucgcagugaccauuauggccaucaguugcguccccaaugcugugauucugcagaacgcguggaagguuuccuguacgauccuugccgcagugucugucagcccacuguugcucacauccucacagcagaaagcugacuggauaccucuggcccuaaccauuaagggccugaaucccacugccaucuuucuuaccacacucagccggacaaguaaaaagagaucuuggccacugaacgaggcuaucauggcagugggcaugguuuccauuuuggccagcucgcugcuaaagaaugacauaccgaugaccgggccucucguggcgggaggucugcuuacggucugcuauguacugacaggcaggucagcugauuuggaacucgagcgagccgcagacgugaagugggaggaucaagccgaaaucucugggaguucccccauucugagcaucaccauuucugaggacggaagcauguccaucaaaaacgaagaggaggaacagacucuaacaauacugauccgcaccggccuucucguuauuucagguguguucccagucaguauccccauuacugcugcagccugguaccugugggaggugaagaagcagcgggcggggguauugugggaugugccuagcccacccccugucggaaaagcugaauuagaggacggcgccuauagaaucaagcagaggggcauacugggguacucucaaauuggagccgguguuuauaaagaaggcacauuucacaccauguggcaugugacgcguggggcagugcucaugcaccgcggaaagcggaucgagccguccugggcugaugucaaaaaggaccugaucucauacggcgguggguggaaacuugagggagaauggaaagagggcgaagaggugcagguucuggccuuggaaccaggcaagaaucccagagcaguacagacuaaaccugggauuuucaagaccaacacaggaaccaucggugcugugagucuagauuuuagcccaggcacauccgggucucccauagucgacaggaaaggaaaggugguuggccuguacgguaaugggguggucacucgaucgggagccuaugugagcgcgauugcccagaccgagaagucaaucgaggauaacccugaaauugaggacgauaucuuccggaaaaagcgccucacgauaauggaccugcauccgggcgcaggcaaaacaaagagauaccuucccgcuauuguaagggaagccaucaaacggggguuacgaacucugauccucgcuccaaccagagucguggcagccgagauggaagaggccuugcgcggacugccuauuagguaucaaacacccgcuauccgugcggagcacaccggucgggaaauuguugaccucaugugucaugcaacuuucaccaugagacugcuuuccccagugagggucccuaacuacaaucugauaaucauggaugaggcccacuuuacagaccccgcuaguauugccgcacgcggcuauaucucuacgcgaguggaaaugggggaggccgcuggaaucuucaugacugcgaccccaccgggcagcagagauccuuuuccccaguccaacgccccaauuauggacgaggaacgggagauacccgaaaggucauggaacucuggucacgaguggguuacagauuucaaggggaagaccgugugguuugucccuagcaucaaagcaggaaacgacauugcugccugcuugcgcaagaauggcaaaaaggugauccagcuaagucguaaaacuuucgauuccgaauacguaaagacaagagcaaacgacugggauuuugugguuaccacggacauuagcgagaugggcgccaauuucaaggcugagcgggucaucgauccaaggcgcuguaugaaacccgugauacugacugacggggaagaacgagugauccucgccggaccuaugccggucacacauucuucagcggcacaaagacgggguaggauuggccgcaacccaaagaaugaaaacgaccaguauaucuacaugggggagcccuuagaaaaugaugaggacugcgcccacuggaaagaggcuaagaugcugcuugauaacauuaauaccccugaaggaaucauacccuccauguuugagccagaaagagagaaaguagacgccauugauggcgaauacaggcugcggggugaggcucguaagaccuucguggaccucaugcgccgaggggauuugccuguuuggcuggcauauaaaguggccgcugagggcaucaacuacgccgacagaaagugguguuuugauggaauuaagaauaaccagauccucgaagagaacgucgaaguggagauauggacuaaagagggcgaaaggaagaaacugaagccccgguggcuugacgcacgcaucuauagugauccacuagcgcugaaaggguucaaggaguucgccgcuggaagaaagagcuugacauuaaaucugauuaccgaaauggguaggcucccuacauuuaugacucagaaagcccggaacgcacuggacaaucuugcuguucugcauacggccgaggugggcgggaaggcauacacccacgcccucucggaauugccggagacacuggagacucuacugcuccuuacccuguuagcugcggucacaggaggcaucuucuuguuucugaugucugguaaagggauuggcaagaugacccucggaaugugcugcaucauaacugccuccauucugcuuugguaugcacaaauccagccccacuggaucgcugccagcauuauccuggaguucuuucucauaguguugcugauuccagagccugaaaaacagcgaacgccccaggauaaccaauuaaccuacguagugaucgccauucuaacaguugucgcagcuacuauggccaaugagaugggcuuccuggaaaagaccaagaaagaccucggguuuggaucaaucacaacccaggagagugagucuaacauacuugacaucgaucugagaccagcguccgcuuggacuuuguaugccguggcaacaacguucgugaccccuaugcugcgccauagcauugaaaauucaagugucaacguuagccucacugccaucgcuaaucaggcaacagugcugaugggucuuggcaagggguggccccucuccaaaauggacauuggaguaccgcuguuggccaucggcuguuacucucaggugaacccaauuacccugaccgcggcuuuacuacugcucgucgcccacuacgcaaucauagguccugggcuucaagccaaggcuacaagggaggcccagaaacgggcagcugccggcauuaugaagaaucccacuguggauggaaucacgguuaucgaccuggaaccaauucccuaugauccuaaguuugagaaacaguugggccaggugaugcugcucauacugugcgucacccaaguacuuaugaugcguacaacuugggcguuaugugaagcccugacccucgcaacagggccgaucagcaccuugugggagggaaaccccggcagauucuggaauacuacgauugcuguguccauggccaacaucuuuagggguucauaccuggcaggggcuggacuacuguucucuauuaugaagaauacaaccaacacucgccggggcaccgguaauguuggcgagacacucggggaaaaauggaagagucgacuuaacgcccugggaaaaucggaguuucagaucuauaagaaaagcggcauacaggaaguggacagaacuuuggccaaggaggggaucaagaggggagagaccgaucaucacgcggucucccgcggcucugcuaaacugcggugguucguggaaagaaacauggucacaccagaggguaaggugguugaccucgggugcggacguggcgguuggucauacuauuguggcgggcugaaaaaugugagggaaguaaagggauuaacgaaaggcgggccuggacaugaggaacccauuccuaugagcaccuacggcuggaaccuugugcggcugcaauccggugucgauguuuucuuuacuccacccgagaagugcgacacacuccuaugugauaucggggagaguucuccuaauccaaccauugaagcaggacgcacucugcgaguguugaaccuggucgagaauuggcucaacaauaacacacaguucugcaucaaggugcuuaaucccuauaugccgagcguaauagagaaaauggagacccugcagagaaaguacggcggcgccuuggugaggaacccucugucaagaaauuccacgcacgaaauguacuggguuaguaacgcuaccgggaauauugugagcucugucaacaugaucucccgcaugcucaucaauagauuuacaaugaaacacaagaaagccacuuaugagccagacguggauuuaggaucagguaccaggaacauuggcauagagagcgaaauccccaaccuggacauuaucgggaagcgaauugagaagaucaaacaggaacaugagacaucguggcacuacgaccaagaucauccuuauaagacuugggcauaccacggaucuuaugaaaccaaacagacaggcagugccuccagcauggucaauggugugguucggcuucugaccaagccaugggacguagugcccauggucacucagauggcuaugacggauacaaccccguucgggcagcaacguguguuuaaagagaagguugacacuagaacccaggagccuaaggaaggaacgaaaaagcuaaugaaaauaacagcggaguggcucuggaaggaacugggcaaagagaagaccccacgcauguguacuagggaggaguucacacggaaagugagaucaaacgccgcauugggcgcugucuuuaccgaugagaauaaguggaaguccgcccgcgaagcaguggaggacgggagguucugggaacugguagaucgagagcggaaccuccaccuugagggaaaaugcgaaacuuguguguacaauaugauggguaagagagagaaaaagcugggcgaauuugggaaagccaagggaucuagggcuaucugguauaugugguuaggcgcccgcuuccuggaguuugaagcguuggguuuccucaacgaggaccauugguuuagccgugggaauagucuguccggaguugagggcgaaggccuacaccggcuuggguacauucugagagaggucggaaagaaagaagguggcgcaauguacgccgaugacacagcugggugggauaccaggaucacacucgaggaccugaagaacgaagagauggugacuaaucauaugaaaggagagcacaagaaauuggccgaagcaauuuucaagcugaccuaucagaacaaggugguccgcguucagcgaccaacgccucggggcaccgugauggacaucauuagcagaaaagaucaaagggguucugggcagguaggaacauacggccucaauacuuucaccaacauggaggcucagcuuauacgccaaauggaaggcgaggggaucuuuaagucaauucagcaucugacagccacugaggaaaucgcugugcagaauugguuagccagagucggacgggagaggcugagucguauggcaaucuccggugacgauugcgugguuaaacccauugacgaucgauucgcgagcgccuugaccgcucucaacgacaugggcaaggugcgcaaagauauacagcaaugggaaccaucuagaggguggaaugacuggacgcagguccccuuuugcucgcaccacuuccaugagcuggugaugaaggauggacgggucuuaguugugccuuguaggaaccaggacgaacuuaucggccgcgccagaauuucacagggugcaggguggagccugaaggagacagcuugccucggaaaauccuaugcccaaauguggacccugauguacuuucaccggagggauuugcgauuagcagccaacgcgaucuguagugcugucccaucucauugggugccgacuagccguacaaccugguccauucacgccaagcacgaguggaugacuaccgaagacaugcuggcaguguggaauagagucuggauccaggagaaccccuggauggaagauaaaacaccuguugagucaugggaagaggugccauaucucggcaagcgcgaggaccaguggugcggcagucuuauagggcugacgucucgggccaccugggcuaaaaauauccagacugccauuaaccaaguaaggagccuaaucggaaaugaagguuacacagacuauaugcccuccaugaagagauuccgccgggaggaagaggaagcaggcgugcugugguga

SEQ ID NO: 14291 - RNA, 9876 nt, Artificial Sequence
  derived and/or modified CDS sequence (opt3) from DENV-2__JX286518__SS-prME
accgcaggcgugaucguaaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcacugucguuugucacgcuaaucacuggaaauauguccuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgaugcauuggcucugggaaugauggccuuaaaaauaguacgcaacauggaaaaguaccaacucgcagugacgaucauggccauuaguugcguccccaaugcugugauccugcagaacgcguggaagguuuccuguacaauucuugccgcagugucugucagcccacuguugcucaccuccucacagcagaaagcugacuggaucccucuggcccuaacuauaaagggccugaaucccaccgccauuuuucuuacaacucucagccggaccaguaaaaagagaucuuggccacugaacgaggcuaucauggcagugggcaugguuuccaucuuggccagcucgcugcuaaagaaugacauuccgaugacggggccucucguggcgggaggucugcuuacagucugcuauguacugaccggcaggucagcugauuuggaacucgagcgagccgcagacgugaagugggaggaucaagccgaaauaucugggaguucccccauccugagcauuacuaucucugaggacggaagcauguccauuaaaaacgaagaggaggaacagacacuaaccauccugauacgcacuggccuucucguuaucucagguguguucccagucaguauucccaucacagcugcagccugguaccugugggaggugaagaagcagcgggcggggguauugugggaugugccuagcccacccccugucggaaaagcugaauuagaggacggcgccuauagaauuaagcagaggggcauccugggguacucucaaauaggagccgguguuuauaaagaaggcaccuuucacacgauguggcaugugacucguggggcagugcucaugcaccgcggaaagcggauugagccguccugggcugaugucaaaaaggaccugaucucauacggcgguggguggaaacuugagggagaauggaaagagggcgaagaggugcagguucuggccuuggaaccaggcaagaaucccagagcaguacagaccaaaccugggaucuucaagacaaacaccggaacaauuggugcugugagucuagauuuuagcccaggcacuuccgggucucccaucgucgacaggaaaggaaaggugguuggccuguacgguaaugggguggucacccgaucgggagccuaugugagcgcgauagcccagacggagaagucaauugaggauaacccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuuccccagugagggucccuaacuacaaucugauuauaauggaugaggcccacuuuacggaccccgcuaguaucgccgcacgcggcuauauuucuacucgaguggaaaugggggaggccgcuggaaucuucaugaccgcgacaccaccgggcagcagagauccuuuuccccaguccaacgccccaaucauggacgaggaacgggagauucccgaaaggucauggaacucuggucacgaguggguuaccgauuucaaggggaagacugugugguuugucccuagcauaaaagcaggaaacgacaucgcugccugcuugcgcaagaauggcaaaaaggugauucagcuaagucguaaaacauucgauuccgaauacguaaagaccagagcaaacgacugggauuuugugguuacgacugacaucagcgagaugggcgccaauuucaaggcugagcgggucauugauccaaggcgcuguaugaaacccgugauccugacagacggggaggaacgagugauacucgccggaccuaugccggucacccauucuucagcggcacaaagacgggguaggaucggccgcaacccaaagaaugaaaacgaccaguauauuuacaugggggagcccuuagaaaaugaugaggacugcgcccacuggaaagaggcuaagaugcugcuugauaacaucaauaccccugaaggaauuauccccuccauguuugagccagaaagagagaaaguagacgccauagauggcgaauacaggcugcggggugaggcucguaagacuuucguggaccucaugcgccgaggggauuugccuguuuggcuggcauauagaguggccgcugagggcauuaacuacgccgacaggaaaugguguuuugauggaaucaagaauaaccagauucucgaagagaacgucgaaguggagaucuggacaaaggagggcgaacggaaaaagcugaaaccccgcuggcuugacgcaagaauauauagugauccacuagcgcugaaggaguucaaagaguucgccgcugggagaaagagcuugaccuuaaaucugaucacagagaugggacggcucccuacuuuuaugacgcagaaggcccgaaacgcacuggacaaucuugcuguucugcauaccgccgaaguggguggcaaagcauacacacacgcccucucggaguugccggagacucuggaaacccuacugcuccuuacacuguuagcugcggucaccgggggaauuuucuuguuucugaugucuggcaaggguaucgggaaaaugacucucggcaugugcugcauuaucacggccuccauacugcuuugguaugcacaaauucagccccacuggaucgcugccagcaucauucuggaguucuuucucaucguguugcugauaccagaaccugagaagcagagaaccccacaggauaaccaauuaacauacguagugauugccauccuaacuguugucgcagcuaccauggccaaugaaaugggauuccuggagaaaacaaagaaggaccucggcuuugggucaauuaccacucaggagagugaaucuaacauccuugacauagaucugcgcccagcguccgcuuggacauuguaugccguggcaacgaccuucgugacuccuaugcugaggcauagcaucgaaaauucaagugucaacguuagccucacagccauugcuaaucaggcaaccgugcugaugggacuugguaaaggcuggccccucuccaagauggacaucgggguaccgcuguuggccauuggauguuacucucaggugaacccaaucacccugacagcggcuuuacuacugcucgucgcccacuacgcaauuaucggcccuggucuucaagccaaagcuacucgggaagcccagaagcgugcagcugccgggauaaugaaaaaucccacgguggauggcauuaccguuaucgaccuggagccaauccccuaugauccuaaguuugaaaagcaguugggacaggugaugcugcucauucugugcgucacacaaguacuuaugaugagaacuaccugggcguuaugugaggcccugacacucgcaaccggcccgauaagcacuuugugggaggggaaccccggaagguucuggaauacgacaaucgcuguguccauggccaacauuuuucgcggcucauaccuggccggugcugggcuacuguucucuaucaugaaaaauaccacuaacacccggcgaggaacaggcaauguuggugaaacucucggcgagaaguggaaaaguagacuuaacgcccuggggaagucggaauuucagauuuauaaaaagagcggaauccaggagguggacaggaccuuggccaaagagggcauaaagcgcggggaaacagaucaucacgcggucucccggggaucugcuaagcugagaugguucguggagcguaacauggucacgccagaaggcaaagugguugaccucgguugcgggaggggaggcuggucauacuauugugguggccugaagaaugugcgggagguaaaaggguuaaccaagggaggcccugggcaugaggaacccaucccuaugagcacuuacggauggaaccuugugcgccugcaauccggcgucgauguuuucuuuacaccacccgagaaaugcgacacccuccuaugugauauuggugaaaguucuccuaauccaacuaucgaggcagggcgaacacugagaguguugaaccuggucgaaaauuggcucaacaauaacacccaguucugcauuaaggugcuuaaucccuauaugccgagcguaaucgagaagauggaaacgcugcagaggaaauacggaggcgccuuggugcggaacccucugucacgcaauuccacccacgagauguacuggguuaguaacgcuacaggcaauauagugagcucugucaacaugauuuccagaaugcucaucaauagguuuacuaugaagcacaaaaaggccaccuaugagccagacguggauuuagggucaggaacacgaaacaucgguauugaaagcgagauacccaaccuggacaucauuggcaaacggaucgaaaagauuaagcaggagcaugaaacuucguggcacuacgaccaagaucauccuuauaaaaccugggcauaccacgggucuuaugagacaaagcagaccggaagugccuccagcauggucaauggcgugguucgucuucugacuaaaccaugggacguagugcccauggucacgcagauggcuaugacagauaccacuccguucggucagcaaagaguguuuaaggagaaaguugacacccgcacacaggaaccuaaggaggggacgaagaaacuaaugaagaucaccgcggaauggcucuggaaagagcugggaaaggagaaaacucccaggauguguacacgggaagaguucaccagaaaggugcgcucaaacgccgcauugggcgcugucuuuacugaugaaaauaaauggaaguccgccagggaggcaguggaagacggccgauucugggagcugguagaucgggagagaaaccuccaccuugaagggaagugcgagacauguguguacaauaugaugggaaaaagggaaaagaaacugggugaguuuggcaaggccaaagggucucgcgcuauaugguauaugugguuaggagcccguuuccuggaauuugaggcguugggcuuccucaacgaggaccauugguuuagccgggguaauagucuguccgggguugaaggagagggccuacacagacuuggcuacauccugagggaagucgggaagaaggagggaggugcaauguacgccgaugacaccgcuggcugggauacacgcauuacucucgaagaccugaaaaacgaggagauggugaccaaucauaugaagggggaacacaaaaaguuggccgaggcaaucuucaaacugacguaucagaacaaggugguccgaguucagcggccaaccccuagaggaacagugauggacauuaucagcaggaaggaucaacgcggcucuggucagguagggacuuacggacucaauaccuucacaaacauggaagcucagcuuauuagacaaauggagggcgagggcauauuuaaaucaauccagcaucugacugccaccgaagagauugcugugcagaauugguuagcccgggucgggagggaacgucugagucgaauggcaaucuccggagacgauugcgugguuaagcccaucgacgaucgcuucgcgagcgccuugacggcucucaacgacauggguaaagugagaaaggauauucagcaaugggagccaucucggggcuggaaugacuggacacagguccccuuuugcucgcaccacuuccaugaacuggugaugaaagaugggagggucuuaguugugccuugucgcaaccaggacgagcuuauaggaagggcacggaucucacagggcgcagguuggagccugaaggagaccgcuugccucgggaaguccuaugcccaaauguggacucugauguacuuucacaggcgagauuugcguuuagcagccaacgcgauuuguagugcugucccaucucauugggugccgacaagcagaaccacuugguccauccacgccaaacacgaauggaugaccacagaggacaugcuggcaguguggaaucgcgucuggauucaggaaaaccccuggauggaggauaagacgccuguugaaucaugggaggaggugccauaucucggaaaacgggaagaccaguggugcggcagucuuaucggccugaccucuagggccacuugggcuaagaauauacagacagccaucaaccaaguaagaagccuaauugggaaugagggauacaccgacuauaugcccuccaugaaacgcuuccggagggaagaggaagaggccggugugcugugguga

SEQ ID NO: 14292 - RNA, 9876 nt, Artificial Sequence
  derived and/or modified CDS sequence (opt3) from DENV-2__JX286519__SS-prME
accgcaggcgugaucgucaugcugauucccacagcuauggcauuccaccucacuacgaggaacggggagccucauaugauaguuggaaggcaggaaaaggguaaaagccuucuguuuaagaccgaggacggcaucaauaugugcacauugauggcaauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaauagugcagccugagaaccucgaauacaccaucgugauuacuccacacagcggugaggagcaugcugucggcaaugacacggggaagcacggaaaagaaaucaagauaacaccgcaguccucaaccacugaggccgaacugaccggcuaugguacaguuaccauggaguguagucccaggacugggcuugauuucaacgaaauggugcuguugcaaauggaggacaaagcauggcucguacaccggcagugguuucuggauuuaccucugccauggcuccccggcgcugacacacagggaagcaauuggauucagaaggagacgcuugugaccuucaagaacccucaugccaaaaagcaagacgucgugguucugggcucucaggaaggggcgaugcacacugccuugacaggagcaaccgagauccagauguccucagguaaucuacuguuuacaggccaucucaaaugccgucugcgcauggauaaacuucaacugaaagggaugagcuacaguauguguacuggaaaguucaagaucgugaaagaaauugcugagacccagcacggcacgaucgucauuagagugcaguaugagggugacgggucuccaugcaagauacccuucgaaaucaccgauuuggagaaaaggcauguacucggccggcugauuacaguuaacccgaucgugacugaaaaggacuccccugucaacaucgaggccgaacccccauuuggagauagcuacauuauagugggcgucgagccugggcaguuaaaacugaauugguucaagaagggaucgucuaucggucaaauguuugagaccacaaugcgaggcgcuaaacgcauggccauucuaggggacacugcaugggauuucggaucccucggcgguguguuuaccucaaucgggaaggcccugcaccagguuuucggcgcuauuuacggagcggcauuuaguggcgugagcuggacgaugaaaauccuuauagggguaaucauuacauggaucggaaugaacuccagaucuaccagcuugucagucagucuggugcucguuggcguggucacucuguaucuuggugccauggugcaggcugacuccggguguauuguaagcuggaagaauaaagaacugaagugcggaucuggcaucuucauaacagauaacgugcacaccuggacugagcaguacaaguuucaacccgaaucaccaaguaaauuggccagcgcaauucagaaggcccaugaggaagguaucuguggcauuagguccguuacccggcucgagaaucugauguggaaacagaucacacccgaguuaaaccacauacugucugaaaaugaggucaagcuaacgaucaugaccggggacauuaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguggaagacuacggcuuugguguguucacgacaaacaucuggcucaagcugcgugagaaacaggacgucuuuugugauucuaaguuaaugagcgcugccauaaaagacaaucgggcaguucacgccgauaugggguauuggauugaauccgcucugaacgacaccuggaagauggagaaggccucauucaucgaggugaaaagcugccacuggccuaagucucauacucuuugguccaauggaguguuggaaagugagaugaucauucccaagaauuucgcaggccccguaagccagcacaacuaccgaccugguuaucauacccaaacagcuggcccauggcaccucgggaagcuggaaauggauuuugacuucugugagggaacuaccgucgugguuacagaagauugcggcaauagagggcccucucuaaggacgaccacugccuccggaaaacugaucacagaguggugcugucgcucaugcacccucccgccucugcgguacagaggcgaggacgguuguugguacgggauggaaauuaggccacuuaaggagaaggaagagaacuuggugaauagucuggucacugcgggacauggccagauagauaacuuuagcuuaggugugcucggcauggcccuguuccuugaagagaugcugcgcacacgaguugggaccaaacacgcuaucuugcucguggcacugucguuuguaacgcuaauuacuggaaauauguccuuccgggaccugggccgugucauggugauggugggggccaccaugacagaugacaucggaaugggcgucaccuaucucgcucugcuugccgcauuuaagguuagacccacuuucgcggccgguuugcuguuaaggaaacucacaucuaaggagcugaugauggcuaccauugggaucgcccuucugagccagucaacacuaccugaaacuauacucgagcugaccgaugcauuggcucugggaaugauggccuuaaaaaucgugcgcaacauggaaaaguaccaacucgcaguaacgauuauggccaucaguugcgugcccaaugcugucauucugcagaacgcguggaagguguccuguacaauccuugccgcaguuucugugagcccacuguugcucaccuccucacagcagaaagcugacuggauaccucuggcccuaacuauuaagggccugaaucccaccgccaucuuucuuacaacucucagccggaccaguaaaaagagaucuuggccacugaacgaggcuaucauggcagucggcaugguguccauuuuggccagcucgcugcuaaagaaugacauaccgaugacggggccucucguugcgggaggucugcuuacagugugcuauguccugaccggcaggucagcugauuuggaacucgagcgagccgcagacguaaagugggaggaucaagccgaaaucucugggaguucccccauucugagcaucacuauuucugaggacggaagcauguccaucaaaaacgaagaggaggaacagacacuaaccauacugauccgcacuggccuucucgugauuucagguguuuucccagugaguauccccauuacagcugcagccugguaccugugggaggucaagaagcagcgggcggggguguugugggauguaccuagcccacccccugugggaaaagcugaauuagaggacggcgccuauagaaucaagcagaggggcauacugggguacucucaaauuggagccggugucuauaaagaaggcaccuuucacacgauguggcauguuacucguggggcagugcucaugcaccgcggaaagcggaucgagccguccugggcugaugugaaaaaggaccugaucucauacggcgguggguggaaacuugagggagaauggaaagagggcgaagagguccaggugcuggccuuggaaccaggcaagaaucccagagcaguucagaccaaaccugggauuuucaagacaaacaccggaacaaucggugcuguaagucuagauuuuagcccaggcacuuccgggucucccauaguggacaggaaaggaaaggucgugggccuguacgguaaugggguugugacccgaucgggagccuaugucagcgcgauugcccagacggagaagucaaucgaggauaacccugaaauugaggacgauaucuuccggaaaaagcgccucacaauaauggaccugcauccgggcgcaggcaaaacuaagagauaccuucccgcuauugugagggaagccaucaaacggggguuacgaacccugauccucgcuccaacaagaguagucgcagccgagauggaagaggccuugcgcggacugccuauuagguaucaaacccccgcuauccgugcggagcacacuggucgggaaauuguggaccucaugugucaugcaaccuucacaaugagacugcuuuccccaguuagggugccuaacuacaaucugauaaucauggaugaggcccacuuuacggaccccgcuaguauugccgcacgcggcuauaucucuacucgagucgaaaugggggaggccgcuggaaucuucaugaccgcgacaccaccgggcagcagagauccuuuuccccaguccaacgccccaauuauggacgaggaacgggagauacccgaaaggucauggaacucuggucacgagugggugaccgauuucaaggggaagacuguuugguuugugccuagcaucaaagcaggaaacgacauugcugccugcuugcgcaagaauggcaaaaaggucauccagcuaagucguaaaacauucgauuccgaauacgugaagaccagagcaaacgacugggauuuuguagugacgacugacauuagcgagaugggcgccaauuucaaggcugagcggguuaucgauccaaggcgcuguaugaaacccgucauacugacagacggggaagaacgagugauccucgccggaccuaugccggugacccauucuucagcggcacaaagacgggguaggauuggccgcaacccaaagaaugaaaacgaccaguauaucuacaugggggagcccuuagaaaaugaugaggacugcgcccacuggaaagaggcuaagaugcugcuugauaacauuaauaccccugaaggaaucguccccuccauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaacuacgccgacagaaagugguguuuugauggaaucaagaauaaccagauucucgaagagaacgucgaaguggagaucuggacaaaagagggcgaaaggaagaaacugaagccccgguggcuugacgcacgcauauauagugauccacuagcgcugaaagaguucaaggaguucgccgcugggagaaagagcuugaccuuaaaucugaucacagagaugggaaggcucccuacuuuuaugacgcagaaagcccggucggcacuggacaaccuugcuguucugcauaccgccgaaguggguggcaaggcauacacacacgcccucucugaguugccggagacucuggaaacccuacugcuccuuacacuguuagcugcggucaccgggggaauuuucuuguuucugauguccggcaaagguaucgggaagaugacucucggcaugugcugcauuaucacggccagcauacugcuuugguaugcacaaauucagccccacuggaucgcugccucaaucauucuggaguucuuucucaucguguugcugauaccagaaccugagaaacagcgaaccccacaggauaaucaauuaacauacguagugauugccauccuaacuguugucgcagcuaccauggccaacgaaaugggauuccuggagaagacaaagaaagaccucggcuuugggaguauuaccacucaggagucugaauccaauauccuugacauagaucugagaccagcgagcgcuuggacauuguaugccguggcaacgaccuucgugacuccuaugcugcgccauucaaucgagaacaguagcgucaauguuucccucacagccauugcuaaccaggcaaccgugcugaugggacuugguaagggcuggccccucucuaaaauggacaucgggguaccgcuguuggccauuggauguuacagccaggugaauccaaucacccugacagcggcuuuacuacugcucgucgcccacuacgcaauuaucggcccuggucuucaagccaaggcuacuagggaagcccagaaacgggcagcugccgggauaaugaagaaccccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauauccacuuugugggaggggaaucccggaagauucuggaacacgacaaucgcugugucaauggccaauauuuuuaggggcucuuaccuggccggugcugggcuacuguucaguaucaugaagaacaccacuaauacccgccggggaacaggcaacguuggugaaacucucggcgagaaauggaagucgcgacuuaaugcccuggggaaaagcgaauuucagauuuauaagaaauccggaauccaggagguggacagaaccuuggccaaggagggcauaaagagaggggaaacagaucaucacgcggucucucgcggaucagcuaaacugcggugguucguggagagaaacauggucacgccagaaggcaaggugguugaccucgguugcgggcguggaggcuggagcuacuauugugguggccugaaaaacgugagggagguaaagggguuaaccaaaggaggcccugggcaugaggaacccaucccuauguccacuuacggauggaaucuugugcggcugcaaaguggcgucgauguuuucuuuacaccacccgagaagugcgacacccuccuaugugauauuggugaaucuagcccuaacccaacuaucgaggcagggcgcacacugcgaguguugaaucuggucgaaaacuggcucaauaacaauacccaguucugcauuaaggugcuuaaccccuauaugccgucaguaaucgagaaaauggaaacgcugcagagaaaguacggaggcgccuuggugaggaauccucugucccggaacaguacccacgagauguacuggguuagcaaugcuacaggcaacauagugucuuccgucaauaugauuucacgcaugcucaucaacagauuuacuaugaaacacaagaaagccaccuaugagccagacguggauuuagggagcggaacaaggaauaucgguauugaaucggagauacccaaccuggacaucauuggcaagcgaaucgaaaagauuaaacaggagcaugaaacuucuuggcacuacgaccaagaucauccuuauaagaccugggcauaccacgggaguuaugagacaaaacagaccggauccgccagcucaauggucaacggcgugguucggcuucugacuaagccaugggacguagugcccauggucacgcagauggcuaugacagauaccacuccguucggucagcaacguguguuuaaagagaagguugacaccagaacacaggaaccuaaggaggggacgaaaaagcuaaugaaaaucaccgcggaauggcucuggaaggagcugggaaaagagaagacuccccgcauguguacaagggaagaguucacccggaaagugagauccaaugccgcauugggcgcugucuuuacugaugaaaacaaguggaagucugcccgcgaggcaguggaagacggcagguucugggagcugguagaucgagagcggaaucuccaccuugaagggaaaugcgagacauguguguacaacaugaugggaaagagagagaaaaagcugggugaguuuggcaaagccaaggggagcagggcuauaugguauaugugguuaggagcccgcuuccuggaauuugaggcguugggcuuccucaaugaggaccauugguuuagucgugguaacucccugagcgggguugaaggagagggccuacaccggcuuggcuacauccugagagaagucgggaagaaagagggaggugcaauguacgccgaugacaccgcuggcugggauacaaggauuacucucgaagaccugaagaaugaggagauggugaccaaccauaugaaaggggaacacaagaaauuggccgaggcaaucuucaagcugacguaucagaauaaggugguccgcguucagcgaccaaccccucggggaacagugauggacauuaucucuagaaaagaucaaaggggcucaggucagguagggacuuacggacucaacaccuucacaaauauggaagcucagcuuauucgccaaauggagggcgagggcauauuuaagaguauccagcaucugacugccaccgaagagauugcugugcagaacugguuagccagagucgggcgggaaaggcugucccguauggcaaucagcggagacgauugcgugguuaaacccaucgacgaucgauucgcgucugccuugacggcucucaaugacauggguaaggugcgcaaagauauucagcaaugggagccaucgagaggcuggaacgacuggacacagguccccuuuugcucacaccacuuccaugaacuggugaugaaggaugggcgggucuuaguugugccuuguaggaaucaggacgagcuuauaggacgcgccagaaucagccagggcgcagguuggucccugaaggagaccgcuugccucgggaaaaguuaugcccaaauguggacucugauguacuuucaccggagggauuugcgauuagcagccaacgcgauuuguucugcugucccaagccauugggugccgacaucccguaccacuuggucaauccacgccaagcacgaauggaugaccacagaggacaugcuggcaguguggaacagagucuggauucaggaaaaucccuggauggaggauaaaacgccuguugaaaguugggaggaggugccauaucucggaaagcgcgaagaccaguggugcggcucucuuaucggccugaccagccgggccacuugggcuaaaaacauacagacagccaucaaucaaguaaggucccuaauugggaacgagggauacaccgacuauaugcccucaaugaagagauuccgccgggaagaggaagaggccggugugcugugguga

SEQ ID NO: 14293 - RNA, 9876 nt, Artificial Sequence
  derived and/or modified CDS sequence (opt3) from DENV-2__KP188549__SS-prME
accgccggcgugaucgucaugcugauuccaacagcuauggcguuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagauggucauccccaagaacuucgcaggccccgugagccagcacaacuaccgaccugguuaucauacccaaacagcuggcccauggcaccucgggaagcuggaaauggauuuugacuucugugagggaacuaccguuguggucacagaagauugcgagaaaagaggccccucucuaaggacgaccacugccuccgggaagcugaucacagaguggugcugucgcucaugcacccucccgccucugcgguacagaggagaagacggcuguugguacgguauggagauuaggccacuuaaggaaaaagaggaaaauuuggugaacagucugguuacugcggggcauggacagaucgauaauuuuagcuuaggcgugcucgguauggcccuguuccuugaggagaugcugcgcacacgaguaggcaccaagcacgcuauuuugcucgucgcacugucguuugugacgcuaauaacugggaacauguccuuccgggaccugggacgugugauggucaugguuggcgccaccaugacagaugacaucgggaugggagugaccuaucucgcucugcuugccgcauuuaaaguaagacccacuuucgcggccggcuugcuguuaaggaagcucacaucuaaagaacugaugauggcuaccauugguaucgcccuucugagccagucaacacuaccugagacuauucucgaacugaccgaugcauuggcucuggggaugauggccuuaaagaucgugcgcaauauggagaaguaccaacucgcagucacgauaauggccaucaguugcgugcccaacgcuguuauucugcagaaugcguggaaaguguccuguacaauccuugccgcagucucugugagcccacuguugcucaccuccucacagcagaaggcugacuggauuccucuggcccuaacuaucaaaggacugaaccccaccgccauauuucuuacaacucucagccggaccaguaagaaaagaucuuggccacugaaugaagcuauuauggcaguuggcaugguguccaucuuggccagcucgcuguuaaagaacgacaucccgaugacgggcccucucgucgcagggggacugcuuacaguaugcuaugugcugaccgguaggucagcugauuuggagcucgagcgagccgcagacguuaaaugggaagaucaagccgagauuucuggcaguucccccauacugagcaucacuauuucugaagacgggagcauguccaucaagaaugaggaggaagaacagacacuaaccauucugauccgcacuggacuucucgugauaucaggcgucuucccagugaguauccccauuacagcugcagccugguaccugugggaaguaaagaaacagcgggcggguguguugugggaugucccuagcccacccccuguugggaaggcugaguuagaagacggagccuauagaaucaaacagaggggcauucugggcuacucucaaaucggggcaggaguguauaaggaggguaccuuucacacgauguggcaugugacucguggcgccguccucaugcaccgcgggaaacggauagagccguccugggcugaugugaagaaggaccugauuucauacggaggcgguuggaaacuugaaggggaguggaaggaaggagaggaaguucagguacuggccuuggagccaggcaaaaaccccagagcagugcagaccaagccuggcaucuucaaaacaaauaccgggacaaucggagcugucagucuagauuuuagcccagguacuuccggcucucccauuguggacaggaaggggaagguugugggacuguacggcaacggugucgugacccgaucgggggccuauguaagcgcgaucgcccagacggagaaaucaauagaagauaauccugagauugaagacgauaucuuccggaagaaacgccucacaauuauggaccugcauccgggagcaggcaagacuaaaagauaccuucccgcuaucgucagggaggccauaaagcggggcuuacgaacccugauucucgcuccaacaagagugguugcagccgaaauggaggaggccuugcgcgggcugccuaucagguaucaaacccccgcuauccgugcggaacacacuggacgggagauuguggaccucaugugucaugcaaccuucacaaugagacugcuuuccccagucagggugccuaacuacaaccugaucauuauggaugaagcccacuuuacggaccccgcuaguauagccgcacgcgguuauaucucuacucgaguugagaugggcgaggccgcugggauuuucaugaccgcgacaccaccgggaagcagagauccuuuuccccaguccaaugccccaaucauggacgaagaacgggaaauccccgagaggucauggaacucuggccacgaaugggugaccgauuucaaggguaaaacugucugguuugugccuagcauuaaggcagggaaugacauagcugccugcuugcgcaaaaacggaaagaaaguaauccagcuaagucguaagacauucgauuccgaguacgugaagaccagagcaaaugacugggauuuuguugucacgacugacauuagcgagaugggcgccaacuucaaagcugaacgggugaucgauccaaggcgcuguaugaagcccgugauucugacagacggcgaggaacgagucauccucgccgggccuaugccgguaacccauucuucagcggcacaaagacggggaaggauaggucgcaaucccaagaacgagaaugaccaguauaucuacaugggcgaacccuuagagaacgaugaggacugcgcccacuggaaggaagcuaaaaugcugcuugauaauauuaacaccccugaggggaucauucccuccauguuugaaccagagagagaaaagguggacgccaucgauggagaguacaggcugcggggcgaggcucguaaaacuuucguugaccucaugcgccgaggugauuugccuguguggcuggcauauaaggucgccgcugaagggauaaauuacgccgacagaaagugguguuuugauggcauuaaaaacaaucagauccucgaggaaaacguggagguugagauuuggacaaaggaaggagagaggaaaaagcugaaaccccgguggcuugacgcacgcaucuauagugauccacuagcgcugaaggaguucaaggaguucgccgcuggcagaaagagcuugaccuuaaaccugauaacagaaauggggaggcucccuacuuuuaugacgcagaaggcccggaaugcacuggacaaccuugcugugcugcauaccgccgaggucggagguaaagcauacacacacgcccucucggaguugccggaaacucuggagacccuacugcuccuuacacuguuagcugcggugaccggcgggaucuucuuguuucugaugucuggaaagggcauugguaaaaugacucucgggaugugcugcaucauuacggccuccauccugcuuugguaugcacaaauacagccccacuggauugcugccagcaucauccuggaguucuuucucauuguauugcugaucccagagccugaaaagcagcgaacaccacaggauaaucaauuaacauacgugguuauagccauucuaacugucguggcagcuaccauggccaacgagaugggcuuccuggagaagaccaagaaagaccucggauuuggcucaaucaccacucaggaaagugagucuaauauucuugacaucgaucugagaccagcguccgcuuggacauuguaugccguggcaacgaccuucgucacuccuaugcugcgccauagcauagaaaacucaaguguuaaugugagccucacagccaucgcuaaccaggcaaccguacugauggggcuuggaaaagguuggccccucuccaaaauggacauuggcgugccgcuguuggccaucggguguuacucucaggucaauccaauuacccugacagcggcuuuacuacugcucguggcccacuacgcaaucauuggaccuggccuucaagccaaagcuacuagggaggcccagaagcgggcagcugccgguaucaugaagaaccccacgguugaugggauaaccgugauugaccuggaaccaauccccuaugauccuaaauuugagaagcaguugggccaggucaugcugcucauccugugcguaacacaagugcuuaugaugcguacuaccugggcguuaugugaggcccugacacucgcaaccggaccgauuagcacuuugugggaaggcaaucccgggagauucuggaacacgacaauagcuguuuccauggccaauaucuuuaggggaucauaccuggcaggcgcuggucuacuguucucuauuaugaaaaacaccacuaauacccgccgggggacaggaaacgugggcgagacucucggugaaaaguggaaaagucgacuuaaugcccugggcaagucggaguuucagaucuauaaaaagagcgggauucaggaggucgacagaaccuuggccaaggaaggaaucaaaaggggcgagacagaucaucacgcggugucccgcgggucugcuaagcugcggugguucgucgaaagaaacauggugacgccagagggaaaaguuguggaccucggcugcggucgugggggauggucauacuauuguggcggucugaagaacguaagggaagugaaaggcuuaaccaaagggggaccuggccaugaggagcccauaccuaugagcacuuacggguggaaucuuguccggcugcaauccggaguugauguguucuuuacaccacccgaaaagugcgacacccuccuaugugauaucggcgagaguucuccuaacccaacuauugaagcaggucgcacacugcgagucuugaaucugguggagaacuggcucaauaacaauacccaguucugcaucaaaguacuuaaccccuauaugccgagcgugauugaaaagauggagacgcugcagagaaaauacgggggagccuugguuaggaauccucugucacggaacuccacccacgagauguacugggugaguaaugcuacaggcaacaucgucagcucugugaauaugauaucccgcaugcucauuaacagauuuacuaugaagcacaaaaaggccaccuaugaaccagacgucgauuuaggcucagggacaaggaauaucggaaucgagagcgaaacucccaaccuggacauuauagguaagcgaaucgagaaaauuaagcaggaacaugagaccucguggcacuacgaccaagaucauccuuauaaaacaugggcauaccacggcucuuaugagaccaagcagacugggagugccuccagcauggugaacggaguuguacggcuucugacgaaaccaugggacgugguccccauggugacacagauggcuaugaccgauacuaccccguucggccagcaacguguuuuuaaggaaaagguggacacaagaacgcaggagccuaaagaagguaccaagaaacuaaugaagaucacugcggaguggcucuggaaagagcuggggaaggagaaaacaccccgcauguguaccagggaggaguucacucggaaggucagaucaaaugccgcauugggagcuguguuuacagaugagaacaaguggaaauccgcccgcgaagcaguagaggacggcagguucugggagcugguggaucgagaacggaaucuccaccuugagggcaagugcgaaaccuguguuuacaacaugauggggaaaagagagaagaaacugggagaauuugguaaggccaagggcucuagggcuauuugguauaugugguuaggggcccgcuuccuggaguuugaggcguugggauuccucaaugaagaccauugguuuagccguggcaacagucuguccggugucgagggggaaggacuacaccggcuuggcuacauccugagagaggugggcaaaaaggaagggggagcaauguacgccgaugacacagcugguugggauacuaggauaacccucgaggaccugaaaaaugaggaaauggugacgaaccauaugaagggcgagcacaaaaaguuggccgaagcaaucuucaagcugaccuaucagaauaaagucguucgcgugcagcgaccaacaccucgggggacuguaauggacauuaucagcagaaaggaucaaaggggaucuggccagguggguaccuacgggcucaacacauucacuaauauggaggcucagcuuauucgccaaauggagggagaaggcaucuuuaaaucaauucagcaucugaccgccacggaggaaacagcuguccagaacugguuagccagagugggccgggagaggcugagucguauggcaauauccggggacgauugcguugugaagcccaucgacgaucgauucgcgagcgccuugaccgcucucaaugacaugggaaaaguccgcaaggauauucagcaaugggaaccaucuagagguuggaacgacuggacucaggugcccuuuugcucgcaccacuuccaugagcugguaaugaaggauggccggguucuaguggucccuuguaggaaucaggacgagcuuaucgggcgcgccagaaucucacagggagcaggcuggagccugaaagaaacagcuugccucgguaaguccuaugcccaaauguggacccugauguacuuucaccggagggauuugcgauuagcagccaacgcgauuuguagugcugugccaucucauugggugccgacuagccguaccacaugguccauacacgccaaacacgaguggaugacgaccgaagacaugcuggcagucuggaacagaguuuggauccaggagaaucccuggauggaagauaagacuccuguggagucaugggaggaaguaccauaucucgggaaacgcgaggaccaguggugcggaagucuuauuggccugacaucucgggccaccugggcuaagaacauccagacugccauuaaucaagugaggagccuaaucggcaacgaaggguacacagacuauaugcccuccaugaagagauuccgccgggaggaagaggaggcaggaguccugugguga

SEQ ID NO: 14294 - RNA, 9876 nt, Artificial Sequence
  derived and/or modified CDS sequence (opt3) from DENV-2__KP188550__SS-prME
accgccggcgugaucguaaugcugauucccacuguuauggcuuuccaccucacuacgagaaacggggagccucauaugauagugggaaggcaggaaaaggguaaaagccuucuguuuaagaccgaggacggcguaaauaugugcacauugauggcuaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugagaugcaucgggauaucuaacagggauuuuguggaaggaguaucggguggcucauggguugacauugugcucgagcacgggagcugugucacuacaauggccaagaauaagcccaccuuagauuucgaacugaucaaaacggaggcuaagcagccugccacccuucggaaauauugcauugaagcgaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggaucgugaccugcgcaauguuuacaugcaaaaagaauauggaaggaaaaauuguccagccugagaaccucgaauacaccauaguuaucacuccacacagcggugaggagcaugccgugggcaaugacacggggaagcacggaaaagaaauuaagaucacaccgcaguccucaaccacugaggcugaacugaccggcuaugguacaguaaccauggaguguagucccaggacugggcuugauuucaacgaaauggugcuguugcaaauggaggacaaagccuggcucguccaccggcagugguuucuggauuuaccucugccauggcuccccggcgcagacacacagggaagcaauuggauacagaaggagacgcuugugaccuucaagaacccucaugcuaaaaagcaagacguugugguccugggcucucaggaaggggccaugcacacugcguugacaggagccaccgagauucagauguccucagguaaucuacuguuuacaggccaucucaaaugccgucugcgcauggauaaacuucaacugaaagggaugagcuacaguauguguacuggaaaguucaagaucgugaaagaaaucgcagagacccagcacggcacgauuguaaucagaguucaguaugagggugacgggucuccaugcaagauucccuucgaaauaaccgauuuggagaaaaggcaugugcucggccggcugaucacagucaacccgauugugacugaaaaggacuccccugucaacaucgaggcugaacccccauuuggagauagcuacaucauugugggcguugagccugggcaguuaaaacugaauugguucaagaagggaucgucuauaggucaaauguuugagaccacaaugcgaggcgccaaacgcauggcuauccuaggggacacugccugggauuucggaucccucggcgguguguuuaccucaauugggaaggcacugcaccagguauucggcgccaucuacggagcugcguuuaguggcgucagcuggacgaugaaaauucuuaucggggugauaaucacauggauuggaaugaacuccagaucuaccagcuugucaguuagucuggugcucgucggcgugguaacucuguaucuuggugcaauggugcaggccgacuccggguguaucguuagcuggaagaauaaagaacugaagugcggaucuggcauuuucaucacagauaacguccacaccuggacugagcaguacaaguuucaacccgaaucaccaaguaaauuggcuagcgccauacagaaggcacaugaggaagguauuuguggcaucagguccgugacccggcucgagaaucugauguggaaacagauuacacccgaguuaaaccacauccugucugaaaaugaggugaagcuaacgauaaugaccggggacaucaaaggaauuaugcaggccggcaagcgcucgcucagaccucaaccaacugaacugaaauauagcuggaagacaugggggaaggcuaaaaugcuuuccaccgagucacauaaccagacauucuugaucgauggaccggaaacugccgagugccccaauaccaacagggcauggaauagucuggaggucgaagacuacggcuuugguguuuucacgacaaacauuuggcucaagcugcgugagaaacaggacguguuuugugauucuaaguuaaugagcgcggcuaucaaagacaaucgggccgugcacgcagauaugggguauuggauagaauccgcccugaacgacaccuggaagauggagaaggcuucauucauugagguaaaaagcugccacuggccuaagucucauacucuuugguccaauggagucuuggaaagugagaugaucauccccaagaauuucgccggccccgugagccagcacaacuaccgaccugguuaucauacccaaacagcaggcccauggcaccucgggaagcuggaaauggauuuugacuucugugagggaacuaccguuguggucacagaagauugcggcaauagagggcccucucuaaggacgaccacugcuuccggaaaacugauuacagaguggugcugucgcucaugcacccucccgccucugcgguacagaggcgaggacgguuguugguacgggauggaaaucaggccacuuaaggagaaggaagagaacuuggugaauagucugguuacugccggacauggccagauugauaacuuuagcuuaggugugcucggcauggcgcuguuccuugaagagaugcugcgcacacgaguagggaccaaacacgccauauugcucgucgcucugucguuugugacgcuaaucacuggaaauauguccuuccgggaccugggccgugugauggucaugguuggggcaaccaugacagaugacauuggaaugggcgugaccuaucucgcccugcuugcugccuuuaagguaagacccacuuucgcagcggguuugcuguuaaggaaacucacaucuaaggagcugaugauggccaccaucgggauugcacuucugagccagucaacacuaccugaaacuauccucgagcugaccgaugccuuggcacugggaaugauggcuuuaaaaauagugcgcaacauggaaaaguaccaacucgccgucacgaucauggcaauuaguugcgugcccaaugccguuauccugcagaacgcuuggaagguguccuguacaauucuugcggccgucucugugagcccacuguugcucaccuccucacagcagaaagcagacuggaucccucuggcucuaacuauaaagggccugaaucccaccgccauuuuucuuacaacucucagccggaccaguaaaaagagaucuuggccacugaacgaggccaucauggcuguuggcaugguguccaucuuggcaagcucgcugcuaaagaaugacauuccgaugacggggccucucgucgccggaggucugcuuacaguaugcuaugugcugaccggcaggucagcggauuuggaacucgagcgagcugccgacguuaagugggaggaucaagcagaaauaucugggaguucccccauccugagcauuacuaucucugaggacggaagcauguccauuaaaaacgaagaggaggaacagacacuaaccauccugauacgcacuggccuucucgugaucucaggugucuucccagugaguauucccaucacagccgcugcaugguaccugugggagguaaagaagcagcgggccgggguguugugggaugucccuagcccacccccuguuggaaaagcggaauuagaggacggcgcuuauagaauuaagcagaggggcauccugggguacucucaaauaggagccgguguguauaaagaaggcaccuuucacacgauguggcaugugacucguggggcaguccucaugcaccgcggaaagcggauugagccguccugggccgaugugaaaaaggaccugaucucauacggcgguggguggaaacuugagggagaauggaaagagggcgaagagguucagguacuggcuuuggaaccaggcaagaaucccagagccgugcagaccaaaccugggaucuucaagacaaacaccggaacaauuggugcagucagucuagauuuuagcccaggcacuuccgggucucccaucguggacaggaaaggaaagguugugggccuguacgguaauggggucgugacccgaucgggagcuuauguaagcgccauagcgcagacggagaagucaauugaggauaacccugaaaucgaggacgauauuuuccggaaaaagcgccucacaaucauggaccugcauccgggcgccggcaaaacuaagagauaccuucccgcaauagucagggaagcuauuaaacggggguuacgaacccugauccucgccccaacaagagugguugcugcagagauggaagaggccuugcgcggacugccuaucagguaucaaacccccgccauucgugcugagcacacuggucgggaaaucguggaccucaugugucaugcgaccuucacaaugagacugcuuuccccagucagggugccuaacuacaaucugauuauaauggaugaggcacacuuuacggaccccgccaguaucgcugcccgcggcuauauuucuacucgaguugaaaugggggaggcagccggaaucuucaugaccgcuacaccaccgggcagcagagauccuuuuccccaguccaacgcgccaaucauggacgaggaacgggagauucccgaaaggucauggaacucuggucacgagugggugaccgauuucaaggggaagacugucugguuugugccuagcauaaaagccggaaacgacaucgcagcuugcuugcgcaagaauggcaaaaagguaauucagcuaagucguaaaacauucgauuccgaauacgugaagaccagagccaacgacugggauuuuguugucacgacugacaucagcgagaugggcgcaaauuucaaggccgagcgggugauugauccaaggcgcuguaugaaacccgugauccugacagacggggaagaacgagucauacucgcuggaccuaugccgguaacccauucuucagccgcgcaaagacgggguaggaucggccgcaacccaaagaaugaaaacgaccaguauauuuacaugggggagcccuuagaaaaugaugaggacugcgcacacuggaaagaggccaagaugcugcuugauaacaucaauaccccugaaggaauuauccccuccauguuugagccagaaagagagaaaguggacgcuauagauggcgaauacaggcugcggggugaggcccguaagacuuucguugaccucaugcgccgaggggauuugccuguguggcuggcuuauaaagucgcagccgagggcauuaacuacgcugacagaaagugguguuuugauggaaucaagaauaaccagauucucgaagagaacguggaaguugagaucuggacaaaagagggcgaaaggaagaaacugaagccccgguggcuugacgcccgcauauauagugauccacuagcacugaaagaguucaaggaguucgcggccgggagaaagagcuugaccuuaaaucugaucacagagaugggaaggcucccuacuuuuaugacgcagaaagcucggaacgcccuggacaaucuugcagugcugcauaccgcugaagucgguggccgagcccacacacacgcacucucggaguugccggagacucuggaaacccuacugcuccuuacacuguuagccaccgugacugggggaauuuucuuguuucugaugucuggcaaggguaucgggaaaaugacgcucggcaugugcugcauuaucaccgcuuccauacugcuuugguacgcgcaaauucagccccauuggaucgccgcaagcaucauucuggaguucuuucucaucguauugcugauaccagaaccugagaagcagagaacaccccaggauaaccaauuaacuuaugugguuauugcuauccuaaccgucguggccgccacaauggcaaaugaaaugggauuccuggagaaaaccaagaaggaccucggcuuugggacuauuacaacgcaggagucagaaaguaacauccuugacauagaucugcgcccagcuucugccuggaccuuguacgcgguggcuacuacauucgucaccccuaugcugaggcacuccaucgagaauagcucaguuaacgugagucucaccgccauugcaaaucaggccacaguacugaugggacuugguaaaggcuggccccucagcaagauggacaucggggugccgcuguuggcuauuggauguuauucccaggucaacccaaucacucugacggcagccuuacuacugcucguggcgcauuacgcuauuaucggcccuggucuucaagccaaagcaacccgggaagcccagaagcgugcugccgcagggauaaugaaaaaucccacaguugauggcauuacugugaucgaccuggagccaauccccuacgauccuaaguuugaaaagcaguugggacaggucaugcugcucauucugugcguaacccaagugcuuaugaugagaacaaccugggcuuuaugugaggcccugacucucgcgacgggcccgauaucuacauugugggaggggaaccccggaagguucuggaauaccacuaucgccguuagcauggcaaacauuuuucgcggcuccuaucuggcuggugccgggcuacuguucucaaucaugaaaaauaccacaaacacucggcgaggaaccggcaaugugggugaaacacucggcgagaaguggaaaucuagacuuaacgcacuggggaagagugaauuucagauuuacaaaaagucgggaauccaggaggucgacaggacguuggcuaaagagggcauaaagcgcggggaaaccgaucaccaugccgugagccggggauccgccaagcugagaugguucgucgagcguaacauggugacuccagaaggcaaaguuguggaccucgguugcgggaggggaggcuggucuuauuacugugguggccugaagaauguacgggaggugaaaggguuaacaaagggaggcccugggcacgaagaaccaaucccuaugucaaccuauggauggaaccuuguccgccugcaaagcggcguugauguguucuuuacuccacccgagaaaugcgacacacuccuaugugauauuggugaauccaguccuaauccaaccaucgaggcggggcgaacgcugagagucuugaaccugguggaaaauuggcucaacaauaacacccaguucugcauuaagguacuuaaucccuacaugccgucugugaucgagaagauggaaacacugcagaggaaauauggaggcgcuuugguucggaacccucugagccgcaauucaacucacgagauguacuggguguccaacgcaaccggcaauauagucaguagcgugaacaugauuucuagaaugcucaucaauagguuuacaaugaagcauaaaaaggccacuuacgagccagacgucgauuuaggguccggaacccgaaacaucgguauugaaucagagauacccaaccuggacaucauuggcaaacggaucgaaaagauuaagcaggagcacgaaacaagcuggcauuaugaccaagaucacccuuacaaaaccugggcuuaucacgggucguacgagacuaagcagacgggaucugccaguuccauggugaauggcguuguacgucuucugacaaaaccaugggacgugguccccauggugacccagauggcaaugacugauaccacaccguucggucagcaaagaguuuuuaaggagaaaguggacacgcgcacccaggaaccuaaggaggggacuaagaaacuaaugaagaucacagccaaauggcucuggaaggaacugggaaaagagaagacccccaggauguguacucgggaggaguucacaagaaaaguccgcagcaacgcugcguugggcgccauauuuaccgaugagaauaaguggaagucagcaagggaagcuguggaggacggccgauucugggaacugguagaucgggagagaaaccuccaucuugaggggaaaugcgaaacauguguguauaauaugaugggaaagagggagaaaaagcugggugaauuuggcaaagccaaggggucccgcgcaaucugguacaugugguuaggagcccguuuccuggaguuugaggcuuugggcuuccucaacgaggaccacugguuuucucgggguaauagccugagugggguugagggagaaggccuacauagacuuggcuauauucugagggaggucgggaagaaagaaggaggugccauguacgcggaugacacugcaggcugggauacccgcaucacgcucgaggaccugaagaacgaagagauggugaccaaucacaugaaaggggagcauaagaaauuggccgaagcuauuuucaagcugacauaccagaacaaggugguccgaguucagcggccaacuccuagaggaaccgugauggacaucauuuccaggaaagaucaacgcggcagcggucagguagggacauauggacucaauacuuucaccaacauggaggcccagcuuauaagacaaauggaaggcgagggcaucuuuaagaauauucagcaccugacggcaacagaggaaaucgcugugcagaacugguuagcccgggucgggagggagcgucugucucgaauggcuaucucaggagacgauugcgugguuaaacccauugacgaucgcuucgccagugcauugaccgcgcucaaugacauggguaaggugagaaaagauauacagcaaugggaaccaucccggggcuggaacgacuggacucagguccccuuuugcagccaccauuuccacgagcuggugaugaaggaugggagggucuuaguugugccuugucgcaaccaggacgaacuuaucggcagagcacggauuucucagggagcugguuggucgcugaaggagacagccugccucgggaaaucauacgcacaaauguggacccugauguauuuucauaggcgagauuugcguuuagcugccaaugcaaucuguagcgccgucccaucccacugggugccgacaaguagaaccacauggucuauucacgcgaagcaugaguggaugacgaccgaagacaugcuggcuguguggaaccgcgucuggauccaggagaaucccuggauggaagauaaaacuccuguugagagcugggaagaggugccauaccucggaaagcgggaggaccaguggugcggcucccuuauaggccugacaucaagggccaccugggccaaaaacauccagacugccauuaaucaaguaagaagucuaaucgggaacgaaggauauacagacuacaugcccucuaugaagcgcuuccggagggaggaagaggaagcuggugugcugugguga

SEQ ID NO: 14295 - RNA, 9876 nt, Artificial Sequence
  derived and/or modified CDS sequence (opt3) from DENV-2__KP188553__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguuuuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagauggucaucccaaaaaacuucgcaggccccgugagccagcacaacuaccgaccugguuaucauacccaaacagcuggcccauggcaccucgggaagcuggaaauggauuuugacuucugugagggaacuaccguuguggucacagaagauugcgagaaaagaggccccucucuaaggacgaccacugccuccgggaagcugaucacagaguggugcugucgcucaugcacccucccgccucugcgguacagaggagaagacggcuguugguacgguauggagauuaggccacuuaaggaaaaagaggaaaauuuggugaacagucugguuacugcggggcauggacagaucgauaauuuuagcuuaggcgugcucgguauggcccuguuccuugaggagaugcugcgcacacgaguaggcaccaagcacgcuauuuugcucgucgcacugucguuugugacgcuaauaacugggaacauguccuuccgggaccugggacgugugauggucaugguuggcgccaccaugacagaugacaucgggaugggagugaccuaucucgcucugcuugccgcauuuaaaguaagacccacuuucgcggccggcuugcuguuaaggaagcucacaucuaaagaacugaugauggcuaccauugguaucgcccuucugagccagucaacacuaccugagacuauucucgaacugaccgaugcauuggcucuggggaugauggccuuaaagaucgugcgcaauauggagaaguaccaacucgcagucacgauaauggccaucaguugcgugcccaacgcuguuauucugcagaaugcguggaaaguguccuguacaauccuugccgcagucucugugagcccacuguugcucaccuccucacagcagaaggcugacuggauuccucuggcccuaacuaucaaaggacugaaccccaccgccauauuucuuacaacucucagccggaccaguaagaaaagaucuuggccacugaaugaagcuauuauggcaguuggcaugguguccaucuuggccagcucgcuguuaaagaacgacaucccgaugacgggcccucucgucgcggggggacugcuuacaguaugcuaugugcugaccgguaggucagcugauuuggagcucgagcgagccgcagacguuaaaugggaagaucaagccgagauuucuggcaguucccccauacugagcaucacuauuucugaagacgggagcauguccaucaagaaugaggaggaagagcagacacuaaccauucugauccgcacuggacuucucgugauaucaggcgucuucccagugaguauccccauuacagcugcagccugguaccugugggaaguaaagaaacagcgggcggguguguugugggaugucccuagcccacccccuguugggaaggcugaguuagaagacggagccuauagaaucaaacagaggggcauucugggcuacucucaaaucggggcaggaguguauaaggaggguaccuuucacacgauguggcaugugacucguggcgccguccucaugcaccgcgggaaacggauagagccguccugggcugaugugaagaaggaccugauuucauacggaggcgguuggaaacuugaaggggaguggaaggaaggagaggaaguucagguacuggccuuggagccaggcaaaaaccccagagcagugcagaccaagccuggcaucuucaaaacaaauaccgggacaaucggagcugucagucuagauuuuagcccagguacuuccggcucucccauuguggacaggaaggggaagguugugggacuguacggcaacggugucgugacccgaucgggggccuauguaagcgcgaucgcccagacggagaaaucaauagaagauaauccugagauugaagacgauaucuuccggaagaaacgccucacaauuauggaccugcauccgggagcaggcaagacuaaaagauaccuucccgcuaucgucagggaggccauaaagcggggcuuacgaacccugauucucgcuccaacaagagugguugcagccgaaauggaggaggccuugcgcgggcugccuaucagguaucaaacccccgcuauccgugcggaacacacuggacgggagauuguggaccucaugugucaugcaaccuucacaaugagacugcuuuccccagucagggugccuaacuacaaccugaucauuauggaugaagcccacuuuacggaccccgcuaguauagccgcacgcgguuauaucucuacucgaguugagaugggcgaggccgcugggauuuucaugaccgcgacaccaccgggaagcagagauccuuuuccccaguccaaugccccaaucauggacgaagagcgggaaauccccgagaggucauggaacucuggccacgaaugggugaccgauuucaaggguaaaacugucugguuugugccuagcauuaaggcagggaaugacauagcugccugcuugcgcaaaaacggaaagaaaguaaucccauacagucguaagacauucgauuccgaguaugugaagaccagagcaaaugacugggauuuuguugucacgacugacauuagcgagaugggcgccaacuucaaagcugaacgggugaucgaucccaggcgcuguaugaagccugugauucuaacagacggcgaggaacgagucauccuggccgggccgaugccaguaacccauucuucagcggcacagagacggggaaggauaggucgcaaucccaaaaacgagaaugaccaauacaucuacaugggcgaaccucucgagaacgaugaggacugcgcccacuggaaggaagcuaaaauguuacuggauaauauuaacacccccgaggggaucauuccauccauguuugaaccugagagagaaaagguggacgccaucgauggagaguauaggcuucggggcgaggcucguaaaacuuucguugaccugaugcgccgaggugaucuccccgugugguuggcauacaaggucgccgcugaagggauaaauuaugccgacagaaagugguguuuugauggcauuaaaaacaaucagauccuggaggaaaacguggagguugagauuuggacaaaggaaggagagaggaaaaagcucaaaccacgguggcuggacgcacgcaucuacagugauccucuugcgcuaaaggaauucaaggaguucgccgcuggcagaaaaagccugaccuugaacuuaauaacagaaauggggaggcugccgacuuuuaugacgcagaaggcccggaaugcacucgacaaccuggcugugcuucauaccgccgaggucggagguaaagcauauacacacgcccugucggagcuccccgaaacuuuggagacccugcuacugcucacacuucuggcugcggugaccggcgggaucuucuuauuuuugaugucuggaaagggcauugguaaaaugacucuggggaugugcugcaucauuacggccuccauccuccugugguacgcacagauacaaccacacuggauugcugccagcaucauccuugaauucuuucugauuguacucuugaucccugagcccgaaaagcagcgaaccccacaggauaaucagcugacauaugugguuauagccauuuuaacugucguggcagcuaccauggccaacgagaugggcuuccuagagaagacaaaaaaggaccugggauuuggcucaaucaccacucaagaaagugagucuaauauucucgacaucgaucuuagaccugcguccgcuuggacacuguacgccguggcaacgaccuucgucacucccauguugcgccauagcauagaaaacucaaguguuaaugugagccugacagccaucgcuaaccaggcaaccguacucauggggcugggaaaagguuggccgcuuuccaagauggacauuggcgugccacuccuggccaucggguguuacucucaggucaauccuauuaccuugacagcggcucuguuacuacugguggcccacuaugcaaucauuggacccggccuccaggccaaagcuacuagggaggcccaaaagcgggcagcugccgguaucaugaagaacccaacgguugaugggauaaccgugauugaccuugaacccaucccuuacgauccgaaauuugagaagcagcugggccaggucauguugcugauccucugcguaacacaggugcugaugaugcguacuaccugggcgcuuugugaggccuuaacacuggcaaccggacccauuagcacucucugggaaggcaauccagggagauucuggaacacgacaauagcuguuuccauggccaauaucuuuaggggaucauauuuggcaggcgcuggucugcuauucucuauuaugaaaaacaccacuaauacccgccgggggacaggaaacgugggcgagacucugggugaaaaguggaaaagucgacucaaugcccuuggcaagucggaguuucaaaucuacaaaaagagcgggauucaggaggucgacagaacccuggccaaggaaggaaucaaaaggggcgagacagaucaucacgcggugucccgcgggucugcuaaguugcggugguucgucgaaagaaacauggugacgccugagggaaaaguuguggaccugggcugcggucgugggggauggucauauuacuguggcggucucaagaacguaagggaagugaaaggccugaccaaggggggacccggccaugaggagccuauaccaaugagcacuuauggguggaauuuaguccggcuucaguccggaguugauguguucuuuacacccccugaaaagugcgacacccugcucugugauaucggcgagaguucuccaaaccccacuauugaagcaggucgcacacuacgaguccugaauuugguggagaacuggcugaauaacaauacccaauucugcaucaaaguacucaacccguacaugccuagcgugauugaaaagauggagacgcuucagagaaaauacgggggagcccugguuaggaauccauugucacggaacuccacccacgagauguauugggugaguaaugcuacaggcaacaucgucagcucugugaauaugauaucccgcaugcugauuaacagauuuacuaugaagcacaaaaaggccaccuacgaacccgacgucgaucucggcucagggacaaggaauaucggaaucgagagcgaaacuccuaacuuagacauuauagguaagcgaaucgagaaaauuaagcaggaacaugagaccucguggcacuaugaccaggaucauccauacaaaacaugggcauaucacggcucuuacgagaccaagcaaacugggagugccuccagcauggugaacggaguuguacggcugcuuacgaaacccugggacguggucccgauggugacacagauggcuaugaccgauacuaccccuuucggccagcagcguguuuuuaaggaaaagguggacacaagaacgcaagagcccaaagaagguaccaagaaacugaugaagaucacugcggaguggcuauggaaagagcucgggaaggaaaaaacaccacgcauguguaccagggaggaauucacucggaaggucagaucaaaugccgcacugggagcuguguuuacagaugagaacaaguggaaauccgcccgcgaagcaguagaggacggcagguucugggaguugguggaucgagaacggaaucugcaccucgagggcaagugcgaaaccuguguuuauaacaugauggggaaaagagagaagaaacuuggagaauuugguaaggccaagggcucuagggcuauuugguacauguggcugggggcccgcuucuuagaguuugaggcgcugggauucuugaaugaagaccauugguuuagccguggcaacagucucuccggugucgagggggaaggacugcaccggcuaggcuacauccuuagagaggugggcaaaaaggaagggggagcaauguaugccgaugacacagcugguugggauacuaggauaacccuggaggaccucaaaaaugaggaaauggugacgaaccauaugaagggcgagcacaaaaagcuggccgaagcaaucuucaaguugaccuaccagaauaaagucguucgcgugcagcgaccuacaccccgggggacuguaauggacauuaucagcagaaaggaucagaggggaucuggccaaguggguaccuaugggcugaacacauucacuaauauggaggcucagcucauucgccagauggagggagaaggcaucuuuaaaucaauucaacaucuuaccgccacggaggaaacagcuguccagaacuggcuggccagagugggccgggagagguuaagucguauggcaauauccggggacgauugcguugugaagccaaucgacgaucgauucgcgagcgcccugaccgcuuugaaugacaugggaaaaguccgcaaggauauucagcagugggaacccucuagagguuggaacgacuggacucaagugccuuuuugcucgcaccacuuccaugagcucguaaugaaggauggccggguucugguggucccauguaggaaucaggacgagcuaaucgggcgcgccagaaucucacagggagcaggcuggagccuuaaagaaacagcuugccuggguaaguccuacgcccagauguggacccucauguauuuucaccggagggaucugcgauuggcagccaacgcgauuuguagugcugugccgucucauugggugcccacuagccguaccacaugguccauacacgccaaacacgaguggaugacgaccgaagacauguuagcagucuggaacagaguuuggauccaagagaauccuuggauggaagauaagacuccaguggagucaugggaggaaguacccuaccuggggaaacgcgaggaccaguggugcggaagucucauuggccuuacaucucgggccaccugggcuaagaacauccagacugccauuaaucaggugaggagccugaucggcaacgaaggguauacagacuacaugccuuccaugaagagauuccgccgggaggaagaggaggcaggaguccuaugguga

SEQ ID NO: 14296 - RNA, 9876 nt, Artificial Sequence
  derived and/or modified CDS sequence (opt3) from DENV-2__KP188556__SS-prME
accgccggcgugaucgucaugcugauuccaacagcuauggcguuccaccucacuacgagaaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagauggucauccccaagaacuucgcaggccccgugagccagcacaacuaccgaccugguuaucauacccaaacagcuggcccauggcaccucgggaagcuggaaauggauuuugacuucugugagggaacuaccguuguggucacagaagauugcgagaaaagaggccccucucuaaggacgaccacugccuccgggaagcugaucacagaguggugcugucgcucaugcacccucccgccucugcgguacagaggagaagacggcuguugguacgguauggagauuaggccacuuaaggaaaaagaggaaaauuuggugaacagucugguuacugcggggcauggacagaucgauaauuuuagcuuaggcgugcucgguauggcccuguuccuugaggagaugcugcgcacacgaguaggcaccaagcacgcuauuuugcucgucgcacugucguuugugacgcuaauaacugggaacauguccuuccgggaccugggacgugugauggucaugguuggcgccaccaugacagaugacaucgggaugggagugaccuaucucgcucugcuugccgcauuuaaaguaagacccacuuucgcggccggcuugcuguuaaggaagcucacaucuaaagaacugaugauggcuaccauugguaucgcccuucugagccagucaacacuaccugagacuauucucgaacugaccgaugcauuggcucuggggaugauggccuuaaagaucgugcgcaauauggagaaguaccaacucgcagucacgauaauggccaucaguugcgugcccaacgcuguuauucugcagaaugcguggaaaguguccuguacaauccuugccgcagucucugugagcccacuguugcucaccuccucacagcagaaggcugacuggauuccucuggcccuaacuaucaaaggacugaaccccaccgccauauuucuuacaacucucagccggaccaguaagaaaagaucuuggccacugaaugaagcuauuauggcaguuggcaugguguccaucuuggccagcucgcuguuaaagaacgacaucccgaugacgggcccucucgucgcagggggacugcuuacaguaugcuaugugcugaccgguaggucagcugauuuggagcucgagcgagccgcagacguuaaaugggaagaucaagccgagauuucuggcaguucccccauacugagcaucacuauuucugaagacgggagcauguccaucaagaaugaggaggaagaacagacacuaaccauucugauccgcacuggacuucucgugauaucaggcgucuucccagugaguauccccauuacagcugcagccugguaccugugggaaguaaagaaacagcgggcggguguguugugggaugucccuagcccacccccuguugggaaggcugaguuagaagacggagccuauagaaucaaacagaggggcauucugggcuacucucaaaucggggcaggaguguauaaggaggguaccuuucacacgauguggcaugugacucguggcgccguccucaugcaccgcgggaaacggauagagccguccugggcugaugugaagaaggaccugauuucauacggaggcgguuggaaacuugaaggggaguggaaggaaggagaggaaguucagguacuggccuuggagccaggcaaaaaccccagagcagugcagaccaagccuggcaucuucaaaacaaauaccgggacaaucggagcugucagucuagauuuuagcccagguacuuccggcucucccauuguggacaggaaggggaagguugugggacuguacggcaacggugucgugacccgaucgggggccuauguaagcgcgaucgcccagacggagaaaucaauagaagauaauccugagauugaagacgauaucuuccggaagaaacgccucacaauuauggaccugcauccgggagcaggcaagacuaaaagauaccuucccgcuaucgucagggaggccauaaagcggggcuuacgaacccugauucucgcuccaacaagagugguugcagccgaaauggaggaggccuugcgcgggcugccuaucagguaucaaacccccgcuauccgugcggaacacacuggacgggagauuguggaccucaugugucaugcaaccuucacaaugagacugcuuuccccagucagggugccuaacuacaaccugaucauuauggaugaagcccacuuuacggaccccgcuaguauagccgcacgcgguuauaucucuacucgaguugagaugggcgaggccgcugggauuuucaugaccgcgacaccaccgggaagcagagauccuuuuccccaguccaaugccccaaucauggacgaagaacgggaaauccccgagaggucauggaacucuggccacgaaugggugaccgauuucaaggguaaaacugucugguuugugccuagcauuaaggcagggaaugacauagcugccugcuugcgcaaaaacggaaagaaaguaauccagcuaagucguaagacauucgauuccgaguacgugaagaccagagcaaaugacugggauuuuguugucacgacugacauuagcgagaugggcgccaacuucaaagcugaacgggugaucgauccaaggcgcuguaugaagcccgugauucugacagacggcgaggaacgagucauccucgccgggccuaugccgguaacccauucuucagcggcacaaagacggggaaggauaggucgcaaucccaagaacgagaaugaccaguauaucuacaugggcgaacccuuagagaacgaugaggacugcgcccacuggaaggaagcuaaaaugcugcuugauaauauuaacaccccugaggggaucauucccuccauguuugaaccagagagagaaaagguggacgccaucgauggagaguacaggcugcggggcgaggcucguaaaacuuucguugaccucaugcgccgaggugauuugccuguguggcuggcauauaaggucgccgcugaagggauaaauuacgccgacagaaagugguguuuugauggcauuaaaaacaaucagauccucgaggaaaacguggagguugagauuuggacaaaggaaggagagaggaaaaagcugaaaccccgguggcuugacgcacgcaucuauagugauccacuagcgcugaaggaguucaaggaguucgccgcuggcagaaagagcuugaccuuaaaccugauaacagaaauggggaggcucccuacuuuuaugacgcagaaggcccggaaugcacuggacaaccuugcugugcugcauaccgccgaggucggagguaaagcauacacacacgcccucucggaguugccggaaacucuggagacccuacugcuccuuacacuguuagcugcggugaccggcgggaucuucuuguuucugaugucuggaaagggcauugguaaaaugacucucgggaugugcugcaucauuacggccuccauccugcuuugguaugcacaaauacagccccacuggauugcugccagcaucauccuggaguucuuucucauuguauugcugaucccagagccugaaaagcagcgaacaccacaggauaaucaauuaacauacgugguuauagccauucuaacugucguggcagcuaccauggccaacgagaugggcuuccuggagaagaccaagaaagaccucggauuuggcucaaucaccacucaggaaagugagucuaauauucuugacaucgaucugagaccagcguccgcuuggacauuguaugccguggcaacgaccuucgucacuccuaugcugcgccauagcauagaaaacucaaguguuaaugugagccucacagccaucgcuaaccaggcaaccguacugauggggcuuggaaaagguuggccccucuccaaaauggacauuggcgugccgcuguuggccaucggguguuacucucaggucaauccaauuacccugacagcggcuuuacuacugcucguggcccacuacgcaaucauuggaccuggccuucaagccaaagcuacuagggaggcccagaagcgggcagcugccgguaucaugaagaaccccacgguugaugggauaaccgugauugaccuggaaccaaucccccaugauccuaaauuugagaagcaguugggccaggucaugcugcucauccugugcguaacacaagugcuuaugaugcguacuaccugggcguuaugugaggcccugacacucgcaaccggaccgauuagcacuuugugggaaggcaaucccgggagauucuggaacacgacaauagcuguuuccauggccaauaucuuuaggggaucauaucuggcaggcgcuggucuacuguucucuauuaugaaaaacaccacuaauacccgccgggggacaggaaacgugggcgagacucucggugaaaaguggaaaagucgacuuaaugcccugggcaagucggaguuucagaucuacaaaaagagcgggauucaggaggucgacagaaccuuggccaaggaaggaaucaaaaggggcgagacagaucaccaugcggugucccgcgggucugcuaagcugcggugguucgucgaaagaaacauggugacgccagagggaaaaguuguggaccucggcugcggucgugggggauggucauauuacuguggcggucugaagaacguaagggaagugaaaggcuuaaccaaagggggaccuggccacgaggagcccauaccuaugagcacuuauggguggaaucuuguccggcugcaauccggaguugauguguucuuuacaccacccgaaaagugcgacacccuccuaugugauaucggcgagaguucuccuaacccaacuauugaagcaggucgcacacugcgagucuugaaucugguggagaacuggcucaauaacaauacccaguucugcaucaaaguacuuaaccccuacaugccgagcgugauugaaaagauggagacgcugcagagaaaauaugggggagccuugguuaggaauccucugucacggaacuccacccacgagauguacugggugaguaaugcuacaggcaacaucgucagcucugugaauaugauaucccgcaugcucauuaacagauuuacuaugaagcauaaaaaggccaccuacgaaccagacgucgauuuaggcucagggacaaggaauaucggaaucgagagcgaaacucccaaccuggacauuauagguaagcgaaucgagaaaauuaagcaggaacacgagaccucguggcauuaugaccaagaucacccuuacaaaacaugggcauaucacggcucuuacgagaccaagcagacugggagugccuccagcauggugaacggaguuguacggcuucugacgaaaccaugggacgugguccccauggugacacagauggcuaugaccgauacuaccccguucggccagcaacguguuuuuaaggaaaagguggacacaagaacgcaggagccuaaagaagguaccaagaaacuaaugaagaucacugcggaguggcucuggaaagagcuggggaaggagaaaacaccccgcauguguaccagggaggaguucacucggaaggucagaucaaaugccgcauugggagcuguguuuacagaugagaacaaguggaaauccgcccgcgaagcaguagaggacggcagguucugggagcugguggaucgagaacggaaucuccaucuugagggcaagugcgaaaccuguguuuauaacaugauggggaaaagagagaagaaacugggagaauuugguaaggccaagggcucuagggcuauuugguacaugugguuaggggcccgcuuccuggaguuugaggcguugggauuccucaaugaagaccacugguuuagccguggcaacagucuguccggugucgagggggaaggacuacaucggcuuggcuauauccugagagaggugggcaaaaaggaagggggagcaauguacgccgaugacacagcugguugggauacuaggauaacccucgaggaccugaaaaaugaggaaauggugacgaaccacaugaagggcgagcauaaaaaguuggccgaagcaaucuucaagcugaccuaccagaauaaagucguucgcgugcagcgaccaacaccucgggggacuguaauggacauuaucagcagaaaggaucaaaggggaucuggccagguggguaccuaugggcucaacacauucacuaauauggaggcucagcuuauucgccaaauggagggagaaggcaucuuuaaaucaauucagcaccugaccgccacggaggaaacagcuguccagaacugguuagccagagugggccgggagaggcugagucguauggcaauauccggggacgauugcguugugaagcccaucgacgaucgauucgcgagcgccuugaccgcucucaaugacaugggaaaaguccgcaaggauauucagcaaugggaaccaucuagagguuggaacgacuggacucaggugcccuuuugcucgcaccauuuccacgagcugguaaugaaggauggccggguucuaguggucccuuguaggaaucaggacgagcuuaucgggcgcgccagaaucucacagggagcaggcuggagccugaaagaaacagcuugccucgguaaguccuacgcccaaauguggacccugauguauuuucaucggagggauuugcgauuagcagccaacgcgauuuguagugcugugccaucucacugggugccgacuagccguaccacaugguccauacacgccaaacaugaguggaugacgaccgaagacaugcuggcagucuggaacagaguuuggauccaggagaaucccuggauggaagauaagacuccuguggagucaugggaggaaguaccauaccucgggaaacgcgaggaccaguggugcggaagucuuauuggccugacaucucgggccaccugggcuaagaacauccagacugccauuaaucaagugaggagccuaaucggcaacgaaggguauacagacuacaugcccuccaugaagagauuccgccgggaggaagaggaggcaggaguccugugguga

SEQ ID NO: 14297 - RNA, 9876 nt, Artificial Sequence
  derived and/or modified CDS sequence (opt3) from DENV-2__GU369819__SS-prME
accgccggagugauagucaugcugauucccacagcuauggcauuccaccucacuacgagaaacggggagccucauaugauaguuggaaggcaggaaaaggguaaaagccuucuguuuaagaccgaggacggagugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguugacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggagaauaaagcauggcucguccaccggcagugguuucuggacuuaccucugccauggcuccccggcgcugauacucagggaagcaacuggauacagaaggagacacuugugacguucaagaauccucaugccaaaaagcaagacguugugguccugggcucucaggaaggggcgaugcacaccgccuugacuggagcaacagagauucagauguccucagguaaccuacuguuuaccggccaucucaaaugccgucugcgcauggacaaacuucaacugaaagggaugagcuacaguauguguacaggaaaguucaagaucgugaaagaaaucgcugagacucagcacggcaccauuguaaucagaguucaguaugagggugaugggucuccaugcaagauucccuucgaaauaacggacuuggagaaaaggcaugugcucggccggcugaucaccgucaacccgauugugacagaaaaggauuccccugucaauaucgaggccgaacccccauuuggagacagcuacaucauuauaggcguggagccugggcaguuaaaacugaacugguucaagaagggaucgucuaucggucaaauguuugagacuaccaugcgaggcgcuaaacgcauggccauucuaggggauacagcaugggacuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguaagggcugauuccgggugugugguuagcuggaagaacaaagaacugaagugcggaucuggcauuuucaucacugacaauguccacacauggaccgagcaguacaaguuucagcccgaaucaccaaguaaauuggccagcgcaauacaaaaggcccaugaggaagguauuuguggcauccgguccgugacucgccucgagaaccugauguggaaacagauuacccccgaguuaaaucacauccugucugaaaacgaggugaagcuaacaauaaugacgggggauaucaaaggaauuaugcaggcuggcaagagaucgcucaggccucagccaaccgaacugaaauauagcuggaagacuugggggaaggccaaaaugcuuuccacagagucacauaaucaaaccuucuugaucgacggaccggaaacagcagagugccccaacacuaaucgugcguggaacagucuggaggucgaagauuacggcuuugguguuuucaccacgaauauuuggcucaagcugcgggagaaacaggacguguuuugugacucuaaguuaaugagcgcugccaucaaagauaaccgagcagugcacgccgacaugggguauuggauagaauccgcucugaaugauacauggaagauggagaaggccucauucauugagguaaaaagcugccacuggccuaagucucauacccuuugguccaacggagucuuggaaagugagaugaucauccccaagaauuucgcaggccccgugagccagcacaauuacagaccugguuaucauacucagaccgcuggcccauggcaccucgggaagcuggaaauggacuuugaucuaugugagggaacaacuguuguggucaccgaagacugcggcaacagggggcccucucugcgcacaacgaccgccuccggaaaacucauuacugaguggugcugucggucaugcacacugccgccucuuagauacaggggcgaggaugguuguugguacgggauggaaauccgcccauugaaggagaaggaagagaaucuggugaacaguuuaguuaccgcgggacauggccaaauugacaauuucagccucggugugcugggcauggcccuuuuucuggaagagauguugcgaacucggauagggacaaaacacgcuauccuccugguagcagucucguucgugacccuaauuacgggaaacauguccuuucgugaucugggcagagugauggucaugguuggggccacuaugaccgacgauaucggaaugggcgugacauaucucgcucugcuugccgcauucaagguaaggcccaccuuugcggccgguuugcuguuacgcaaacucacuucuaaggagcugaugauggcuacaauugggaucgcccuucugagccagucaaccauaccugaaacaauccuagagcucacugacgcacuggcuuugggaaugauggugcugaaaauuguccggaauauggaaaaguaccaguuagccgugaccaucauggcaauuaguugcguucccaacgccgugauccuccaaaaugcuuggaaggucuccuguacgauacuggcggccgugucuguuagcccacuucuguugacauccucacagcagaaagcagauuggauuccucucgcucugaccaucaagggccuaaaccccacugccaucuuccugaccacacuuagcagaacaaguaaaaagaggucuuggccacucaaugaggccauuauggcugugggcauggucuccauacuggcaagcucguugcugaaaaacgacaucccgaugaccgggccuuuaguagccggaggucuccugacggugugcuauguucuuacaggccgaucagcggaccuggaauuggagcgcgcugccgaugugaagugggaggaccaggcagaaauuucugggaguucccccauccucagcauuaccaucucugaggauggaagcauguccaucaaaaaugaagaggaggaacaaacucugacaauccuaauucggaccggccugcuugucaucucagguguguuuccaguaaguauucccaucacugccgcugcaugguaccucugggaggugaagaagcagagagccgggguccugugggacguuccuagcccacccccugugggaaaagcggaauuggaggauggcgcuuauaggauaaagcagaaaggcauuuuaggguacucucagaucggagccgguguguauaaggaaggcacauuccacaccauguggcaugucacgcguggggcagugcugaugcaccgcggaaaacggaucgagccguccugggccgacguuaagaaggaucucauuucauacggcgguggguggaaacuggagggagaauggaaggagggcgaagagguacaagugcuugcucuggaaccaggcaaaaaccccagagccguccagacuaagccugggaucuuuaaaaccaauacaggaaccauaggugcagugaguuuggacuucagcccaggcacauccgggucucccauuguugauaggaagggaaagguggucggccuauacgguaacggggugguaacucgaucgggagcuuaugucagcgccaucgcgcagaccgagaaaucaauugaggacaacccugaaaucgaggaugacauauuucggaagaaacgccugacgauuauggaucuccauccgggcgccggcaagacaaaaagauaccugcccgcaaucgugagggaagcuaucaagcgggggcuucgaacuuuaauucuggccccaaccagaguuguggcugcagagauggaagaggcccuccgcggauugccuaucagguaucagacacccgccauuaagaccgagcacacuggucgugaaauagucgaccugaugugucaugcuaccuucacaaugcggcuccuguccccagugagaguuccuaauuacaaccuuaucauuauggacgaggcgcacuucacggaucccgcaaguaucgccgcuaggggcuauaucucuacucgcguggaaaugggggaggccgcaggaauuuuuaugaccgccacaccaccgggcagccgagacccuuucccccaauccaaugcuccaauaauggaugaggaaagagagauccccgaacggucauggaacucuggucacgagugggucaccgacuuuaaagggaagacugugugguucguaccuagcauuaaagcgggaaaugauaucgccgcaugccugaggaagaacggcaaaaaggugauucaguugagucgcaagacauuugacuccgaauacguuaaaacccgugcuaaugauugggacuucgucgugacgacugauaucagcgagaugggcgccaacuuuaaggcagagagagugauagacccacggagguguaugaaacccgucauccuaacagauggggaagaacgcguaauucuggccggaccuaugccggugacccauucuucagcugcccagcgaagaggucggaucggcaggaauccaaagaacgaaaaugaccaauauauuuacaugggggagccccucgaaaacgacgaggauugcgcgcacuggaaagaggcaaagauguuacuggacaauaucaacaccccugaaggaauaauucccuccauguucgagccagaacgcgagaaaguugaugccaucgacggcgaauacagacuuaggggugaggcucggaagacuuuuguggaucugaugcgucgcggggaccucccugucugguuggccuauaagguggcugcagagggcauuaauuacgccgaucgaaaaugguguuucgacggaaucaagaacaaccagauacuggaagagaauaucgaaguugagauuuggacaaaagagggcgaaagaaagaaacucaagcccagguggcuggaugcucggaucuauagugacccacuugcccuaaaggaguuuaaagaguucgcagcggggcgcaagagccugaccuugaacuuaauuacagagaugggaagacugccuacuuucaugacgcagaaagccaggaaugcucucgauaaccuggccgugcuucauaccgcagaagcugguggccgggccuacaaucacgcacugucggagcucccggagacauuggaaacucugcuacugcucacccuucuggccacagucaccgggggaaucuuuuuauucuugaugucuggccgagguauagggaagaugacucugggcaugugcugcauuaucacggcuuccauccuccugugguaugcgcagauucaaccccacuggaucgccgcaagcauaauucuugaguuuuuccugaucgugcucuugauuccagaaccugagaaacagagaaccccacaggacaaccagcugacauacguagugaucgcuauauuaacuguugucgccgccaccauggcaaaugaaaugggauuucuagagaagacaaagaaagaucugggccucgggucaaucaccacucaagagagugaaucuaacauucuugacaucgaccugcgcccagcuuccgccuggacauuguaugcgguggcuacgaccuucgugacuccuaugcugaggcauagcauugaaaauucaagugucaacguuagccucacagccaucgcaaaucaggccaccgugcugaugggacuugguaagggcuggccccucuccaaaauggauauugggguaccgcuguuggcuaucggauguuacucucaggugaacccaauaacccugacagcagccuuacuacugcucgucgcgcacuacgcuauuaucggcccuggucuucaggccaaggcaacucgggaagcccaaaaacgugcugccgcagggaucaugaagaaucccacgguggacggcauuaccguuauagaucuggagccaauccccuaugacccuaaguuugaaaaacaguugggacaggugaugcugcucauucugugcgucacacagguacuuaugaugagaacuaccugggcuuuaugugaggcccugacacucgcgaccggcccgaucagcacuuugugggaggggaaccccggaagguucuggaauacgacaauugccguguccauggcaaacaucuuucgcggcucauaccuggcuggugccgggcuacuguucucuauaaugaagaauaccacuaacacccggcgaggaacaggcaacaucggugaaacucucggcgagaaauggaagaguagacuuaaugcacuggggaaaucggaauuucaaguuuauaagaaaagcggcauucaggagguggauaggaccuuggcuaaggagggcaucaagcgcggggaaacagaccaucacgccgucucccggggaucugccaaacugagaugguucguggagcguaacauggucacgccagaaggcaaggugguugaucucgguugcgggaggggaggcuggucauacuauugugguggccugaaaaaugugcgggagguaaagggguuaaccaaaggaggcccugggcaugaagaacccauuccuaugagcacuuacggauggaaccuugugcgccugcaguccggcgucgacguauuuuucacaccacccgagaagugcgauacccuccuaugugacaucggugaaaguucuccuaauccaacuauagaggcggggcgaacacugagaguguugaaccuggucgaaaauuggcucaacaauaacacccaauucugcauuaaggugcuuaaucccuauaugccgagcguaaucgagaaaauggaagcucugcagaggaaguacggaggcgcauuggugcggaacccucugucacgcaauuccacgcacgagauguacuggguuaguaacgccaccggcaauaucgugagcucugucaacaugauuuccagaaugcucauaaacagguuuacaaugaaacacaagaaagcuacuuaugagccagauguggacuuagggucaggaacccgaaauaucgguauugaaagcgagauccccaaccuggauauuaucggcaagcggauagaaaagaucaaacaggagcaugaaacaucguggcacuacgaccaggaccauccuuauaagacuugggccuaccacgggucuuaugagaccaaacaaacaggaagugcauccagcauggucaauggcgugguucgucuucugaccaagccaugggauguacuacccauggugacucagauggccaugacggacacaaccccguucggucagcagagagucuuuaaagagaagguggauacucgcacccaagaaccuaaggaggggacgaaaaagcucaugaaaauuacagcugaauggcuguggaaggaguugggcaaaaagaaaacccccaggauguguacucgggaggaguucacaagaaagguucgcucaaacgcggcccugggcgcaaucuuuaccgacgagaauaaguggaaauccgcuagggaagccguggaggauggccgauucugggaacucgucgaccgggagagaaaccuucaccuggaggggaagugcgaaacuuguguguacaauaugaugggaaaaagggagaagaaauuaggugaauuuggcaaggcaaaggggucucgcgccauuugguauauguggcugggagcucguuucuuggaguuugaagcccucggcuuccugaacgaggaucauugguuuagccgggguaauagucuauccgggguagagggagaaggccuucacagacugggcuacauccucagggacguggggaaaaaggagggaggugcgauguacgcagaugacacagccggcugggauacccgcauuacacuggaagacuugaaaaacgaggaaaugguuacuaaucauaugaagggggagcacaaaaagcuggcugaggccauauucaagcucaccuaucagaacaaagucgugcgagugcagcggccaacgccuagaggaaccgucauggacaucauuagcaggcgcgaucagagaggcucuggucaaguugggacauacggacuuaauacuuuuaccaacauggaagcacagcugauccggcagauggagggcgaaggcaucuucaagucaauucaacauuuaacagcuacugaggagauagccgugcagaauuggcuggcuaggguagggcgugaacgauugagucgcauggccaucuccggagacgauugcguggucaaacccauugacgauagauucgcaagcgcgcucaccgcccugaacgacauggguaaggugcggaaagauauccagcagugggagccaucuaggggcuggaacgacuggacgcaaguucccuuuugcucgcaccacuuccaugagcuagugaugaaggaugggcgcguccuugugguaccuuguagaaaucaggacgagcugauuggacgggcuaggaucucacagggcgccgguuggagccucaaggaaacagcaugccuggggaaauccuaugcucagauguggaccuugauguacuuucaccgacgugauuuaagacuggccgcaaacgccauauguagugcgguuccaccgcauugggugcccacuucucgcacaaccuggagcauccacgcuaagcacgaguggaugacuaccgaggacaugcucgccgucuggaaucggguguggauucaagaaaacccuuggauggaggauaaaacaccaguggaauccugggaggaaguccccuaucuuggaaagagggaggaccaguggugcggcucacugaucggccuaacgaguagagcaaccugggccaaaaauauucagacugcuaucaaccagguucgcucucugauagggaaugaggaauacacagacuauaugccuagcaugaagcgguucaggcgagaggaagaggaagccggagugcucugguga

SEQ ID NO: 14298 - RNA, 9876 nt, Artificial Sequence
  derived and/or modified CDS sequence (opt3) from DENV-2__JX649147__SS-prME
accgcaggcgugaucauuaugcugauacccaccgcuauggcauuccaccucacuacgcggaauggggagccucauaugaucgucgggaggcaggaaaaggguaaaagccuucuguuuaagaccgaggacggcguuaauaugugcaccuugauggccauugauuuaggggaacugugugaggacacuaucaccuacaaaugcccacuacuccggcaauccgaaccggaggauauugacuguuggugcaacucuacgucaaccugggugacuuauggaacauguaccacgacuggcgagcaccgccgagaaaagcguagugucgcgcuggugccccaugucgguauggggcuugagacccggacagaaacuuggaugagcuccgagggagcuuggaaacacgcccagaggaucgagaccuggauacugcggcauccuggcuucacaaucauggcagccauuuuggcuuacaccaucggcacgacucacuuucagaaggcacucauuuucauccugcugacagccguggcuccaucuaugaccaugcgcugcauagggauuucgaauagagauuuuguugaaggagugucagguggcagcugggucgacaucgugcucgagcacgggaguuguguaacuacaauggccaagaacaaacccaccuuagauuucgaacugauuaagacggaggcgaaagaaccugcaacccuuaggaaguauugcaucgaggccaaauugacaaauacuaccacagagucccgguguccaacucagggagaacccucucugaacgaggaacaagacaagcgcuuuguuugcaagcauagcaugguggaucgaggcugggguaauggguguggacuauucggcaaaggcgggaucguaaccugcgcuauguuuacaugcaagaaaaacauggagggaaagauugugcagccugaaaaucucgaguacaccauagugaucacuccacacuccggugaggaacaugccgucggcaacgacacggggaaacacggaaaggagauuaaaaucacaccgcagucaaguauaaccgaagcagagcugacuggcuaugguaccguuacaauggaauguagccccagaaccgggcuugauuucaaugagauggugcuguugcagauggaggacaaggcuuggcucguacacaggcaaugguuucuggauuuaccucugccauggcuccccggcgccgacacucagggaucuaacuggauucagaaggaaacacuugugacguucaaaaauccucaugcgaagaaacaggacgucgugguucugggcucccaagagggggccaugcacaccgcauugacuggagcuacagaaauccagaugucaagcgguaaccuacuguuuaccggccaucucaagugccggcugcguauggauaaacuucagcugaaggggaugaguuacucuauguguacaggaaaguucaaaaucgugaaggagauugccgagacucaacacggcaccaucgucauucgcgugcaguaugaaggugacggguccccaugcaaaauacccuucgagaucauggauuuggaaaagagacauguacucggcaggcugauuacgguuaauccgaucgugaccgagaaagacagcccugucaacaucgaagcugagcccccauuuggagauucguacauuauaaucggcguggagccugggcaguuaaagcugaacugguucaagaaaggaucuuccauuggucagauguuugaaacaacuaugcggggcgccaagcgaauggcaauccuaggggacaccgccugggauuucggaucacucggcggugucuuuacaaguauugggaaagcucugcaccaaguguucggcgcgaucuacggagcagccuuuagcggcguuuccuggacuaugaagauacuuaucggggugauuaucaccuggauuggaaugaacucucgcagcacgucauugaguguaucccugguccucgugggcguuaucacacuguaucuuggugcuauggugcaggccgacagcgggugugucgugucuuggaaaaacaaggagcugaagugcggaucaggcauauucauuaccgauaauguacacacuuggacagaacaguacaaauuucagcccgagaguccaagcaaguuggcauccgccauccaaaaagcucaugaagaggguauuuguggcaucagaucugugaccaggcucgagaaccugauguggaagcagauaacucccgaauuaaaucacauccugucggagaacgaaguuaaacuaaccauuaugacaggggacaucaagggaauuaugcaggccggcaaacggagccuccgcccucagccaacggagcugaaguauuccuggaagaccugggggaaagcaaagaugcuuucaacugaaagucauaaucaaacauucuugaucgauggaccggagaccgcggagugccccaacaaaaauagagcuuggaacucucuggaagucgaggacuacggcuuugguguguucacaacuaauauauggcucaagcugagggaaaaacaggacguguuuugugauagcaaguuaauguccgccgcaauuaaggacaaccgugccguccacgcugauaugggguauuggaucgagucagcccugaaugacaccuggaaaauggagaaggccagcuucaucgaaguuaaaucuugccacuggccuaagucccauacgcuuuggaguaacggaguguuggagagcgaaaugauuaucccaaaaucuuucgcuggccccgugucccagcacaauuaccggccugguuauuacacacagaccgccggcccauggcaucucgggaagcuggagauggauuuugacuucugugaaggaacuaccguagucgugacagaggauugcggcaaccgagggcccucacuaagaacuaccacagcgaguggaaagcugauuacggaguggugcuguaggagcugcacccucccgccucugcgcuaccggggcgaagacgguuguugguaugggauggagauaagaccacuuaaagaaaaggaggaaaacuugguuaauucgcuggugacugccggacacggccaaaucgauaacuuuuccuuagguguccucggcauggcucuguuccuugaggagaugcugaggacacgcguggggaccaaacaugcaauuuugcucguugccgugucuuuuguaacucugaucacaggaaauaugagcuuccgagaccuaggccgggucauggugauggugggggcuaccaugacggaugacauuggaaugggcgucacuuaccuggcccuccuggcagcguuuaagguucgucccaccuucgccgcuggucuuuugcugaaaaaguuaacaucaaaggaacucaugauggccaccaucgggauagcacugcuuagucaguccacuaucccugagacaauucuggaacuaaccgaugcucucgcccugggaaugaugguguugaaaaucguaagaaacauggagaaguaucagcuggcagugacaauuauggccaucucuugcguccccaaugcugugauauuacaaaacgcguggaaaguuagcuguacuauucucgccgcaguguccgucucaccacugcuucugaccagcagucagcagaaggcugacuggaucccuuuggcccucacgaucaaaggccugaaucccacagccauuuuucuaaccacucugucuaggaccuccaagaaacgcagcuggccacuuaacgaagcuauaauggcagugggcaugguuucgauccucgccucaucucuguugaagaaugacauuccgaugacagggccucugguggcgggagguuuacucacugucugcuacguacugaccggccggagugcugaucuugagcuggagagagccacggacgugaagugggaagaucaggcagagaucuccgggagcucucccauuuugagcaucacaauauccgaagacggaucaaugaguaucaaaaacgaggaggaagaacaaacccucacuauucugaucaggacaggccuacugguuauuagcggucuuuucccaaugucuauccccauaaccgccgcugcaugguaucucugggaagugaagaaacagcgagccgggguccugugggaugugccuuccccacccccuguaggaaaggcggaguuggaagacggcgcuuaccgcauuaaacagaagggcaucuuaggguauucacagaucggagccgguguguacaaggagggcacuuuucacacaauguggcacgucaccagaggggcaguucugaugcauagaggaaaaaggauugagccgaguugggccgaugugaagaaagaccucaucagcuacggcgguggguggaagcuggaaggagaguggaaagaaggcgaggaagugcaaguccuugcucuggagccaggcaagaauccccgugccgugcagacgaagccuggguuguucaaaacuaacaccggaacaauaggugcaguuucccuagauuuuucuccaggcaccucggggagccccauuguagaccgcaagggaaaaguggucggccuguaugguaauggggugguuacacggucaggagcuuacguguccgccaucgcgcagacugagaagaguauugaagauaacccugagaucgaagacgauauauucaggaagaagaggcucaccauuauggaccugcacccgggcgccggcaagacgaaacgauaucuucccgcaaucguccgggaggcuaucaagcgcggguuaagaacacugauucucgccccaacuagggugguagcugcagaaauggaggaggccuugcggggacugccuauccgauaccagacccccgccauuagagcugaacauacaggucgcgagauagucgaccucaugugucacgcgaccuucacuaugaggcugcuuucuccagugcguguuccuaauuauaaccugaucauuauggaugaagcacauuuuaccgaccccgccagcaucgcugcccggggcuacaucuccacaagaguggagaugggggaggcagccggaauuuucaugacggcuacuccaccgggcucaagggauccuuuuccccaaucuaacgcgccaauaauggacgaagaacgcgaaauccccgagcgaagcuggaauaguggucacgaaugggucaccgauuucaaagggaagacagugugguuuguuccuuccauuaaagccggaaacgacaucgcagcuugcuugagaaagaauggcaagaaagugauucagcuaagccggaagaccuucgauucugaguaugucaaaacuaggacaaacgacugggauuuugugguaaccacggacaucucagagaugggcgccaauuucaaggcagaacgcgugauagauccacguagauguaugaaacccguuauccugacugacggggaggaacgggucauucucgccggaccuaugccggugacacacuccagugcugcccagaggcgcggucgaaucggcagaaacccaaagaaugagaacgaccaauacauuuacaugggggaacccuuagagaaugaugaggacugcgcgcauuggaaagaagcaaagaugcugcuugauaacaucaauaccccugagggaauaauucccagcauguuugaaccagagcgggaaaagguggacgccaucgauggcgaguauaggcugcgcggugaggcuagaaaaaccuucgucgaccucaugaggagaggggauuugccuguauggcuggccuaccguguggcugcagaaggcauuaacuaugccgaccgccgaugguguuuugauggaguuaagaauaaccagauccucgaggaaaauguggaggucgagauauggacuaaagaaggcgagagaaagaaacugaagcccagguggcuugacgcucggaucuacucggauccacuagcccugaaggaguucaaagaguucgcagcggggcgcaagucuuugacauuaaaccugauuaccgaaaugggaagacucccuacauuuaugacucagaaagccagggacgcucuggauaaccuugccgugcugcacacggcagaggcugguggccgggccuauaaucaugcacucuccgaguugccggaaacccuggagacacuacugcuccuuacucuguuagccaccguuacagggggaaucuucuuguuucugaugagcggcaaggguguggggaaaaugacccucggcaugugcugcauuaucacugcuucaauacugcuuugguacgcgcagauucaaccccacuggaucgccgcaaguaucauucuggaguucuuucucaucgucuugcugauaccagagccugaaaagcagcgaacgccccaggacaaccaguuaaccuaugugguaauugcuauccuaacagugguugccgccacuauggcaaaugagaugggauuccuggagaagaccaaaaaggaccucggccuugggucuauugcuacacaagaaccagaguccaacauccuggauauagacuugagaccugccagcgcguggacccuguacgcugucgccacuacauuugugacgcccaugcuccgccacucaaucgaaaauaguagcgugaacgucucccugaccgcaauugccaaucaggcuacuguucuuaugggacucgguaaaggcuggccgcugucuaagauggauaucggggugccauugcuggcaauuggauguuacagccagguaaacccuaucacauuaaccgccgcgcuacugcuccuuauugcucauuaugccaucauaggccccggucugcaggcaaaagccaccagggaggcucaaaagcgggccgcagcugggauuaugaagaauccaacaguggacggcaucacugucaucgauuuggaccccauuccuuacgauccgaaauucgaaaagcagcugggacaggugaugcuccugauacuuugcguuacacagguguuaaugaugcguaccacaugggcccugugugaggcgcucacuuuggccaccggccccaucuccacacugugggaggggaacccaggaagauuuuggaauaccacuauugcagucucaauggcuaacaucuucaggggcucuuaucuagccggugcagggcugcucuuuaguauuaugaaaaauacgacaaacacccgccggggaacuggcaauaucggugaaacccuuggcgagaaguggaaaucgcgacugaacgcuuugggaaagagcgaguuccaaauauacaaaaaguccggaauccaggagguagacagaacacuggccaaggagggcauuaaaagaggggaaacugaucaccaugccgugucucgcggaucagcgaagcuccggugguuuguugagagaaauauggugaccccugaaggcaaagucguggaccuggguugcgggcguggaggcuggagcuauuacugugguggcuuaaagaacgucagggaggugaaagggcuuacaaagggaggccccgggcacgaagaaccuaucccaauguccacguauggauggaaccugguucggcuccagaguggcguggauguauucuucacacccccugagaagugcgacacucuacugugugauauuggugaaucuagcccaaaucccacaaucgaggcugggcgcaccuugcgagugcugucacucgucgaaaacuggcuuaauaacgacacucaauuuugcauaaaaguucugaauccguacaugccuuccgugauugagaagauggaaacauugcagagaaaauacggaggcgcacuggucaggaacccacucagucggaauagcacccaugagauguauugggugucuaacgccacgggcaauaucguauccucagugaacaugaucagccgcauguuaauuaauagauucaccaugaagcacaaaaaggcuacauacgagcccgacguugaucuggggucgggaacuaggaacauagguaucgaaucugagauuccuaaucuugacaucauuggcaagcgaaucgagaaaauaaagcaggaacacgaaaccaguuggcauuaugaucaggaccacccauacaaaacaugggccuaucauggguccuacgagacuaagcaaaccggaagcgcaucauccauggugaacggcgucgugcggcugcuaacaaaacccugggaugucgugccgaugguuacccagauggccaugacugacacgacaccuuuuggucagcagcguguauucaaggagaagguggauaccagaacucaagaacccaaagaggggaccaagaaacucaugaagaucacagcugaauggcuguggaaagaguugggaaagaaaaagacgccacgcauguguaccagggaggaauuuacucggaaggucagaucuaaugcggcccugggcgcaauuuucacagacgagaacaaauggaaaagcgcucgcgaagccguggaggauaguagguuuugggaacucguugacaaagagcgaaaccuucaccuggagggcaagugcgaaaccuguguguauaauaugauggggaaacgggagaagaaguuaggagaguucgguaaagcaaagggcuccagagccaucugguacauguggcugggggcuagguuuuuggaguucgaagcccucggauuucugaacgaggaucacugguucagccgcgaaaauucucuaucaggcgucgaaggugaggggcuucauaaacugggauacauucuccgugacgugaguaagaaagaaggcggcgcgauguaugcagacgauacugccgggugggacacacggaucacccuggaggauuugaagaacgaagagaugguaacaaaucacauggagggagaacauaagaaacuggcugaggccauuuuuaagcucacuuaccagaacaaagugguuagaguccagaggccuacaccccgcgguacggugauggacauaaucucccgacgggaucagagaggcagcgggcaagugggaaccuauggccuuaauacauucacuaacauggaagcacagcugauuaggcagauggagggugaggggaucuucaagucuauccaacacuuaaccgucacagaagagauugcuguucaggacuggcuggcccgcgugggaagagaacgguugucgaggauggcuauaucaggcgaugacugcguagugaaaccacucgaugaccguuuugccagcgcacugacugcgcuaaaugauaugggcaagguccgaaaggacauccagcagugggagcccucccgcggguggaacgauuggacccaagugccuuucugcagucaucacuuucacgaacuuauuaugaaagacggaagaguucugguggucccaugucggaaucaggacgagcucaucgguagggcccgcauuucucagggcgcuggguggagccugaaggagacggccugcuugggaaaauccuacgcacagauguggucauuaauguauuuccauagacgggaucugaggcucgcugccaacgcaaucuguagugccgugccgucucacuggguacccacaagccgaaccacuugguccauacaugcgaagcacgaauggaugacaaccgaggacaugcuuacuguuuggaaucguguguggauccaagaaaacccuuggauggaggauaaaaccccagucgaaucaugggaggaggugcccuaccugggcaagagagaagaccaguggugcgguagccuaauugggcugacaucucgcgcuacgugggccaagaauauccagaccgcaauuaaccaggugcggucccucaucggaaacgaggaauauacugauuacaugccuaguaugaaaagguuuagacgcgaggaagaggaggccggcgucuugugguga

SEQ ID NO: 14299 - RNA, 9876 nt, Artificial Sequence
  derived and/or modified CDS sequence (opt3) from DENV-2__KF704356__SS-prME
accgccggaaugaucauuaugcugauacccacagugauggcuuuccaccucacuacgaggaacggggaaccucauaugaucgucagcaggcaggaaaagggaaaaucccuucuguuuaauaccggugacggaguucacaugugcacauugauggcaaugcauuuaggggagcugugugaagauacuauuaccuacaagugcccacuacuccggcaaaacgagccggaagacaucgauuguuggugcaauucuacaucaaccugggugacuuauggaacauguaccacgacuggcgagcaccgccgagagaaacguagugucgcccuggugccccaugucgguauggggcuugaaaccaggacagagacuuggaugagcuccgaaggagcguggaagcacgcucagaggauugagaccuggauccugcggcacccuggcuucacaauaauggccgcaaucuuggccuacaccauuggcacgacucauuuucagcgcgcucucaucuucauucugcugacagcaguggccccaucuaugaccaugagaugcaucgggauaucgaacagggacuuuguugagggagugucagguggcagcugggucgauauugugcucgaacacgggaguuguguaacuacaauggcuaaaaauaagcccaccuuagaccuggagcuuaucaagacggaagccaaacagccugcgaccuugcggaaguauugcauugaggcaaaacugacaaacacuaccacagaaucccgcuguccaacucaaggagagcccucucuaaaugaggaacaggauaagcgauucguuugcaaacauagcaugguggacagaggcugggguaacggguguggacucuuuggcaagggcuccaucguaaccugcgccauguucacaugcaagaaaaucaugaaggggaaaguggugcagccugagaaucuggaauacaccauugucauaacuccacacucaggagaggaacacgcuguugguaacgauacgggcaagcaugggaaagagaucaagauuacaccgcagaguagcaucaccgaggccgaacuuacuggauauggcaccgugacaauggaguguucucccaggaccggucuggacuuuaaugaaaugguauugcuccaaauggaggauaaagcauggcuggugcaccggcagugguucuuagaccugccucucccauggcuucccggggcugauacucagggcuccaacuggauacagaaggaaacacuggucacguuuaagaauccucaugccaaaaagcaagacgugguuguguugggaucacaggagggcgcgaugcacaccgcccuaacuggggcaacagagauucagaugagcaguggaaacguccuguucaccggucaucucaaaugccgucugcgcauggacaaacuucaacugaaaggcaugucuuacuccauguguacagggaaguuuaaggugguaaaagaaaucgcugagacucagcacggaaccaucguuauuagagugcaguaugaaggcgaugguagcccaugcaagauccccuucgagauuauggacuuggagaaaaggcacguccucgggcggcugauaacggugaauccgaucgucaccggcaaggauucgccugugaacauugaagccgagcccccauucggagacucuuacaucaucauuggcguugaaccugggcaguuaaaacugaacugguuuaagaagggauccucaauaggucaaauguucgcuacaacuaugcgaggcgccaaacgcauggcaauccuaggggauaccgccugggacuuuggaagucucggcgguguguucacaagcauugggaaggcucugcaucagguauuuggcgcgaucuacggagcagccuucuccggcgucucuuggacuaugaaaauucuuaucggggugauaaucaccuggauuggaaugaauagcagaucaacgaguuuguccguuagccuggugcucgucggcgugguaacacuguaucuuggugugaugguucaggcugauucugggugugucgugucauggaagaacaaagagcugaagugcggaaguggcaucuuuauuaccgacaaugugcacacuuggacagaacaguacaaguuccaacccgagagcccauccaaauuggccucugcaauccagaaggcccaugaggaagguauauguggcauuaggucggucacccggcucgagaaccugauguggaaacagaucacucccgaauuaaaucacauucugagcgagaacgaaguuaagcuaaccaucaugacaggggauauaaaaggaaucaugcaggcuggcaagcgcucccucagaccucaaccaacggagcugaaauauucauggaagaccugggggaaggccaaaaugcuuaguacugagucucacaaucagacauuuuugauugacggaccggaaaccgcagagugccccaacacaaauagggcguggaacagccuggaaguggaggauuacggcuucgguguguuuacuaccaauaucuggcucaagcugcgugaagaacaggacguauucugugacuccaaauuaaugucagcugccauuaaggauaaccgggcaguccaugccgacaugggguauuggaucgagagcgcucugaaugauacguggaaaauagaaaaggccucuuuuauugaggugaaguccugccacuggccuaaaagucauacacuuuggagcaacggaguuuuggaaucugagaugaucaucccaaagaauuucgcaggccccgugucccagcacaacuaccgaccugguuaucauacccaaacugcuggcccauggcaccucgggaaacuggagauggacuucgauuuuugugaaggaaccacagucgugguuacugaggacugcggcaacagagggcccucacuaaggaccacaacggccaguggaaagcugauuaccgaauggugcugucgcagcugcacucucccgccucugcgguacagaggcgaggaugguuguugguacgggauggaaaucaggccacuuaaagagaaggaggaaaauuuggugaacucgcugguaacagcgggacacggccagauugacaauuucuccuuagguguccucggcauggcccuguuucuugaggaaaugcugcgcacccgaguggggacuaagcaugcuauauugcucguggcagucucuuucguuacacugaucaccggaaacaugagcuuucgggaucuaggccgugugaugguaauggugggggccacgaugacugacgauauuggaaugggcgucaccuaucuggcucuccuggccgcauucaaagugagacccacauuugcggccggucuuuugcugaggaaguuaaccucaaaagagcucaugaugacuacaaucgggauuguucugcuuagucaguccaccaucccugaaacaauacuggagcuaacugacgcucucgcccugggaaugaugguguugaagaugguccgcaaaauggagaaguaccaacuggcagugaccaucauggcuauuuuaugcguucccaaugccgugauccuccagaacacguggaaggucucuuguacaauucuggcaguagugagcguuuccccacuuuuccugaccucaagccagcagaaagccgauuggaucccuuuggcucucacuauaaagggccugaaucccaccgcgauuuuucuaacaacucugagucggaccaacaaaaagagaucuuggccacuuaaugaagccaucauggcagugggcauggucuccauccucgcuagcucgcuguugaaaaacgacauuccgaugacggggccucugguggccggagguuuacucacaguaugcuaugugcugaccggcaggucagccgaccuugagcuggaacgagcugcagaugucaagugggaggaccaagccgaaauaucugggaguucccccaucuugagcauuacuaucucugaggauggaagcauguccauuaaaaaugaggaagaggaacagacacucaccauccugauacgcacuggccuacugguuaucucaggucuuuucccagugaguauucccaucacagcggcugccugguaccucugggaggugaagaagcagcgggcagggguccugugggacgugccuagcccacccccuguuggaaaagccgaguuggaagauggcgcuuauagaauuaagcagaaaggcaucuuaggguacucucaaauaggagccgguguauauaaggagggcaccuuucacacgauguggcaugugacuagaggggcaguccugaugcacaaaggaaagcguauugaaccguccugggcggacgugaagaaagaucucaucucauacggcgguggguggaagcuggagggagaauggaaagagggcgaggaaguucaggugcuugcucuggagccaggcaagaacccccgcgccguccagaccaaaccuggguuguucaagacaaaugcaggaaccaucggugccgugagucuagacuuuagcccaggcacauccgggucucccauuaucgaucggaagggaaaaguagucggccuguacgguaacggggugguuacuagaucgggagcuuaugugagcgccauagcacagaccgaaaagucaauugaggacaauccugaaaucgaggaugacauuuucaggaaacgaaagcucacgaucauggaucugcauccgggcgcuggcaaaacaaagcgguaccuucccgccauaguccgcgaggcgauuaagagaggguuaaggacucugauccucgccccaacccgggugguugcagcugaaauggaggaagccuugcgaggacugccuaucagauaucaaacacccgcuauucgcgcagagcacaccgguagggaaaucguggaccucaugugucacgccacuuucaccaugcgucugcuuuccccaguccgggugccuaacuacaaccugauuauaauggacgaggcccauuuuacagaucccgcuaguaucgcggcaagaggcuauauuucuacgaggguagagaugggggaagccgcuggaaucuucaugacugccaccccaccgggcagccgcgacccuuuuccccaguccaaugcaccaaucauggaugaggaacgagagauucccgagagaucauggucuagcggucacgaaugggugacagacuucaaagggaagaccguuugguuugucccuaguauacgggccggaaacgauaucgcugcgugcuugaggaaaaauggcaagaaagugauucagcuaucccgcaagacuuucgacagcgaguacgugaagacacguaccaacgauugggacuuugucguaacgacugauaucucugaaaugggcgccaauuucaaagcagagagagugauugacccacggagguguaugaagcccguuauccugacagauggggaagaacgcgugauacucgcuggaccuaugccggucacccauucauccgccgcacaacgaagaggucggaucggcaggaaccccaagaaugagaacgaccaguauauuuacaugggggaacccuuagagaaugacgaagauugcgcccacuggaaggaggcuaaaaugcugcuugacaacaucaauaccccugaaggaauuauccccaguauguuugagccagagcgcgaaaagguggaugccauagacggcgaguacagacugaggggugaagcgcggaaaacuuucguugaucucaugcgucgcggggacuugccuguguggcuggcauaucgagucgccgcugagggcauuaacuacgccgauagaaggugguguuuugacggaaucaagaauaaccagauucucgaagagaauguggagguagaaaucuggacaaaggagggcgaacggaaaaagcugaaaccccgcuggcuugaugcuagaauauauagcgacccacuagcacugaaggaguucaaagaguucgccgcugggaggaagucguugaccuuaaaccugaucacagaaaugggacggcucccuacuuuuaugacgcagaaggcccgagaugcacuggacaaccuugcggugcugcacaccgccgaggcugguggcagagccuacaaucaugcacucucugaauugccggagacacuggaaacucuacugcuccuuacccuguuagcuacaguuaccgggggaauuuucuuguuucugauguccggccgcgguaucgggaaaaugacucucggcaugugcugcauuaucacggccagcauacugcuuugguaugcacaaauucagccccacuggaucgccgcuucaaucauucuggaguucuuucucaucgucuugcugauaccagagccugaaaagcagaggaccccacaggauaaccaauuaacauacguggugauugcgauccuaacugucguugccgcaaccauggcuaaugagaugggauuccuggagaaaacaaagaaagaccucggccuugggaguauuaccacucagcagccagagucuaacauccuggacauagauuugcggccugccuccgccuggacacuguaugcaguggcuacgaccuuuguaacucccaugcuccgucauagcaucgaaaauucaagugugaacgucagccugacagccauugcgaaucaggcuaccgugcuuaugggacucgguaagggcuggccgcuguccaagauggacaucgggguuccauugcuggccauuggauguuacucucaagugaacccuaucaccuuaacagcagcccuauuccugcucgucgcucacuacgcaauuaucggccccggucuucaggccaaagcgacuagagaggcucagaagagggccgcagccgggauaaugaaaaauccaacgguagauggcauuaccgugaucgaccuggaucccaucccuuaugacccgaaguuugagaaacaguugggacaaguuaugcugcucgugcugugcgucacacaggugcuuaugaugcgcacuaccugggcuuuaugugaagcccugacacucgcaaccggccccauuagcacuuugugggaggggaacccaggacgguucuggaauacgacaauagcugucuccauggccaacaucuuucgaggcucauaccuggcgggugccgggcuacuguucucuauuaugaagaauaccacuaacaccagaaggggaacaggcaauaugggugaaacucucggcgagaaguggaaaagucgccuuaacgcacuggggaagucggaauuucagaucuauaaaaagagcggcauucaagagguggaucggaccuuggcuaaagagggcaucaagagaggggaaacagaccaucacgccguuucccguggaucugcaaaacugaggugguucguggagcggaauaugguaacgccugaaggcaagguggucgaucucgguugcgggcgcggaggcuggucauacuauugugguggccugaagaacguucgagaggugaaaggguuaaccaagggaggccccgggcacgaggaaccuauaccaaugagcacuuacggauggaaccuugucagacugcaguccggcguggacguauucuuuacacccccugagaaaugcgauacccuccuaugugacaucggugaaaguucuccaaaucccacuguggaggcugggaggacacugcggguuuugaaccugguggaaaauuggcucaacaauaacacccaguucugcauuaagguccuuaauccguauaugccuagcgugaucgagaaaauggaggcccugcagcgcaaguacggaggcgccuuggucagaaacccacugucaagaaauuccacgcaugaaauguacugggugaguaacgcgagcggcaauauuguuucuuccguaaacaugaucucacgaaugcucauaaaucgguuuaccaugcgucacaagaaagcuacauucgagcccgauguggacuuagggagcggaacuagaaacauugguaucgaaucggagaucccuaaucuggacauuauaggcaagcgcaucgagaaaauuaagcaagaguaugagaccucuuggcauuacgaucaggaccacccauauaaaacaugggcauaccacgggaguuaugaaacuaagcagaccggauccgccagcucaauggucaacggcgugguuaggcuucugacaaagcccugggauguggucccgauggugacccagauggcuaugacugacacgacaccuuuuggucaacagcggguauucaaagagaagguggauaccagaacucaggaacccaaagaggggaccaagaaacuaaugaagaucacagccgaauggcucuggaaggagcugggcaaaaagaaaacgccacgcauguguaccagggaggaauuuacucgaaagguucgguccaacgcagccuugggcgcuauuuucacagacgagaauaaauggaagucugcgagagaagccgucgaggauagcagguuuugggagcugguggacaaagaacgcaaccuccaucuugagggcaagugcgaaaccuguguguacaauaugauggggaagcgugagaaaaagcugggagaguucgguaaagcaaagggcagucgggcuaucugguauaugugguuaggggccagauuucuggaguucgaggcauugggauuucucaacgaagaucacugguucuccagggagaauagccugucuggcgucgaaggugaggggcuacauaaacuuggauacauacugcgcgacguuucaaagaaggaaggcggcgccauguacgcugaugacacugccgggugggacacacgaaucacccucgaggaucugaaaaacgaggaaauggugacaaaucacauggagggagaacauaagaaauuggcggaggcaauuuucaagcugacuuaucagaacaaaguagugcggguccaaagaccuacccccagggguacggugauggacaucauuagucgcagagaucagcggggcuccgggcagguuggaaccuacggccucaauacauuuacuaacauggaagcccaacuuaucaggcagauggagggugaggggguguucaagaauauucagcaccugaccgucacagaagagauagcugugcagaacugguuagcccguguaggacgagaacgccugagcagaauggcaaucucuggcgacgauugcguugugaagccauuggacgaucgguuugcuucggcccucacugcucugaaugacaugggcaaagucaggaaggauauucaacagugggagcccucacgcggguggaacgacuggacccaggugccuuucugcagccaccauuuucacgagcuaaucaugaaagauggaagagugcuugucguuccaugucggaaucaggacgaacugaucgguagggcccgaauuucccaaggcgcaggguggagucuccgugagacggcgugccugggaaagucuuaugcccagauguggagcuugauguacuuccauagacgcgauuuacggcuggcugccaacgcaauauguuccgcugugccgucacacuggguacccacaaguaggaccacuuggucuauccacgccaaacaugaauggaugacaaccgaggacaugcucacuguguggaacagagucuggauucaggaaaauccuuggauggaggacaagaccccaguggagagcugggaagagauccccuaucuuggcaagcgcgaagaucaguggugcgguucccugauugggcuaacaucacgggcaacgugggccaaaaacauccaaaccgcgauaaaucagguuaggagccugaucggaaacgaggaauacacugacuauaugccuucuaugaagcgauuuagacgggaggaggaagaggcuggcgugcucugguga

SEQ ID NO: 14300 - RNA, 9876 nt, Artificial Sequence
  derived and/or modified CDS sequence (opt3) from DENV-2__KF704355__SS-prME
accgccggcaugaucauuaugcugauacccacagugauggcuuuccaccucacuacgaggaacggggagccucauaugaucgucucaaggcaggaaaagggaaaaucccuucuguuuaagaccggugacggcguuaauaugugcacauugauggcgauggauuuaggggagcugugugaagacacuauuaccuacaaaugcccauuccuacggcaaaacgagccggaagauaucgacuguuggugcaauucuacaucaaccugggugacuuauggaacauguaccacgacuggcgagcaccgccgagagaagcguagugucgcccucgugccccaugucgguauggggcuggaaaccaggacagagacuuggaugagcuccgaaggagcguggaaacacgcucagaggauugagaccuggauccuucggcauccuggcuuuacaauaauggccgcaauccuggccuacaccauuggcacgacucacuuccagcgcgcuuugaucuuuauucuccugacagcaguggccccaucuaugaccaugagaugcaucgggauaucgaacagggauuucguugagggagugucagguggcagcugggucgacauugugcuggaacacgggaguuguguaacuacaauggcuaagaauaagcccacccucgauuuagagcugaucaaaacggaagccaagcagccugcgacccuucggaaauauugcauugaggcaaaguugacaaacacuaccacagaaucccgcuguccaacucaaggagagcccucucugaaugaggaacaggacaaacgauuuguuugcaagcauagcaugguggauagaggcugggguaacggguguggacuauucggcaagggcuccaucguaaccugcgccauguuuacaugcaaaaagaucaugaaagggaagguggugcagccugagaaucucgaauacaccauugucauaacuccacacucaggagaggaacaugcuguugguaacgacacgggcaaauaugggaaggagaucaaaauuacaccgcagaguagcaucaccgaggccgaacugacuggauacggcaccgugacaauggaguguucucccaggaccggucuugauuucaaugaaaugguacuguugcaaauggaggacaaggcauggcucgugcaccggcagugguuucuggauuuaccucugccauggcuccccggggcugacacucagggcuccaacuggauacagaaggaaacacuugucacguucaaaaauccucacgccaagaaacaagacgugguugugcugggaucacaggagggcgcgaugcauaccgccuugacuggggcaacagagauucagaugagcaguggaaacguccuauuuaccggucaccugaagugccgucuccgcauggauaaacugcaacuuaagggcaugucuuauuccauguguacagggaaguucaaagugguaaaggaaaucgcugagacucagcauggaaccaucguuauuagagugcaguacgaaggcgacgguagcccaugcaaaauccccuucgagauuauggaucuggagaagaggcacgucuuggggcggcucauaacggugaauccgaucgucaccggcaaagacucgccugugaacauugaagccgagcccccauuuggagauucuuacaucaucauuggcguugaaccugggcagcugaaguuaaacugguucaagaaaggauccucaauaggucaaauguuuggcacaacuaugcgaggggcuaagcgcauggccauccugggagacaccgcaugggauuucggcagucuaggugggguguuuacaagcauuggcaaagcccuccaucagguauucggagcuaucuauggcgcggcauuuuccggggucucuuggacuaugaagauucugaccggagugaucauaacguggaucggcaugaauagcagaucaacaagucuuuccguuagcuuggugcuggucggugugguaacccucuaccugggggugaugguucaggccgacucuggaugugucgugucauggaaaaacaaggagcuuaagugcggcagugguauuuucaucacugauaaugugcacacauggaccgaacaguauaaauuucaacccgagagcccauccaagcuggcuucugccauucagaaagcacacgaggaaggcaucugugggauaaggucggucacucgguuggagaaccucauguggaagcagauuacccccgaacugaaucauaucuuaagcgagaacgaaguuaaacugacaauuaugacgggagacaucaagggcauaaugcaggccgggaaacgcucccuaagaccucaaccaaccgagcucaaguacucauggaagacuuggggaaaagcuaagaugcugaguacagagucucacaaucagaccuuccuuaucgauggcccggaaacagccgagugccccaacacuaauagggcauggaacagcuuggaaguggaggacuaugguuuugggguguucaccacgaauauuuggcugaaacuccgugaaaagcaggacguauuuugugauuccaaacugaugucagcggcuaucaaggacaaccgggccguccaugcagauaugggauacuggauugagagcgccuuaaaugacacauggaagaucgagaaggcuucuuucauagaagugaaguccugccacuggccuaaaagucacacccuguggagcaacggcguucuugagucugaaaugauuaucccaaagaauuucgccggucccgugucccagcauaacuaucgaccuggcuaccacacucaaaccgcagggccauggcauuugggaaaacucgagauggauuuugacuucugugagggcacaacugucgugguuaccgaagauugcgggaacagaggacccucacugaggacaacgaccgcuaguggcaagcuaaucacugaguggugcugucgcagcugcacacugccgccucuccgguacagaggugaagacggguguugguauggaauggagauuaggccacugaaggaaaaagaggagaaucuugugaacucguugguaaccgccggccacggucagaucgauaauuuuucccugggcgucuuagggauggcacucuuccuggaagagaugcuucgcacucgagugggaacaaagcaugccauucuguugguggcugucucuuuuguuacccucauaacgggcaacaugagcuuccgggaccuggggcgugugaugguaauggugggagcaacuaugaccgaugacaucggcaugggugucacauaccuagcccugcucgcugccuuuaaagugagacccaccuucgcagcggggcugcuuuugaggaagcugacuucaaaagaauuaaugaugacaaccauuggaaucguucuccugagucaguccacaauuccugagacuauccuugaacugaccgaugcccuagcucucggcaugauggugcugaagaugguccgcaagauggagaaauaucaauuggccgugacgauaauggcaauccugugcguucccaaugcugugauuuuacagaacgccuggaaggucucuuguacaauccucgcaguagugagcguuuccccacuguuucuuaccucaagccagcagaaagccgacuggauuccucuggcuuugacuaucaagggccucaaucccaccgcgauauuccugacaacucuaagucggaccaacaaaaagagaucuuggccacugaaugaggccauuauggcaguggggauggucuccauccuugcuagcucgcuccugaaaaacgacaucccgaugacgggaccuuugguggccgguggccuguuaacaguaugcuacgugcucaccgggaggucagccgaucuggaacuugagcgagcugcagacgucaagugggaagaucaagccgagauuucuggaaguucccccauacugagcaucacuauuucugaagacggcagcauguccaucaagaaugaggaggaggaacagacauugaccauucucauccgcacuggucugcuaguuauaucagggcuguuuccagugaguauccccauuacagcggcugccugguaucuuugggaagugaaaaagcagcgggcaggaguccucugggaugugccuagcccacccccuguuggcaaagccgagcuggaggacggcgcuuacagaaucaagcagaaagggauuuugggauauucucaaaucggugcaggcguauacaaggaagggaccuuccacacgauguggcacgugacuaggggagccgucuuaaugcauaagggcaaacguauagagccguccugggcggaugugaagaaagaccugauuucauacggugggggauggaagcucgaaggcgaguggaaagaaggcgaggagguucaggugcuggcucuugaaccagggaagaacccccgcgccguccagaccaagccuggacuguuuaaaacaaaugcagguaccaucggcgccgugaguuuggauuucagcccagggacauccggaucucccaucauugaccggaagggcaaaguagucggucuauaugggaacggagugguuacuagaucgggcgcuuacgugagcgccaucgcacagaccgagaagucaauagaagauaauccugagauugaagacgauaucuucaggaaacgaaagcugacgauuauggaccuccacccgggcgcugggaagacaaaacgguaucugcccgccaucguccgcgaggcgauaaagagaggacuuaggacuuuaauucuggccccaacccgggugguugcagcugagauggaagaggcccuccgagguuugccuaucagauaccaaacacccgcuauccgcgcagaacauaccggcagggagauuguggaccugaugugucacgccacuuuuaccaugcgucuccuguccccaguccgggugccuaacuauaaccuuaucauuauggaugaagcccauuucacagaccccgcuaguauagcggcaagaggguacaucucuacgaggguagagaugggagaggccgcuggcauuuuuaugacugccaccccaccggguagccgcgauccuuucccccaguccaaugcaccaaucauggacgaagaacgagaaauccccgagagaucauggucuagcgggcacgagugggugacagauuuuaaaggaaagaccguuugguucgucccuaguauucgggccggcaacgacauagcugcgugccugaggaaaaauggcaagaaggugauccaguugucccgcaaaacuuuugauagcgaauaugugaagacacguaccaacgacugggauuucgucguaacgacugacauuucugagaugggggccaauuuuaaagcagaaagagugaucgauccacggagguguaugaagcccguuauucuaacagacggagaggaacgcgugauccuggcugguccuaugccggucacccacucauccgccgcacaacgaagaggccggauagggaggaaccccaaaaaugagaacgaccaguacaucuacaugggagagccccucgaaaaugaugaggacugcgcccauuggaaggaagcuaaaauguuacuggauaacauuaauaccccugagggcaucauucccaguauguucgaaccagagcgcgagaagguggacgccaucgauggugaauauagacuuagaggggaagcgcggaagacuuuuguugaccugaugcgucgcggcgaucucccugugugguuggcauaccgagucgccgcugaaggaauaaacuaugccgacagaaggugguguuucgauggcauuaaaaauaaccagauccuggaggaaaauguggagguagagauuuggacaaaggaaggggagcggaaaaagcucaaaccccgcuggcuggacgcuagaaucuacagcgauccacuugcacuaaaggaguucaaggaguuugccgcuggaaggaaaucgcugaccuugaacuuaauaacagagaugggucggcugccuacuuucaugacgcagaaggcccgagacgcacucgauaaccuggcggugcuucacaccgccgaagcuggcgggagagccuauaaucaugcacugucugagcucccggaaacauuggagacucugcuacugcucacccuucuggcuacaguuaccggaggcaucuuuuuauucuugauguccggucgcgggauuggcaaaaugacucugggaaugugcugcaucauuacggccagcauccuccugugguacgcacaaauacagccccacuggauugccgcuucaaucauccuugaauuuuuccugauuguccucuugaucccagagccugagaagcagaggaccccacaggacaaccaacugacauauguggugauagcgauuuuaacugucguugccgcaaccauggcuaaugaaaugggcuuucuagagaaaacaaagaaggaccuggggcucggaaguaucaccacucagcagccagaaucuaacauucuugauaucgaccugcggccugccuccgccuggacauuguacgcaguggcuacgaccuucguaacucccaugcugcgucacagcauagaaaauucaagugugaacgucagccucacagccaucgcgaaucaggcuaccgugcugaugggucuuggcaaaggguggccgcucuccaagauggauauuggaguuccacuguuggccaucggcuguuacucucaagugaacccuauuacccugacagcagccuuauuucuacuggucgcucauuaugcaaucauuggucccgggcuccaggccaaagcgacuagagaagcucagaagagggccgcagccggcaucaugaaaaauccaacgguagacggaauaaccgugauugaucuugaccccaucccuuacgauccgaaguucgagaagcagcugggccaaguuauguugcuggugcucugcgucacacaggugcugaugaugcgcacuaccugggcucuuugugaggccuuaacacuggcaaccgggcccaucagcacucucugggaaggaaacccaggccgguuuuggaauacgacaauugcugucuccauggccaacauauuccgagguucauauuuggcgggggccggacugcuauuuucuaucaugaaaaauaccacuaacaccagaaggggcacagguaauauuggcgagacucugggggaaaaguggaaaagucgccucaacgcacuuggaaagucggaguuccagaucuacaaaaagagcggcauucaagaaguggaccggacccuggcuaaagaggggaucaagagaggagagacagaucaccaugccguuucccguggcucugcaaaguugaggugguucguggaacggaauaugguaacgccugaggguaaaguggucgaccuggggugcggacgcggcgguuggucauauuacuguggcgggcucaagaacguucgagaagugaaaggacugaccaagggcgggcccggacacgaggagccuauaccaaugagcacuuauggcuggaacuuagucagacuucaguccgguguggauguauuuuucacacccccugaaaaaugcgacacccugcucugugauaucggggagaguucuccaaaucccacuguggaagcuggaaggacacuacggguucugaacuugguggagaauuggcugaacaauaacacccaguuuugcauuaagguccucaauccguacaugccuagcgugaucgaaaagauggaggcccuucagcgcaaauacggcggcgcccuggucagaaacccauugucaagaaauuccacgcaugagauguauugggugaguaacgcgagcgggaauauuguuucuuccguaaacaugaucucacgaaugcugauaaaucgguucaccaugcgucacaagaaagcuacauacgaacccgacguggaccucggaagcgguacuagaaacauuggcaucgagucggaaaucccuaauuuagauauuauagggaagcgcaucgagaaaauuaagcaagaauaugagaccucuuggcacuacgaccaggaucauccauauaagacaugggcauaccacggaaguuaugagacuaaacagaccggcuccgccagcucaauggucaacggugugguuaggcugcuuacaaagcccugggacguggucccgauggugacccagauggcuaugacugauacgacaccuuuugggcaacagcggguauucaaagaaaagguggacaccagaacucaggagcccaaagaaggaaccaagaagcugaugaaaaucacagccgaguggcuauggaaggaacucggcaaaaagaaaacgccacgcauguguaccagggaggaguuuacucgaaagguucgguccaacgcagcccugggcgcuauuuucacagaugaaaauaaauggaagucugcgagagaggccgucgaagacagcagguuuugggaguugguggauaaggagcgcaaccugcaucucgaagggaaaugcgagaccuguguguacaauaugaugggaaagcgugagaagaaacuuggugaguucggcaaagcaaaagggagucgggcuaucugguacauguggcugggagccagauuuuuagaguucgaggcacugggcuuuuugaacgaggaccacugguucuccagggaaaauagccucucuggugucgagggggaaggacugcacaagcuaggcuauauacuucgcgauguuagcaaaaaggagggcggggccauguacgcugacgacacugccggaugggauacacgaaucacccuggaagaccucaaaaacgaggagauggugacaaaucauauggaaggugagcacaagaaacuggcggaagcaauuuucaaguugacuuaucagaacaagguagugcggguccaaagaccuacccccaggggcacggugauggauaucauuagucgcagagaccagcggggguccggacagguuggcaccuacggucugaauacauuuacuaacauggaggcccaacucaucaggcagauggaaggggagggaguguucaaaaauauucagcaucuuaccgucacagaggaaauagcugugcagaacuggcuggcccguguaggccgagagcgcuuaagcagaauggcaaucucuggcgaugacugcguugugaagccacuggaugaccgguuugcuucggccuugacugcucucaaugauauggggaaagucaggaaggacauucaacagugggaacccucacgcggauggaacgauuggacccaggugccuuucugcagccaccauuuucacgagcugaucaugaaagacgguagagugcuagucguuccaugucggaaucaggaugagcuuaucggcagggcccgaauuucccaaggggcaggauggagucugcgugaaacggcgugccucggcaagucuuaugcccagauguggagccugauguacuuccacagacgcgacuugcgguuagcugccaacgcaauauguuccgcugugccgucacauuggguacccacaaguaggaccacuuggucuauccacgccaagcaugaguggaugacaaccgaagacaugcugacuguguggaacagagucuggauucaggagaauccuuggauggaagauaaaaccccaguggagagcugggaggaaauccccuaucucgguaagcgcgaggaccaguggugcgggucccuuauuggacugacaucacgggcaacgugggccaaaaacauccaaaccgcgauaaaucagguuaggagccuaaucggcaacgaagaguacacugauuacaugccuucuaugaagcgauuuagacgggaagaggaggaagcuggcgugcugugguga

SEQ ID NO: 14301 - RNA, 9876 nt, Artificial Sequence
  derived and/or modified CDS sequence (opt3) from DENV-2__KF704354__SS-prME
accgccggaaugaucauuaugcugauaccaacagugauggcuuuccaccucacuacgaggaacggggagccucauaugaucgucagcaggcaggaaaagggaaaaucccuucuguuuaagaccgaggacgguguuaauaugugcacauugauggcaauggauuuaggagaacugugugaggacacuauuaccuacaaaugcccauuccuacggcaaaacgaaccggaggauaucgacuguuggugcaauucuacaucaaccugggugacuuaugggacauguaccacgacuggagagcaccgccgagaaaagcguaguguagcccucgugccccaugucggcaugggucuggagacccggacagaaacuuggaugagcuccgagggggcguggaaacacgcucagaggauugagaccuggauccuucggcauccuggauuuacaauaauggccgcaauccuggccuacaccauuggcacgacucacuuccagcgcgcuuugaucuuuauucuccugacagcaguggccccaucuaugaccaugagaugcaucggcauaucgaacagggauuucguugaaggggugucaggagguagcugggucgacauugugcuggagcacggcaguuguguaacuacaauggcuaagaauaagcccacccucgauuuugaauuaaucaaaacggaggccaagcagccugcgacccugcggaaauauugcauugaagcaaaacuuacaaacacuaccacagagucccgcuguccaacucaaggggagcccucuuugaaugaagaacaggacaaacgauucguuugcaagcauagcaugguggauagaggauggggcaacgguugugggcuguuuggaaagggcggcaucguaaccugcgccauguucacaugcaaaaagaucaugaaagggaagguggugcagccugaaaaucuagaguacaccauugucauaacuccacacuccggagaagaacaugcuguugguaacgacacgggcaaacacgggaaggagaucaaaauuacaccgcagucaaguaucaccgaagccgagcucacuggauauggcaccgugacaauggaauguagccccaggaccggucuggauuuuaaugagaugguacuucugcaaauggaaaacaaggcaugguuggugcaccggcagugguuccucgaccugccuuuaccauggcugcccggggcugauacucagggcucuaauuggauacagaaggagacacucgucacguuuaaaaacccucaugccaagaaacaagacgugguugugcuuggaucccaggagggcgcgaugcacaccgcccugacuggggcaacagaaauucagaugucaagcggaaaugucuuguucaccggucaucuaaagugccgucugcgcauggacaaacuccaacugaagggcaugaguuacucuauguguacagggaaguucaaagugguaaaggagaucgcugaaacucagcacggaaccaucguuauuagagugcaguaugagggcgaugguuccccaugcaaaauccccuuugagauuauggaccuugaaaagaggcauguccuggggcgguugauaacggugaacccgaucgucaccggcaaagauagcccugugaacauugaggccgaacccccauucggagacucguacaucaucauuggcguugagccugggcagcucaagcugaauugguuuaagaaaggaucuuccauaggucaaauguucgcuacaacuaugcgaggcgccaagcgcauggcaaucuuaggggauaccgccugggacuuuggaucacugggcgguguguucacaaguauugggaaagcucuacaccagguauuuggcgcgaucuacggagcagccuucagcggcgucuccuggacuaugaagauucucaucggggugauaaucaccuggauuggaaugaacucuagaagcacgucacugaguguuucccuuguguuggucggcgugguaacacuguaucucggugugaugguucaggcugauagcgggugugucgugucuuggaaaaauaaggaacugaagugcggaucaggcaucuuuauuaccgacaacgugcacacuuggacagagcaguacaaauuccaacccgagaguccaagcaaacuugccuccgcaauccagaaagcccaugaagaggguauauguggcauuaggucugucacccggcuggaaaauuugauguggaagcagaucacucccgagcucaaccacauucugucggaaaaugagguuaaauuaaccaucaugacaggggauauaaagggaaucaugcaggcuggcaaacgcagccugagaccucaaccaacggagcuaaaguauuccuggaagaccugggggaaagccaagaugcucucaacugaaagucauaaccagacauuucugauugacggaccggagaccgcagaaugccccaauacaaacagggcguggaacucucuugagguggaagauuacggcuucgguguguuuacuaccaacaucugguugaaacugcgugaggagcaggacguauucugugacagcaagcucauguccgcugccauuaaagauaaucgggcaguccacgccgacaugggguauuggaucgaaucagcucugaacgauacguggaagauagagaaggccagcuucauugaagugaaaucuugccacuggccuaagucccauacauuauggaguaauggaguucuggagagcgagaugaucauccccaagaauuuugcaggccccgugucucagcacaacuaccgaccugguuaucauacccaaacugcuggcccauggcaccuugggaaguuggaaauggacuucgauuuuugugagggaaccacagucgugguuacugaagacugcggcaauagagggcccucccucaggaccacaacggccucaggaaaacugauuaccgaguggugcugucgcaguugcacucuaccgccucugcgguacagaggcgaagaugguuguugguacgggauggagaucaggccacucaaggagaaggaagagaaccuggugaauagccuuguaacagcgggacauggccagauugacaacuucucguuggguguccugggcauggccuuauuucucgaagagaugcugcgcacccgaguggggacuaaacacgcuauacuucugguggcagucuccuucguuacauugaucaccggaaauaugucuuuucgggaucucggccgugugaugguaauggugggggccacgaugacugacgauauuggaaugggcgucaccuaucuggcucuacuggccgcauucaaggugagacccacauuugcggccggucuccugcuuaggaaauugaccagcaaggaacugaugaugacuacaaucgggauuguuuuacucucacagaguaccaucccugagacaauacuggagcuuacugacgcucuggcccuaggaaugauggugcucaaaaugguccgcaagauggaaaaguaccaacuggcagugaccaucauggcuauuuugugcguucccaacgccgugauccugcagaauacguggaaagucuccuguacaauuuuagcaguagugucuguuagcccacucuuccugaccuccucacagcagaaggccgauuggaucccucuugcucugacuauaaaaggcuugaaccccaccgcgauuuuucucacaacucugagccggaccaauaagaaaagaaguuggccacuaaacgaggccaucauggcagugggcauggucucuauccuggcuuccagccuucucaagaaugacauuccgaugacggggccucugguggccggagguuugcugacaguaugcuauguguuaaccggcaggucggccgaccucgaacuggagcgagcugcagaugucaaaugggaagaccaagccgagauaucagggucuagucccauccuuuccauuacuaucagcgaggauggaucuaugagcauuaagaacgaagaggaggaacagacacugaccaucuugauacgcacuggccuccugguuaucuccggucuauucccagugucaauucccaucacagcggcugccugguaccugugggaggugaagaaacagcgggcagggguccuuugggacgugccuaguccacccccuguuggaaaggccgaacucgaggauggcgcuuauagaauuaaacagaagggcauccugggguacagccaaauaggagccggugucuauaaagaaggcaccuuucacacgauguggcaugugacuagaggggcagucuugaugcacaagggaaagcguauugagccgucuugggcggacgugaaaaaggauuuaaucuccuacggcgguggguggcgccuggaaggagaguggaaagagggcgaagagguucaggugcucgcucuggaaccaggcaagaauccccgggccguccagaccaaaccugggcuuuucaagacaaacgcaggaaccaucggugccgugucacuggacuucaguccaggcacaagcgggucccccauuaucgauaagaaaggaaagguagucggcuuguacgguaauggggugguuacuagaucuggagcuuaugugucggccauagcacagaccgagaaaagcauugaagacaacccugagaucgaggaugacauuuuuaggaagcgaaaacuaacgaucauggaucugcauccgggcgcuggcaagacaaagcgguaccuccccgccauaguccgcgaagcgauuaaaagagggcugaggacucuuaucuuagccccaacccgggugguugcagcugagauggaagaggcccugcgaggacucccuaucagauaucaaacacccgcuauucgcgcagaacacaccgguagggagaucguggacuugaugugucaugccacuuucaccaugcgucugcucucaccaguccgggugccuaacuacaaucugauuauaauggacgaggcccacuuuacagaucccgcuuccaucgcggcaagaggcuauauuaguacgaggguagaaaugggggaggccgcuggaaucuucaugacugccaccccaccgggcucucgcgacccuuuuccccagagcaacgcaccaaucauggaugaggaacgagagauucccgaaagauccuggucaucuggucacgagugggugacagacuucaaggggaaaaccguuugguuugucccuagcauaaaggccggaaaugauaucgcugcgugccuucggaaaaacggcaagaaggugauucagcugaguaggaaaacuuucgacuccgaauacgugaagacacgcaccaaugauugggacuuugucguaacgacugauaucagcgagaugggcgccaacuucaaagcagaacgugugauugacccaagacgguguaugaagcccguuaucuugacagauggggaggagagggugauacuagcuggaccuaugccggucacccauucuucagccgcacaacgccgagguagaaucggccggaaucccaagaacgaaaaugaccaguauauuuacaugggggagccccuggaaaacgacgaggauugcgcccacuggaaggaagcuaaaaugcucuuagacaauaucaacaccccugagggaauuauccccuccauguuugagccagaaagggagaagguggaugccauagacggcgaauaccgccugagaggugaggcgaggaagacuuucguugaucuuaugcggcguggggaccugccuguguggcucgcauaucgcgucgccgcugaaggcauuaauuacgccgaucgaagaugguguuucgacggaaucaaaaacaaucagauuuuggaggagaacguggaaguagagaucuggacaaaggaaggcgagaggaaaaagcugaaaccccgguggcucgaugcucgcauauauagugacccacuggcacuuaaggaguuuaaggaguucgccgcugggagaaaaagccuaacccugaacuugaucacagagaugggaagguuaccuacuuuuaugacgcagaaggcccgggaugcacuggacaaucucgcggugcugcauaccgccgaagcugguggccgagccuacaaccacgcacuuucggagcugccggaaacacucgagacuuugcugcuacugacccuccuugcuacaguuaccgggggaauuuuccuguuuuuaaugucuggcagagguaucgggaaaaugacuuugggcaugugcugcauuaucacggccuccauacugcucugguaugcacaaauucagccccacuggaucgccgcuagcaucauucuggaguucuuucuuaucguccugcucauaccagaaccugagaagcagcgcaccccacaggauaaucaauugacauacguggugauugcgauccugacugucguugccgcaaccauggcuaacgaaaugggauucuuagagaaaacaaagaaggaccuaggcugggggucaauuaccacucagcagccagaaaguaauauccuggacauagaucucaggccugccucugccuggacacuuuaugcaguggcuacgaccuuuguaacucccaugcugcggcauuccaucgagaacagcucagugaaugucaguuugacagccauugcgaaccaggcuaccgugcugaugggacucgguaaaggcuggccgcugagcaagauggacaucgggguuccacuucucgccauuggauguuacucccaagugaauccuaucacccugacagcagccuuguuccuguuagucgcucacuacgcaauuaucggccccggucuacaggccaaagcgacucgugaggcucagaagagagccgcagccgggauaaugaaaaacccaacgguagauggcauuaccgugaucgaccuggaucccaucccuuaugacccgaaguuugaaaagcagcucggacaaguuaugcuucugguguugugcgucacacaggugcugaugaugaggacuaccugggcucucugugaggcccugacacuugcaaccggccccauuucuacuuuaugggaagggaauccaggacgcuucuggaacacgacaauagcugucagcauggccaauaucuuucggggcuccuaccuggcgggugccgggcucuuguucucaauuaugaaaaacaccacuaauacccgaagaggaacaggcaacaugggugagacucugggcgaaaaguggaaaucuaggcuaaaugcacuggggaagagugaguuccagaucuauaaaaagucgggcauucaagagguggaucgcacccucgcuaaagaaggcaucaagagaggggaaacagaccaucacgccguuagcagaggauccgcaaaacuucguugguuuguggaaaggaacaugguaacgccugagggcaaaguggucgaucuggguugcgggcggggaggcuggucuuacuauugugguggcuugaagaacguucgcgaggugaaagggcugaccaagggaggccccgggcaugaggagccuauaccaaugucaacuuacggauggaaucucguccgacugcagagcggcguggacguauucuuuacacccccugaaaaaugcgauaccuuacuuugugacaucggugaguccaguccaaaccccacuguggaagcugggagaacacugaggguucucaaucuaguggagaacuggcugaauaacaauacccaguucugcauuaaggucuugaacccguauaugccuucugugaucgagaagauggaagcccugcagcggaaauacggaggcgcccucguccgcaauccacuuagcagaaacucaacgcacgagauguacuggguguccaaugcgaguggcaacauuguuagcucuguaaauaugaucuccaggaugcugauaaaccgauuuaccaugcggcacaagaaagcuacauucgaacccgauguggacuuggggucaggaacucguaauauugguaucgagagcgaaaucccuaaccuggacauuauaggcaagagaaucgagaaaauuaagcaagaguaugaaaccucguggcauuacgaucaggaccacccauauaagacaugggcauaccaugggucuuaugagacuaaacagaccggaagugccuccagcauggucaacggcgugguucgccucuuaacaaagcccugggauguggucccgauggugacccagauggcuaugacugacacgacaccuuuuggucaacagaggguauucaaagaaaagguggauacccggacucaggagcccaaagaagggaccaagaagcugaugaaaaucacagccgaguggcuuuggaaggagcugggcaagaagaaaacgccaagaauguguacccgcgaagaguuuacuaggaagguucgaucaaaugcagcccuaggcgcuauuuucacagacgaaaacaaauggaaguccgcgcgggaggccgucgaggauucuagauuuugggaacucguggacaaggagaggaaucugcacuuggaaggcaaaugcgagaccuguguguacaacaugauggggaagcgcgagaaaaagcugggagaguucgguaaagcaaagggcagccgugcuaucugguauauguggcucggggcccgguuucuugaguucgaagcacugggauucuuaaaugaggaucacugguuuaguagagaaaacucccugagcggcgucgagggugaaggguugcauaagcucggauacauacugagggacguuucuaaaaaggagggcggcgccauguacgcugaugacacugccgggugggacacacgcaucacccuagaggaucuuaaaaaugaagagauggugacaaaccacauggaaggagagcauaagaaacuggcggaagcaauuuucaagcucacuuaucagaauaagguagugcgaguccaacggccuacccccagagguacggugauggacaucauuucaaggcgcgaucagagaggcagugggcagguuggaaccuacggccugaacacauuuacuaauauggaggcccaauugauccggcagauggagggugaagggguguucaaaaacauucagcaccugaccgucacagaggaaauagcugugcagaauuggcucgccaggguaggacgugagcgacuuucccgcauggcaaucagcggcgacgauugcguugugaagccacuggacgauagauuugcuucugccuuaacugcucugaacgacaugggcaaaguccggaaggauauucaacagugggagcccucgaggggguggaaugacuggacccaggugccuuucugcucacaucacuuucacgaauugaucaugaaagauggacgcgugcucgucguuccauguagaaaccaggacgagcugaucggucgggccaggauuagccaaggcgcaggguggucccuacgagaaacggcgugccuuggaaagaguuaugcccagauguggucucugauguacuuccaucguagagaucuccgccuggcugccaacgcaauauguagcgcugugccgucccacuggguacccacaucacggaccacuuggaguauccaugccaagcacgaguggaugacaaccgaagacauguugacuguguggaauagggucuggauucaggagaacccuuggauggaggacaaaaccccaguggaaucuugggaggaaauccccuauuuaggcaagagagaggaucaguggugcgguagccugauugggcucacaucccgcgcaacgugggccaaaaauauccaaaccgcgauaaaccagguucggucacuuaucggaaaugaagaguacacugacuauaugccuagcaugaagagguuucgaagagaggaagaggaagcuggcgugcugugguga

SEQ ID NO: 14302 - RNA, 9876 nt, Artificial Sequence
  derived and/or modified CDS sequence (opt3) from DENV-2__KF704357__SS-prME
accgccggcaugaucauuaugcugauacccacagugauggcuuuccaccucacuacgagaaacggggagccucauaugaucgucagcaggcaggaaaagggaaaaucccuucuguuuaagaccggugacggcguuaauaugugcacauugauggcaauggauuuaggggagcugugugaagacacuauuaccuacaaaugcccacuacuccggcaaaacgagccggaagauaucgacuguuggugcaauucuacaucaaccugggugacuuauggaacauguaccacgacuggcgagcaccgccgagagaagcguaguguagcccuggugccccaugucgguauggggcuugaaaccagaacagagacuuggaugagcuccgaaggagcguggaaacacgcucagaggauugagaccuggauccugcggcauccuggcuucacaauaauggccgcaaucuuggccuacaccauuggcacgacucacuuucagcgcgcucucaucuucauucugcugacagcaguggccccaucuaugaccaugagaugcaucgggauaucgaacagggauuuuguugagggagugucagguggcagcugggucgacauugugcucgaacacgggaguuguguaacuacaauggcuaagaauaagcccaccuuagaucuggagcuuaucaaaacggaagccaagcagccugcgaccuugcggaaauauugcauugaggcaaagcugacaaacacuaccacagaaucccgcuguccaacucaaggagagcccucucuaaaugaggaacaggacaaacgauucguuugcaagcauagcaugguggauagaggcugggguaacggguguggacucuuuggcaagggcuccaucgucaccugcgccauguucacaugcaaaaagaucaugaaagggaagguggugcagccugagaaucuggaauacaccauugucauaacuccacacucaggagaggaacaugcuguugguaacgacacgggcaaacacgggaaggagaucaaaauuacaccgcagaguagcaucaccgaggccgaacuuacuggauauggcaccgugacaauggaguguucucccaggaccggucuggauuuuaaugaaaugguauugcuccaaauggaggacaaggcauggcuggugcaccggcagugguucuuagaucugccucucccauggcuucccggggcugacacucagggcuccaacuggauacagaaggaaacacuggucacguuuaaaaauccucaugccaagaaacaagacgugguuguguugggaucacaggagggcgcgaugcacaccgcccuaacuggggcaacagagauucagaugagcaguggaaacguccuguucaccggucaucucaagugccgucugcgcauggauaaacuucaacugaagggcaugucuuacuccauguguacagggaaguuuaaagugguaaaggaaaucgcugagacucagcacggaaccaucguuauuagagugcaguaugaaggcgacgguagcccaugcaaaauccccuucgagauuauggauuuggagaagaggcauguccucgggcggcugauaacggugaauccgaucgucaccggcaaagacucgccugugaacauugaagccgagcccccauucggagauucuuacaucaucauuggcguugaaccugggcaguuaaagcugaacugguuuaagaaaggauccucaauaggucaaauguucgcuacaacuaugcgaggcgccaagcgcauggcaauccuaggggacaccgccugggauuuuggaagucucggcgguguguucacaagcauugggaaagcucugcaccagguauuuggcgcgaucuacggagcagccuucuccggcgucucuuggacuaugaagauucuuaucggggugauaaucaccuggauuggaaugaauagcagaucaacgaguuuguccguuagccuggugcucgucggcgugguaacacuguaucuuggugugaugguucaggcugacucugggugugucgugucauggaaaaacaaggagcugaagugcggaaguggcaucuuuauuaccgauaaugugcacacuuggacagaacaguacaaauuccaacccgagagcccauccaaguuggccucugcaauccagaaagcccaugaggaagguauauguggcauuaggucggucacccggcucgagaaccugauguggaagcagaucacucccgaauuaaaucacauucugagcgagaacgaaguuaaacuaaccaucaugacaggggacauaaagggaaucaugcaggcuggcaaacgcucccucagaccucaaccaacggagcugaaguauucauggaagaccugggggaaagccaagaugcuuaguacugagucucauaaucagacauuuuugauugauggaccggaaaccgcagagugccccaacacaaauagggcguggaacagccuggaaguggaggacuacggcuucgguguguuuacuaccaauaucuggcucaaacugcgugaagagcaggacguauucugugauuccaaguuaaugucagcugccauuaaagacaaccgggcaguccacgccgauaugggguauuggaucgagagcgcucugaaugacacguggaagauagaaaaggccucuuuuauugaggugaaauccugccacuggccuaagagucauacacuuuggagcaacggaguuuuggaaucugagaugaucaucccaaaaaauuucgcaggccccgugucccagcacaacuaccgaccugguuaucauacccaaacugcuggcccauggcaccucgggaagcuggagauggauuucgacuuuugugaaggaaccacagucgugguuacugaggauugcggcaacagagggcccucacuaaggaccacaacggccaguggaaaacugauuaccgaauggugcugucgcagcugcacucucccgccucugcgguacagaggcgaggacgguuguugguacgggauggaaaucaggccacuuaaggagaaggaggaaaauuuggugaacucgcugguaacagcgggacauggccagauugauaauuucuccuuagguguccucggcauggcccuguuucuugaggaaaugcugcgcacccgaguggggacuaaacacgcuauauugcucguggcagucucuuucguuacacugaucaccggaaacaugagcuuucgggaccuaggccgugugaugguaauggugggggccacgaugacugaugacauuggaaugggcgucaccuaucuggcucuccuggccgcauucaaggugagacccacauuugcggccggucuuuugcugaggaaauuaaccucaaaggagcucaugaugacuacaaucgggauuguucugcuuagucaguccaccaucccugaaacaauacuggagcuaacugaugcucucgcccugggaaugaugguguugaaaaugguccgcaagauggagaaguaccaacuggcagugaccaucauggcuauuuuaugcguucccaaugccgugauccuccagaacacguggaaagucucuuguacaauucuggcaguagugagcguuuccccacuuuuccugaccucaagccagcagaaggccgacuggaucccuuuggcucucacuauaaaaggccugaaucccaccgcgauuuuucuaacaacucugagucggaccaacaagaaaagaucuuggccacuuaaugaagccaucauggcagugggcauggucuccauccucgcuagcucgcuguugaagaacgacauuccgaugacggggccucugguggccggagguuuacucacaguaugcuaugugcugaccggcaggucagccgaucuugagcuggaacgagcugcagacgucaaaugggaggaucaagccgaaauaucugggaguucccccaucuugagcauuacuaucucugaggacggaagcauguccauuaagaaugaggaagaggaacagacacucaccauccugauacgcacuggccuacugguuaucucaggucuuuucccagugaguauucccaucacagcggcugccugguaccucugggaggugaagaaacagcgggcagggguccugugggaugugccuagcccacccccuguuggaaaggccgaguuggaagacggcgcuuauagaauuaaacagaagggcaucuuaggguacucucaaauaggagcagguguauauaaagagggcaccuuucacacgauguggcaugugacuaggggggccguccugaugcacaagggaaagcguauugaaccguccugggcggaugugaaaaaggaccucaucucauacggcgguggguggaaacuggagggagaauggaaggagggcgaggaaguucaggugcuugcucuggagccaggcaaaaacccccgcgccguccagaccaagccuggguuguucaagacaaaugcaggaaccaucggugccgugagucuagauuuuagcccaggcacauccgggucucccauuaucgaccggaaaggaaagguagucggccuguacgguaacggggugguuacuagaucgggagcuuaugugagcgccauagcacagaccgaaaaaucaauugaggauaauccugaaaucgaggacgauauuuucaggaagcgaaaacucacgaucauggaccugcauccgggcgcuggcaagacaaagcgguaccuucccgccauaguccgcgaggcgauuaaaagaggguuaaggacucugauccucgccccaacccgggugguugcagcugaaauggaggaagccuugcgaggacugccuaucagauaucaaacacccgcuauucgcgcagagcacaccgguagggaaaucguggaccucaugugucaugccacuuucaccaugcgucugcuuuccccaguccgggugccuaacuacaaccugauuauaauggaugaggcccacuuuacagaccccgcuaguaucgcggcaagaggcuauauuucuacgaggguagagaugggggaagccgcuggaaucuucaugacugccaccccaccgggcagccgcgauccuuuuccccaguccaaugcaccaaucauggacgaggaacgagagauucccgagagaucauggucuagcggucacgaaugggugacagauuucaaggggaaaaccguuugguuugucccuaguauacgggccggaaacgacaucgcugcgugcuugaggaagaauggcaaaaaggugauucagcuaucccgcaagacuuucgauagcgaguacgugaaaacacguaccaacgacugggauuuugucguaacgacugacaucucugaaaugggcgccaauuucaaggcagagagagugauugauccacggagguguaugaaacccguuauccugacagacggggaagagcgcgugauacucgcuggaccuaugccggucacccauucauccgccgcacaacgaagaggucggaucggcaggaacccaaagaaugagaacgaccaguauauuuacaugggggaacccuuagagaaugaugaagacugcgcccacuggaaagaggcuaagaugcugcuugauaacaucaauaccccugaaggaauuauccccaguauguuugagccagagcgcgaaaaaguggacgccauagauggcgaguacagacugaggggugaagcgcggaagacuuucguugaccucaugcgucgcggggauuugccuguguggcuggcauaucgagucgccgcugagggcauuaacuacgccgacagaaggugguguuuugauggaaucaagaauaaccagauucucgaagagaauguggagguagaaaucuggacaaaagagggcgaacggaagaaacugaagccccgcuggcuugacgcuagaauauauagcgauccacuagcacugaaagaguucaaggaguucgccgcugggaggaagucguugaccuuaaaccugaucacagaaaugggacggcucccuacuuuuaugacgcagaaagcccgagacgcacuggauaaccuugcggugcugcauaccgccgaggcugguggcagagccuacaaucacgcacucucugaauugccggagacacuggaaacucuacugcuccuuacccuguuagcuacaguuaccgggggaauuuucuuguuucugauguccggccgcgguaucgggaagaugacucucggcaugugcugcauuaucacggccagcauacugcuuugguaugcacaaauucagccccacuggaucgccgcuucaaucauucuggaguucuuucucaucgucuugcugauaccagagccugaaaaacagaggaccccccaggacaaccaauuaacauacguggugauugcgauccuaacugucguugccgcaaccauggcuaaugagaugggauuccuggaaaagacaaaaaaggaccucggccuugggaguauuaccacucagcagccagagucuaacauccuggauauagacuugcggccugccuccgccuggacacuguaugcaguggcuacgaccuuuguaacucccaugcuccgucauagcaucgaaaauucaagugugaacgucagccugacagccauugcgaaucaggcuaccgugcuuaugggacucgguaagggcuggccgcuguccaaaauggauaucgggguuccauugcuggccauuggauguuacucucaagugaacccuaucaccuuaacagcagcccuauuccugcucgucgcucacuacgcaauuaucggccccggucuucaggccaaggcgacuagagaggcucagaaaagggccgcagccgggauaaugaagaauccaacgguagacggcauuaccgugaucgaucuggaccccaucccuuaugauccgaaauuugagaagcaguugggacaaguuaugcugcucgugcugugcgucacacaggugcuuaugaugcgcacuaccugggcuuuaugugaagcccugacacucgcaaccggccccauuagcacuuugugggaggggaacccaggacgguucuggaauacgacaauagcugucuccauggccaacaucuuucgaggcucauaccuggcgggugccgggcuacuguucucuauuaugaagaauaccacuaacaccagaaggggaacaggcaauaugggugaaacucucggcgagaaauggaagagucgccuuaacgcacuggggaaaucggaauuucagaucuauaagaaaagcggaauucaagagguggaccggaccuuggcuaaggagggcaucaaaagaggggaaacagaucaucacgccguuucccguggaucugcaaagcugaggugguucguggagcggaauaugguaacgccugaaggcaagguggucgaccucgguugcgggcgcggaggcuggucauacuauugugguggccugaaaaacguucgagaggugaagggguuaaccaaaggaggccccgggcaugaggaaccuauaccaaugagcacuuacggauggaaccuugucagacugcaguccggcguggauguauucuuuacacccccugagaagugcgacacccuccuaugugauaucggugaaaguucuccaaaucccacuguggaggcugggaggacacugcggguuuugaaccugguggaaaauuggcucaacaauaacacccaguucugcauuaaaguccuuaauccguauaugccuagcgugaucgagaagauggaggcccugcagcgcaaguacggaggcgccuuggucagaaacccacugucaaggaauuccacgcacgaaauguacugggugaguaacgcgagcggcaauauuguuucuuccguaaacaugaucucacgaaugcucauaaaucgguuuaccaugcgucacaaaaaggcuacauucgagcccgacguggacuuagggagcggaacuagaaacauugguaucgaaucggagaucccuaaucuggauauuauaggcaaacgcaucgaaaagauuaaacaagaguaugagaccucuuggcauuacgaccaggaucacccauauaagacaugggcauaccaugggaguuaugaaacuaagcagaccggauccgccagcucaauggucaacggcgugguuaggcuucugacaaaacccugggacguggucccgauggugacccagauggcuaugacugauacgacaccuuuuggucaacagcggguauucaaggagaaaguggacaccagaacucaggaacccaaggaggggaccaaaaagcuaaugaagaucacagccgaauggcucuggaaagagcugggaaagaaaaagacgccacgcauguguaccagggaggaauuuacucgaaaaguucgguccaacgcagccuugggcgcuauuuucacagaugagaauaaguggaaaucugcgagagaagccgucgaggacagcagguuuugggagcugguggauaaggaacgcaaccuccaccuugagggcaagugcgaaaccuguguguacaauaugauggggaaacgugagaagaaacugggagaauucgguaaggcaaaaggcagucgggcuaucugguauaugugguuaggggccagauuucuggaguucgaggcauugggauuucucaacgaagaccacugguucuccagggagaauagccugucuggcgucgaaggugaggggcuacauaagcuuggauacauacugcgcgauguuucaaagaaagaaggcggcgccauguacgcugacgacacugccgggugggauacacgaaucacccucgaggaccugaagaacgaggaaauggugacaaaucacauggagggagaacauaaaaaguuggcggaggcaauuuucaaacugacuuaucagaacaagguagugcggguccaaagaccuacccccagggguacggugauggauaucauuagucgcagagaccagcggggcuccgggcagguuggaaccuacggccucaauacauuuacuaacauggaagcccaacuuaucaggcagauggagggugaggggguguucaagaauauucagcaccugaccgucacagaagagauagcugugcagaacugguuagcccguguaggacgagaacgccugagcagaauggcaaucucuggcgaugacugcguugugaaaccauuggaugaccgguuugcuucggcccucacugcucugaaugauaugggcaaggucaggaaagacauucaacagugggagcccucacgcggguggaacgauuggacccaggugccuuucugcagccaucacuuucacgagcuaaucaugaaggacggaagagugcuugucguuccaugucggaaucaggaugaacugaucgguagggcccgaauuucccaaggcgcaggguggagucuccgugagacggcgugccugggaaaaucuuaugcccagauguggagcuugauguacuuccauagacgcgacuuacggcuggcugccaacgcaauauguuccgcugugccgucacacuggguacccacaaguaggaccacuuggucuauccaugccaagcacgaauggaugacaaccgaggacaugcucacuguguggaacagagucuggauucaggaaaauccuuggauggaggauaagaccccaguggagagcugggaagagauccccuaucuuggcaaacgcgaagaccaguggugcgguucccugauugggcuaacaucacgggcaacgugggccaagaacauccaaaccgcgauaaaucagguuaggagccugaucggaaacgaggaauacacugauuauaugccuucuaugaaacgauuuagacgggaggaggaagaggcuggcgugcucugguga

SEQ ID NO: 14303 - RNA, 9876 nt, Artificial Sequence
  derived and/or modified CDS sequence (opt3) from DENV-2__KF704358__SS-prME
accgccggaaugaucauuaugcugauaccaaccgugauggcuuuccaccucacuacgaggaacggggagccucauaugaucgucucaaggcaggaaaagggaaaaucccuucuguuuaauaccggugacggcguucacaugugcacguugauggcaaugcauuuaggggagcugugugaagauacuauuaccuacaagugcccacuacuccggcaaaacgagccggaagacaucgauuguuggugcaauucuacaucaaccugggugacuuauggaacauguaccacgacuggcgagcaccgccgagagaaacguagugucgcccuggugccccaugucgguauggggcuugaaacccggacagagacuuggaugagcuccgaaggagcguggaagcacgcucagaggauugagaccuggauccugcggcacccuggcuucacaauaauggccgcaaucuuggccuacaccauuggcacgacucauuuucagcgcgcucucaucuucauucugcugacagcaguggccccaucuaugaccaugagaugcaucgggauaucgaacagggacuuuguugagggagugucagguggcagcugggucgauauugugcucgaacacgggaguuguguaacuacaauggcuaaaaauaagcccaccuuagaccuggagcuuaucaagacggaagccaaacagccugcgaccuugcggaaguauugcauugaggcaaaacugacaaacacuaccacagaaucccgcuguccaacucaaggagagcccucucuaaaugaggaacaggauaagcgauucguuugcaaacauagcaugguggacagaggcugggguaacggguguggacucuuuggcaagggcuccaucguaaccugcgccauguucacaugcaagaaaaucaugaaggggaaaguggugcagccugagaaucuggaauacaccauugucauaacuccacacucaggagaggaacacgcuguugguaacgauacgggcaagcaugggaaagagaucaagauuacaccgcagaguagcaucaccgaggccgaacuuacuggauauggcaccgugacaauggaguguucucccaggaccggucuggacuuuaaugaaaugguauugcuccaaauggaggauaaagcauggcuggugcaccggcagugguucuuagaccugccucucccauggcuucccggggcugauacucagggcuccaacuggauacagaaggaaacacuggucacguuuaagaauccucaugccaaaaagcaagacgugguuguguugggaucacaggagggcgcgaugcacaccgcccuaacuggggcaacagagauucagaugagcaguggaaacguccuguucaccggucaucucaaaugccgucugcgcauggacaaacuucaacugaaaggcaugucuuacuccauguguacagggaaguuuaaggugguaaaagaaaucgcugagacucagcacggaaccaucguuauuagagugcaguaugaaggcgaugguagcccaugcaagauccccuucgagauuauggacuuggagaaaaggcacguccucgggcggcugauaacggugaauccgaucgucaccggcaaggauucgccugugaacauugaagccgagcccccauucggagacucuuacaucaucauuggcguugaaccugggcaguuaaaacugaacugguuuaagaagggauccucaauaggucaaauguucgcuacaacuaugcgaggcgccaaacgcauggcaauccuaggggauaccgccugggacuuuggaagucucggcgguguguucacaagcauugggaaggcucugcaucagguauuuggcgcgaucuacggagcagccuucuccggcgucucuuggacuaugaaaauucuuaccggggugaucauaacguggaucggaaugaauagcagaucaacaaguuuguccguuagccuggugcucgucggcgugguaacccuguaucuuggugugaugguucaggcugauucugggugugucgugucauggaagaacaaagagcugaagugcggaaguggcauuuuuaucacugacaaugugcacacauggaccgaacaguacaaguuccaacccgagagcccauccaaauuggccucugcaauucagaaggcccaugaggaagguaucuguggcauaaggucggucacucggcucgagaaccugauguggaaacagauuacccccgaauuaaaucacauccugagcgagaacgaaguuaagcuaacaauuaugacgggggauaucaaaggaauaaugcaggcuggcaagcgcucccucagaccucaaccaaccgagcugaaauauucauggaagacuugggggaaggccaaaaugcuuaguacagagucucacaaucagaccuuuuugaucgacggaccggaaacagcagagugccccaacacuaauagggcguggaacagccuggaaguggaggauuacggcuucgguguguuuaccacgaauauuuggcucaagcugcgugaaaaacaggacguauucugugacuccaaguuaaugucagcugccaucaaagauaaccgggcaguccaugccgacaugggguauuggauugagagcgcucugaaugauacauggaagaucgagaaggccucuuuuauagaagugaaauccugccacuggccuaagagucauacccuuuggagcaacggaguuuuggagucugaaaugauuauccccaagaauuucgcaggccccgugucccagcacaacuaccgaccugguuaucauacucaaaccgcuggcccauggcaccucgggaagcuggagauggacuucgauuuuugugagggaacaacugucgugguuaccgaagacugcggcaacagagggcccucacuaaggacaacgaccgccaguggaaaacugaucacugaguggugcugucgcagcugcacacucccgccucugcgguacagaggcgaagaugguuguugguacgggauggagauuaggccacuuaaggaaaaggaggagaauuuggugaacucgcugguaaccgcgggacacggccagaucgacaauuucuccuuagguguccucggcauggcccuguuucuugaagagaugcugcgcacucgaguggggacaaaacaugcuauuuugcucguggcagucucuuucguuacccugauaacgggaaacaugagcuuucgggaucuaggccgugugaugguaauggugggggccacuaugaccgacgauaucggaaugggcgucacauaucuggcucuccuggccgcauucaaggugagacccaccuuugcggccggucuuuugcugaggaaauuaacuucaaaggaacucaugaugacaaccauugggaucguucugcuuagucaguccacaauuccugagacuauccuggaacuaaccgacgcucucgcccugggaaugaugguguugaaaaugguccgcaagauggagaaguaccaacuggcagugacgauaauggcuaucuuaugcguucccaaugccgugauucuccagaacacauggaaagucucuuguaccauccuggcaguagugagcguuuccccacuuuuccugacuucaagccagcagaaggccgauuggauuccuuuggcucucaccaucaaaggccugaaucccacagcgauauuucuaacuacccugagucggacgaacaagaaaagaucuuggccacuuaaugaggccauuauggcagugggcauggucuccauccucgcuagcucgcuguugaagaacgacaucccgaugacagggccucugguggccggagguuuacucaccguaugcuaugugcugacuggcaggucagccgaccuugaacuggagcgagcugcagaugucaaaugggaagaccaagccgagauuucugggaguucccccauauugagcaucacaauuucugaagauggaagcauguccaucaagaaugaggaggaagaacagacccucacuauucugauccgcacaggccuacugguuauaucaggucuuuucccagugaguauccccauuaccgcggcugccugguaccucugggaagugaagaaacagcgggcagggguccugugggacgugccuagcccacccccuguuggaaaggccgaguuggaggauggcgcuuauagaaucaaacagaagggcauuuuaggguacucucaaaucggagccgguguauauaaagaaggcacguuucacacuauguggcaugugaccagaggggcaguccugaugcacaagggaaagcguauagagccguccugggcggacgugaaaaaggaucucauuucauacggcgguggguggaaacuggaaggagaguggaaggaaggcgaggagguucaggugcuugcucuggaaccaggcaaaaacccccgcgccguccagacaaagccuggguuguucaagaccaaugcaggaacaaucggugccgugagucuagacuuuagcccaggcacuuccgggucucccaucauugauaaaaagggaaaaguagucggccuguacgguaacggggugguuacccggucgggagcuuaugugagcgccaucgcacagacggagaagucaauagaagacaauccugagauugaagaugacaucuucagaaaaaggaagcucacaauuauggaucugcauccgggcgcuggcaagacuaaacgauaccuucccgccaucguccgggaggcgauaaagcgcggguuaagaacccugauucucgccccaacaagggugguugcagcugagauggaagaggccuugcggggacugccuauccgauaucaaacccccgcuaucagagcagaacacacuggucgcgagauuguggaccucaugugucacgccaccuucacaaugaggcugcuuuccccaguccgugugccuaacuacaaccugaucauuauggacgaagcccauuuuacggaucccgcuaguauagcggcacggggcuauaucucuacuagaguagagaugggggaggccgcuggaauuuucaugaccgccacaccaccgggcagcagggacccuuuuccccaguccaaugcaccaaucauggaugaagaacgcgaaauccccgagcgaucauggucuagcggucacgagugggugaccgacuucaaagggaagacuguuugguuugucccuaguauuagagccggaaacgauauagcugcgugcuugcggaaaaauggcaagaaggugauccagcuauccaggaaaacauucgacagcgaauacgugaagacccgcacgaacgauugggacuuugucguaacuacagauauuucugagaugggcgccaauuucaaagcagaacgugugaucgacccaagacgguguaugaagcccguuauucugaccgauggggaggaaagggugauccucgcuggaccuaugccggucacccauucauccgccgcacaacgccgagguagaauaggccggaaccccaagaaugagaacgaccaguauaucuacaugggggagcccuuagaaaaugacgaggauugcgcccacuggaaggaagcuaaaaugcugcuugacaacauuaauacuccugagggaaucauucccaguauguuugaaccagagagggagaagguggaugccaucgacggcgaauaccgccugagaggugaggcgaggaagacauucguugaucucaugcggcguggggacuugccuguguggcuggcauaucgcgucgccgcugaaggcauaaacuacgccgaucgaagaugguguuuugacggaauuaaaaauaaccagauccucgaggaaaauguggagguagagauuuggaccaaggaaggcgagaggaaaaagcugaaaccccgguggcuugaugcucgcaucuauagcgacccacuagcacugaaggaguucaaggaguucgccgcugggagaaaaucguugacauuaaaccugauaacugagaugggaaggcucccuacguuuaugacccagaaggcccgggaugcacuggacaaccuugcggugcugcacacagccgaagcugguggccgagccuacaaucaugcacucucugaguugccggaaacucuggagacccuacugcuccuuacacuguuagcuaccguuacugggggaaucuucuuguuucugauguccggcagagguauugggaaaaugacgcucggcaugugcugcaucauuaccgccagcauccugcuuugguaugcacaaauacagccccacuggauugccgcuucaaucauccuggaguucuuucucauugucuugcugaucccagagccugagaagcagcgcacaccccaggauaaccaauuaacuuacguggugauagcgauucuaaccgucguugccgcaacaauggcuaaugaaaugggauuccuggagaaaaccaagaaggaccucggccuugggaguaucacuacacagcagccagaaucuaacauucuggacaucgauuugaggccugccuccgccuggacgcuguaugcaguggcuaccacuuuuguaacacccaugcuccggcauagcauagaaaauucaagugugaacgucagccugaccgccaucgcgaaucaggcuaccgugcuuaugggacucgguaaaggcuggccgcuguccaagauggacauugggguuccauugcuggccaucggauguuacucucaagugaacccuauuacauuaacugcagcccuauuccugcucgucgcucacuacgcaaucauuggccccggucuucaggccaaagcgacgcgugaagcucagaagagagccgcagccgggaucaugaaaaauccaaccguagauggcauaacagugauugaccuggaucccaucccuuaugacccgaaguuugagaagcaguugggacaaguuaugcugcucgugcugugcgucacucaggugcuuaugaugaggaccacaugggcuuuaugugaggcccugacccucgcaacuggccccaucagcacguugugggaagggaacccaggacgcuucuggaauacaaccauugcugucuccauggccaacauauuucggggcucauaccuggcgggugccgggcuacuguucucuaucaugaaaaauacuaccaacacacgaagaggaacuggcaauaugggugagacccucggcgaaaaguggaaaaguaggcuuaacgcacuggggaagucggaguuucagauuuauaaaaagagcggaauccaagaaguggaucgcacauuggcuaaagagggcauuaagagaggggaaacggaccaucacgccguuuccagaggaucugcaaagcugcguugguucguggaaaggaauaugguaaccccugagggcaaaguggucgaucucgguugcgggcggggaggcuggucauacuauugugguggccugaagaacguucgcgaagugaaaggguuaacuaagggaggccccgggcacgaggagccuaucccaaugagcacauacggauggaaccuuguccgacugcaguccggcguggacguauucuuuacaccaccugaaaaaugcgauacucuccuaugugacauaggugagaguucuccaaaucccacaguggaagcugggagaacccugaggguuuugaaccugguggagaauuggcucaacaauaacacgcaguucugcaucaagguccuuaauccguauaugccuagcgugauugaaaagauggaggcccugcagcggaaauacggaggcgccuugguccgcaacccacugucaagaaauuccacccaugagauguacugggugaguaacgcgagcggcaauaucguuucuuccguaaacaugauuucaaggaugcucaucaaucgauuuacaaugcggcacaagaaagcuacuuucgaacccgauguggacuuagggagcggaacccguaacauagguauugagucggaaaucccuaaucuggacaucauuggcaagagaauagagaaaaucaagcaagaauaugagacaucuuggcauuacgaucaggaccacccauauaagacuugggcauaccacgggaguuaugagaccaaacagacaggauccgccagcucaauggucaacggcgugguucgccuucugaccaagcccugggauguggucccgauggugacucagauggcuaugacggacacaaccccuuuuggucaacagaggguauucaaagaaaagguggauacucggacccaggagcccaaagaagggacaaagaagcuaaugaaaauuacggccgaguggcucuggaaggaacugggcaaaaagaaaaccccaagaauguguacucgcgaggaguuuacaaggaagguucgauccaacgcagccuugggcgcuaucuucaccgacgaaaauaaauggaagucugcgcgggaggccgucgaagauagcagauuuugggagcugguggacaaggagaggaaccuccaucuugaaggcaaaugcgagacuuguguguacaauaugauggggaagcgcgagaaaaagcugggagaguucgguaaagcaaagggcagucgugcuauuugguauaugugguuaggggcccgguuucuggaguucgaggcauugggauuucucaacgaggaucacugguucuccagagaaaauagccugucuggcgucgagggugaagggcuacauaaacuuggauacauccugagggacguuagcaaaaaggagggcggcgccauguacgcugaugacacagccgggugggacacccgcauaacacucgaagaucugaaaaacgaggagauggugacuaaucacauggaaggagagcauaagaaauuggcggaagcaaucuucaagcugaccuaucagaacaagguagugcgaguccaacggccuacgcccagagguaccgugauggacauuaucaguaggcgcgaucagagaggcuccgggcagguuggaacauacggccucaauacuuuuaccaacauggaggcccaacuuauucggcagauggaaggugaggggguguucaaaaauauccagcaccugacagucacugaggaaauugcugugcagaacugguuagccaggguaggacgugagcgacugagccgcauggcaauaucuggcgacgauugcguugugaagccauuggacgauagauuugcuucggcccucaccgcucugaaugacaugggcaaaguccggaaggauauccaacagugggaacccucaaggggguggaacgacuggacacaggugccuuucugcagccaccauuuucacgagcuaauuaugaaagauggacgcgugcuugucguuccauguagaaaucaggacgagcugaucggucgggccaggaucucccaaggcgcaggguggagucuccgagaaacagcgugccugggaaagucuuaugcccagauguggagcuugauguacuuccaucguagagauuuacgccuggcugccaacgcaauuuguuccgcugugccgucacacuggguacccaccagucggacuacauggucuauacacgccaagcaugaguggaugaccacugaagacaugcucaccguguggaacagggucuggauccaggagaauccuuggauggaagacaaaacaccaguggagagcugggaggaaauucccuaucuuggcaagagagaggaucaguggugcgguucccugaucgggcuaacgucacgcgcaaccugggccaaaaacauucaaacugcgaucaaucagguucggagccugauaggaaacgaagaguacacagacuauaugccuucuaugaagagguuucgaagagaagaggaggaagcuggcgugcucugguga

SEQ ID NO: 14304 - RNA, 9876 nt, Artificial Sequence
  derived and/or modified CDS sequence (opt3) from DENV-2__KF041232__SS-prME
accgcaggcgugaucauuaugcugauacccacugcuauggcauuccaccucacuacgagaaauggggaaccucauaugaucgucagcaagcaggaaaaaggaaagucccuucuguuuaaaaccgaagacgguguuaauaugugcacauugauggccauggauuuaggcgaacugugugaagacacuauuaccuacaacugcccacugcucaggcaaaaugaaccggaagauaucgacuguuggugcaacgcgacaucuaccugggugacuuaugggacauguaccgcuacgggagaacaccggcgcgaaaagcgaucaguagcccuggugccccaugucggcaugggucuugagacucguaccgaaacauggaugaguagcgagggggcauggaaacacgcccagagaauugagacuuggauccugaggcauccuggauucaccauaauggcugcaaucuuggccuacacaauuggcaccacguauuuucagcgggugcucaucuucauucugcugacugcuguugccccauccaugacaaugcgcugcaucggcauaucuaauagagauuuuguggaaggggucucgggagguucauggguggacauuguacucgagcacggcagcuguguuaccacuauggcgaagaacaagcccacauuagauuucgaacugaucaaaaccgaggcaaagcagccugccacgcuuaggaaauacugcauugaagcuaaguugaccaauacaacuaccgccagucgguguccaacacaaggggagcccucccugaacgaggaacaggacaaacgcuuugugugcaagcacucuauggucgaucgaggauggggcaaugguugugggcuauucggaaagggcggcaucgugacuugcgcaauguuuaccugcaaaaagaacauggaggggaaaaucgugcagccugaaaaucucgaguauacaauugucguuaccccacauagcggagaagagaacgcuguggguaaugacacuggcaagcacgggaaagagauaaagguaacgccgcaguccucaaucacagaagccgagcugaccggauacggcacugugaccauggaauguagucccagaacaggucuugauuucaacgagaugguccuguugcaaauggaaaauaaagcguggcucgugcauaggcagugguuucuggacuuaccucugccauggcuccccggggccgauauucagggcagcaacuggauccagaaggagacccuuguuacuuucaagaacccucacgccaagaagcaagacguggucgugcugggaucucaggagggcgcuaugcacacagccuugacgggggcuaccgaaauacagauguccucaggaaaucuacuguuuacuggucaucucaaaugccggcugcguauggacaaacuucaacugaaaggcaugagcuauaguauguguacagggaaguucaagguaguuaaagagauugccgaaacccagcacggaacaaucgugguccgcgugcaguacgagggcgaugguucuccaugcaagauccccuucgagauuauggacuuggagaagagacauguccucgggaggcugaucacugugaacccgauuguuaccgagaaggauuccccugugaauauagaagcagagcccccauuuggcgacagcuacaucauuaucggaguagaaccuggccaguuaaaacugucgugguucaagaaggggucuuccaucggacaaauguuugagacgaccaugcggggugccaaacgaauggcuauucuaggcgauacagcgugggacuucgggucacucggaggcgucuuuacaaguauagguaaggcacugcaccagguguucggggccaucuauggcgcugccuuuagcggaguuuccuggaccaugaaaauucuuaucggcguggucauuacauggaucgggaugaacucucgcagcacuucauugagugugucccugguacucgugggaguugucacccuguaccuuggcgcaauggugcaggccgauagcgguuguguggucucuuggaagaauaaagagcugaagugcgggucaggaauauucaucacggacaacguucauacauggaccgaacaguauaaguuucaacccgagaguccaagcaaauuggcuuccgccauucagaaggcacacgaagagggcaucugugguauuagaucugugacuaggcucgaaaaucugauguggaaacagaucacacccgaguuaaaccacauacugucggagaaugaagugaagcuaagcauuaugaccggcgauaucaaagggauuaugcaggcgggaaagcggucccuccgcccucaaccaacugagcugaaauacucauggaagaccuggggcaaggcuaaaaugcuuaguacagaaccgcauaaccagacguucuugaucgacgggcccgagaccgccgaaugcccuaauacuaacagagcauggaacucucuggagguagaggauuauggauuuggcgucuucacaaccaacauauggcucaagcugaaagaaaggcaggacguguuuugugacagcaaguuaauguccgccgcuaucaaagauaaucgugccguucacgcagacauggguuacuggauugagucagcucugaacgauacauggaagaucgaaaaggccagcuucauugaggugaaaucuugccauuggccaaagucccacacucuuuggaguaacggggucuuggagagcgaaaugaucauacccaaaaauuucgcgggaccugugucucagcacaacuaucggccaggcuaccauacccaaacggccggucccuggcaccucggcaagcuggagauggacuuugauuucugugaagggacaaccguugugguaacugaggacugcggaaaucgaggcccgucccuaagaaccacaacugcuucagggaaacugauuaccgaauggugcuguaggaguugcacacucccuccacugcgcuaccggggagaggauggcuguugguaugguauggagaucagaccccuuaaggaaaaggaggaaaacuuggucaauagccuggugacggcagggcauggacagaucgacaacuuuucguuaggcgugcucgguauggcccuguuccuugaggaaaugcugaggacccgcgucggcacuaaacacgcuguuuugcucguggccguauccuuuaugacacugauuaccgggaauaugucuuuccgagaucuaggacgggugauggucauggugggcgcagcgaugacugacgauaucgggaugggaguuacauaccuggcccuccuggcugccuuuaaggugcguccuaccuucgcagcuggccuuuugcugagaaaauuaacgagcaaggagcucaugaugacuaccauugguauaguccugcuuucacagaguacaacccccgagacuauccuggaacuaacagacgcccucgcacuggggaugaugauuuugaaaaucgugaggaacauggagaaguaucaacuggccguuaccauuauggcuaucuuaugcgugccaaaugcggucauacuccagaacgccuggaagguauccuguacaauccuggcagcugugucuguuagcccucuucuguugacuuccucacagcagaaagccgauuggauuccccucgcccugaccaucaagggacuaaauccaacggcuauuuuucugacaacccuuagccgcacuaacaaaaagcggaguuggccgcucaaugaagcaaucauggccgugggcauggucucuauacuggcguccagcuugcugaaaaacgacauuccuaugaccggccccuuaguggcugggggacuccugacaguaugcuacgugcuuacugguagaucggccgaccuggaguuggaaagggcagccgauguccgaugggaggaccaagcugagaucucaggcucuaguccaauccucuccauuaccauaagcgaagaugggucuaugagcaucaagaaugaggaagaggagcagacgcugacaauucuaauccgcaccggacugcuuguuauuuccggccucuuccccgugucaaucccuauaacugcagccgcgugguaucugugggaagugaaaaagcagcgggcuggugucuugugggacgugccaagucccccuccgguugggaaggccgaguuagaagauggagcauacagaaucaaacagaagggcauucugggcuauagccaaaucggggccggaguauacaaagaggguacauuucauaccauguggcacgugacuaggggcgcuguccucaugcacaaggggaaacguauugaaccaucuugggccgacgugcgcaaggaucugaucuccuacggaggcgguuggaaacuugagggggaguggaaagaaggagaggaaguucaggugcuggcauuggagcccggcaagaacccucgggcuguccagacaaaaccaggccuauucaagaccaacacggggacuauaggagccgugucacuggacuuuagucccgguaccagcggcuccccuauuguagauaaaaaggggaaggucgugggacucuauggcaaugguguugugacaagaucugggaccuacgucucggcgaucgcccagacagagaaaagcaucgaggacaacccggagauugaagaugacaucuucaggaagaaacgacugacuauaauggaucuucaucccggagcaggcaagaccaaacgguauuuaccagcuauugugcgcgaggccaucaagagaggccugaggacgcucauuuuggcuccuacacggguuguggcagccgaaauggaggaagcccugcgagggcuccccaucagauaccaaacuccagcuauacgcgcggagcacaccggaagggagauugucgaccugaugugucaugcaacauucaccaugcgucuucugucaccugugcggguacccaauuauaacuugaucaucauggacgaagcccacuuuacugauccagcuuccauugccgcaagagguuacaucaguaccaggguggagaugggcgaagccgcugggauuuucaugacagcgacgccgccuggaucucgcgaccccuuuccacagagcaaugcccccauaauggaugaggagcgagaaaucccugagagauccuggaacucaggccaugaauggguuacugacuucaaggguaaaaccgucugguuugugccaucuauuaaggcagggaaugauaucgcugccugccuacggaaaaacggaaagaaagugauccagcugagcaggaagacauucgacagugaguauauuaagacccgcacuaaugauugggacuuugucguaacaaccgauauauccgaaaugggcgcaaacuucaaagccgagcgugugaucgaccccagacgguguaugaagccuguuauucucacggauggcgaggaaagggugaucuuagcugggccgaugccagucacucacagcucugccgcgcaacgccgaggaagaauuggucggaaucccaaaaacgagaaugaccaguacaucuacaugggcgaaccucuggagaacgacgaagauugcgcacacuggaaggaggccaaaaugcuucuggacaauauaaacacacccgaggggaucauuccaucaauguuugaaccugagagggaaaagguggaugcuaucgacggagaguaucgccucagaggcgaagccaggaaaaccuucguugauuugaugcggcguggugaccugcccguguggcucgcuuaccgcgucgcagccgaggggauuaacuaugcugaucgaagaugguguuuugacggcaucaagaauaaccagauacuggaggaaaauguggagguagaaauuuggaccaaggagggagagaggaagaaacuuaaaccacgguggcuagaugcccgcaucuacuccgacccucuggcauugaaggaguucaaagaguucgcggccggcagaaagaguuuaacucugaaccucauuacagaaauggggaggcugccgaccuuuaugacacagaaggcucggaaugcccuugauaaccuggcagugcuccauacugcugaggccggaggucgagcauauaaucacgccuugagcgaacugcccgagacgcuagagacccugcuccuucugacauuauuggcuacuguuaccggcgggaucuuccuguuucucaugucgggaaaaggcauagguaagaugacacuggggaugugcugcaucauuaccgcgucuauccuucugugguacgcccaaauucagccacauuggaucgcagcuuccauaauucucgaguucuuuuugaucguccuguuaaucccugagcccgaaaaacagagaacuccacaggacaaccaacuaacguauguggugauugccauccugaccgucguugccgcaacaauggcuaaugagaugggcuuccucgaaaagacuaaaaaggauuuuggacuuggcagcauagccacccagcagccugagucaaacauucuggacaucgacuugcgccccgcgagugcuuggacacuguacgccguggcaaccacuuucauuacaccgaugcucaggcacucuaucgaaaauuccagcguaaacgugucacugacggccauagcuaaucaggcaaccguccuuauggggcucggaaaggguuggccacugaguaaaauggauaucggcgugccuuugcuggccauuggguguuacagccaaguuaaccccaucacuuuaacagcggcucuacugcuccuuguggcccacuaugcaauuaucggaccaggccugcaggccaaggcuacccgggaagcccagaaacgugcagcugccgguauuaugaagaaucccaccgucgacgggaucacaguaauagauuuggacccuauuccguacgaucccaaauuugagaagcagcugggccaagugaugcuccugguucuuugcgugacucaggucuuaaugaugagaacgaccugggcgcugugugaagcccucacauuggcaacuggaccaaucuccacccugugggagggcaacccugggagguucuggaauacaaccaucgcugugucuauggccaacauuuuucgcggaagcuaucuagcaggcgcuggucuacucuucuccauaaugaagaacacuacgaauacacggcgagggaccggaaacacuggcgaaacccuuggugagaaauggaagaauagacugaacucauugggcaaaucugaguuucagaucuacaagaggagugggauucaagaagucgaccgcacacuggccaaagagggaaucaagcggggcgaaacugaucaucacgccgugucgagagggagcgcgaaacuccguugguucguugagaggaaucuggugacccccgagggaaagguaguggacuuaggcugcggucgcgggggaugguccuauuacuguggcggucuuaagaacguccgggaaguuaaaggccugacaaaagggggaccuggccaugaggaaccaauucccaugucuacguauggguggaaucucgugcgacuacagucaggagucgauguguucuuuaccccuccagagaaaugcgacacucuguugugugauaucggcgaaagcucccccaacccgacaguagaggcugguagaacccugagggugcucaaucuuguugagaacuggcugaauaacaauacucaguucugcauaaagguguugaacccuuacaugccaagugucaucgagaagauggagacacugcagcggaaguacgggggagcacucgugcgcaaucccuuaucuagaaacagcacccacgaaauguauugggucucaaacgccuccggcaauauugugaguagcguuaacaugaucucuaggaugcugauuaaucgauuuacgaugcggcauaagaaagcuaccuacgagccugacguagaucuuggcuccgggacacguaacaucggaauagaaucagagacuccaaaucuggacauuaucgguaagagaaucgagaaaauuaagcaagaacacgagaccagcuggcacuaugaccaggaucaucccuacaaaacaugggccuaucacggcucguacgaaacuaagcagaccgggucugcaaguuccauggugaacggagucgugcgccuacucacaaagccgugggacguuauaccuauggugacccagauggccaugacugauacgacacccuucggccaacagagggucuuuaaagagaagguggacacccggacucaggaaccaaaagaggguaccaagaaacugaugaagaucacagcugagugguuguggaaggaacuggggaaaaagaaaacgccuagaauguguacccgcgaggaguucgcgaggaagguacgaagcaaugccgcacucggagcuauuuuuacugaugagaacaaauggaagucagcccgggaggcaguggaagacuccagauucugggagcuuguugauaaagaaaggaaucugcauuuagagggcaagugcgaaacaugugucuauaacaugaugggcaagcgcgagaaaaagaucggggaguuuggaaaagccaaggguucucgugcuauuugguacauguggcugggcgcccgguucuuggaauuugaggcgcucggguuccugaaugaagaccacugguuuagcagagagaacagucuauccggaguggaaggcgagggucuucacaaacugggguacauccucagggaggugagcaagaaggaaggaggcgcaauguaugccgaugacaccgcuggcugggauacucgcauaacacuggaggacuugaaaaaugaagagauggucaccaaccauauggaaggggagcacaagaaacuggccgaggcaaucuucaagcucacauaccagaauaaaguugugcgaguacaacggcccacuccaagaggaaccgugauggacauuaucucuaggcgcgaucagagagguucaggccaggucgggacguauggacuuaacaccuucacaaacaugggcgcucaacugauucggcagauggaaggugaggggguguuuaagggaauccagcauuuaacugccaccgaagagguugcugugcaggacuggcuggccagggucggccgugagcgauugagucgcauggcaauuuccggcgaugacugcgugguaaagccccucgaugacagauucgcgaaugcccugacagcucuaaacgauauggggaaaguucggaaggacauacaacagugggaaccuagcaggggauggaaugauuggacucaggugccauuuugcucucaccauuuccacgagcuuaucaugaaagacggucgcguccugguggugccguguagaaaccaggaugaacucauuggccgggccaggaucucgcaaggggcaggauggucacugcgagagaccgcuugcuugggcaagagcuacgcccagaugugguccuuaauguauuuucaccguagagaccugcgccucgcagccaaugcgaucuguagugcuguccccucucauuggguuccuacgagccggacaaccugguccauucacgccaggcaugaauggaugacuacagaggauaugcuuaccguguggaacagaguauggauacaggagaauccauggauggaagacaaaacucccguggagucaugggaagagaucccuuaccuggguaagcgcgaagaccaguggugcgggagucuaauuggacugaccucucgggcaacaugggccaggaacauccaaacggcuauuaaucagguccgaagccucaucggcuccgaggaguauaccgauuacaugccaucaaugaagagauuccggagggaagaggaagaggccggcguguugugguga

SEQ ID NO: 14305 - RNA, 9876 nt, Artificial Sequence
  derived and/or modified CDS sequence (opt3) from DENV-2__KF041233__SS-prME
accgccggagugaucauuaugcugauacccacugcuauggcguuccaccucacuacgagaaauggggaaccucauaugaucgucagcaagcaggaaaaaggaaagucccuucuguuuaaaaccgaagacgguguuaauaugugcacauugauggccauggauuuaggagaacugugugaagacacuauuaccuacaacugcccacugcucaggcaaaaugaaccggaagauaucgacuguuggugcaacucuacaucaaccugggugacuuaugggacauguaccgcgacgggagaacaccggcgcgaaaagcgaaguguugcucuggugccccaugucggcaugggucuugagacucguaccgaaacauggaugagcuccgagggggccuggaaacacgcacagagaauugagacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagauuuuguggaaggggucucaggagguagcuggguggacauuguacucgagcacggcaguuguguuaccacuauggccaagaacaagcccacauuagauuucgaacugaucaaaaccgaggcgaagcagccugcaacgcuuaggaaauacugcauugaagccaaguugaccaauacaacuaccgcuucccgguguccaacacaaggggagcccucucugaacgaggaacaggacaaacgcuuugugugcaagcacagcauggucgaucgaggauggggcaaugguugugggcuauucggaaagggcggcaucgugacuugcgccauguuuaccugcaaaaagaacauggaggggaaaaucgugcagccugaaaaucucgaguauacaauugucguuaccccacauuccggagaagagaacgcaguggguaaugacacuggcaagcacgggaaagagauaaagguaacgccgcagucaaguaucacagaagcugagcugaccggauacggcacugugaccauggaauguagccccagaacaggucuugauuucaacgagaugguccuguugcaaauggaaaauaaagccuggcucgugcauaggcagugguuucuggacuuaccucugccauggcuccccggggcggauauucagggcucuaacuggauccagaaggagacccuuguuacuuucaagaacccucacgccaaaaagcaagacguggucgugcugggaucccaggagggcgcaaugcacacagcuuugacgggggccaccgaaauacagaugucaagcggaaaucuacuguuuacuggucaucucaaaugccggcugcguauggacaaacuucaacugaaaggcaugaguuauucuauguguacagggaaguucaagguaguuaaagagauugcugaaacccagcacggaacaaucgugguccgcgugcaguacgagggcgaugguuccccaugcaagauccccuucgagauuauggacuuggagaagagacauguccucgggaggcugaucacugugaacccgauuguuaccgagaaggauagcccugugaauauagaagccgagcccccauuuggcgacucguacaucauuaucggaguagaaccuggccaguuaaaacugucuugguucaagaagggguccucaaucggacaaauguuugagacgaccaugcggggugcaaaacgaauggccauucuaggcgauacagcuugggacuucgggagucucggaggcgucuuuacuagcauagguaaggcgcugcaccagguguucggggcaaucuauggcgccgcuuuuuccggaguuucuuggaccaugaaaauucuuaucggcguggucauuacauggaucgggaugaacagccgcucaacaaguuuguccgugagccugguacucgugggaguugucacccuguaccuuggcgugauggugcaggccgauucugguugugucguuucauggaagaauaaagagcugaagugcgggaguggaauauucaucacggacaacgugcauacauggaccgaacaguauaaguuucaacccgagagcccauccaaauuggcagccgcuauucagaaggcccacgaagagggcaucugugguauuagaucugugacuaggcucgaaaaucugauguggaaacagaucacacccgaguuaaaccacauacugucggagaaugaaguaaagcuaagcauuaugaccggcgauaucaaagggauuaugcaggcaggaaagcggucccuccgcccucaaccaacugagcugaaauacucauggaagaccuggggcaaggcgaaaaugcuuaguacagaaccgcauaaccagacguucuugaucgacgggcccgagaccgcugaaugcccuaauacuaacagagccuggaacucucuggaggucgaggauuauggauuuggcguguucacaaccaacauauggcucaagcugaaagaaaggcaggacguauuuugugacagcaaguuaauguccgcagccaucaaagauaaucgugcugugcacgccgacauggguuacuggauugagucagcacugaacgauacauggaagaucgaaaaggcuagcuucauugaggucaaaucuugccauuggccaaagucccacacucuuuggaguaacgggguguuggagagcgaaaugaucauacccaaaaauuucgccggaccuguuucucagcacaacuaucggccaggcuaccauacccaaacggcgggucccuggcaccucggcaagcuggagauggacuuugauuucugugaagggacaaccgugguagucacugaggacugcggaaaucgaggcccgucccuaagaaccacaacugccucagggaaacugauuaccgaauggugcuguaggaguugcacacucccuccacugcgcuaccggggagaggauggcuguugguaugguauggagaucagaccccuuaaggaaaaggaggaaaacuuggugaauagccuggugacggcugggcauggacagaucgacaacuuuucguuaggcguccucgguauggcacuguuccuugaggaaaugcugaggacccgcguuggcacuaaacacgccguguugcucauugcuguauccuuuaugacacugaucaccgggaauaugucuuuccgagaucuaggacgggugauggucauggugggcgccgcaaugacugacgauauugggaugggaguuacauaccuggcgcuccuggccgcuuuuaaggugcguccuaccuucgccgcaggccuuuugcugagaaaauuaacgagcaaggagcucaugaugacuaccauagguaucguccugcuuucacagaguacaacccccgagacuauucuggaacuaacagacgcucucgcccuggggaugaugaucuugaaaauugugaggaacauggagaaguaucaacuggcaguuaccaucauggccauauuaugcgugccaaaugcugucauccuccagaacgcguggaagguauccuguacaauucuggccgcagugucuguuagcccucuucuguugacuuccucacagcagaaagcugauuggaucccccucgcccugaccauuaagggacuaaauccaacggccaucuuucugacaacccuuagccgcacuaacaaaaagcggaguuggccgcucaaugaagcuauaauggcagugggcauggucucuauucuggccuccagcuugcugaaaaacgacaucccuaugaccggccccuuaguggcagggggacuccugacaguaugcuacgugcuuacugguagaucggcugaccuggaguuggaaagggccgcagauguccgaugggaggaccaagccgagaucucaggcucuaguccaauucucuccauaaccaucagcgaagaugggucuaugagcauuaagaaugaggaagaggagcagacgcugacaauccuaauucgcaccggacugcuuguuaucuccggccucuuccccgugucaauaccuaucacugcugcagccugguaucugugggaagugaaaaagcagcgggcgggugucuugugggacgugccaagucccccuccgguugggaaggcugaguuagaagauggagccuacagaauuaaacagaagggcauccugggcuauagccaaauuggggcaggaguauacaaagaggguacauuucauaccauguggcacgugacuaggggcgccguccucaugcacaaggggaaacguaucgaaccaucuugggcugacgugcgcaaggaucugauauccuacggaggcgguuggaaacuugagggggaguggaaagaaggagaggaaguucaggugcuggccuuggagcccggcaagaacccucgggcaguccagacaaaaccaggccuauucaagaccaacacggggacuauuggagcugugucacuggacuuuagucccgguaccagcggcuccccuaucguagauaaaaaggggaaggucgugggacucuauggcaaugguguugugacaagaucugggaccuacgucucggccaucgcgcagacagaaaagagcauugaggacaacccggagaucgaggaugacauauucaggaagaaaaagcugacuauuauggaucuucaucccggagccggcaaaaccaagcgauauuuaccagcaaucgugcgggaggcuauuaagcgcggccugagaacgcucaucuuggccccuacaaggguuguggcugcagaaauggaggaagcccugcgggggcuccccauacgauaccaaacuccagccauuagagcugagcacaccggacgcgagaucgucgaccugaugugucaugcgacauucaccaugaggcuucugucaccugugcguguacccaauuauaacuugaucauuauggacgaagcacacuuuacugauccagccuccaucgcugcccgggguuacauuaguaccagaguggagaugggcgaagcagccgggauauucaugacagcuacgccgccuggaucuagggaccccuuuccacagagcaaugcgcccaucauggaugaggagcgcgaaauuccugagcgauccuggaacucaggccaugaauggguuacugacuucaaagguaagaccgucugguuugugccaucuaucaaagccgggaaugauaucgcagcuugccuaagaaagaacggcaaaaaggugauucagcugagccggaagacauucgacagugaguauauaaaaaccaggacuaaugauugggacuuugucguaacaaccgauaucuccgaaaugggcgccaacuucaaggcagagcgcgugauugacccccguagauguaugaaaccuguuauccucacggauggcgaggaacgggugauuuuagccgggccgaugccagucacucacagcucugcugcccaaaggcgcggacgaaucgguagaaaucccaagaacgagaaugaccaguacauauacaugggcgaaccucuggagaacgacgaagauugcgcgcacuggaaagaggcaaagaugcuucuggacaauaucaacacacccgaggggauuaucccaucaauguuugaaccugagcgggaaaaaguggaugccauugacggagaguauaggcuccgcggcgaagcuagaaagaccuucguugauuugaugaggcggggugaccugcccguguggcucgccuaccgugucgcugcagaggggaucaacuaugccgaucgccgaugguguuuugacggcauaaagaauaaccagauucuggaggaaaauguggagguagaaaucuggaccaaagagggagagagaaagaaacuuaagccaagguggcuagaugcucggauuuacuccgacccucuggccuugaaagaguucaaggaguucgcagcgggccgcaagaguuuaacucugaaccucaucacagaaauggggagacugccgaccuuuaugacacagaaagccaggaaugcucuugauaaccuggccgugcuccauacugcagaggcuggaggucgggccuauaaucacgcauugagcgaacugcccgagacgcuagagacccugcuccuucugacauuauuggccacuguuaccggcgggauauuccuguuucucaugucgggaaagggcaucgguaaaaugacacuggggaugugcugcauuaucaccgcuucuauucuucugugguacgcgcaaauccagccacauuggauagccgcauccauuauccucgaguucuuuuugaucguccuguuaauuccugagcccgaaaagcagcgaacuccacaggacaaccaacuaacguauguggugaucgcuauacugaccgucguugccgccacaauggcaaaugagaugggcuuccucgagaaaacuaagaaggauuuuggacuuggcagcauugcuacccagcagccugagucaaacauccuggacauugacuugagacccgccagugcguggacacuguacgcuguggccaccacuuucaucacaccgaugcuccgccacucuauagaaaauuccagcguaaacgugucacugacggcaaucgccaaucaggcuaccguccuuauggggcucggaaaagguuggccacugaguaagauggauauuggcgugccuuugcuggcaaucggguguuacagccaaguuaaccccauuacuuuaacagccgcgcuacugcuccuuguggcucacuaugccaucauuggaccaggccugcaggcaaaagccaccagggaagcucagaagcgggccgcagcugguaucaugaaaaaucccaccgucgacgggauaacaguaauugauuuggacccuaucccguacgaucccaaguuugagaagcagcugggccaagugaugcuccugguucuuugcgugacucaggucuuaaugaugcguacgaccugggcccugugugaagcgcucacauuggccacuggaccaaucuccacccugugggagggcaacccugggagauucuggaauacaaccauugcagugucuauggcuaacauauuuaggggaagcuaucuagccggcgcaggucuacucuucuccaucaugaaaaacacuacgaauacacgccgggggaccggaaacacuggcgaaacccuuggugagaaguggaaaaaucgacugaacucauugggcaagucugaguuucagauuuacaaaagaagugggauccaagaagucgacaggacacuggcuaaggagggaauuaaacgcggcgaaacugaucaucacgccgugucgcgggggagcgccaagcucagaugguucguugagcguaaucuggugacccccgagggaaagguaguggacuuaggcugcgguaggggagggugguccuauuacuguggcggucuuaaaaacguccgggaaguuaagggccugacaaaagggggaccuggccaugaggaaccaauccccaugucuacguauggguggaaucucgugcgccuacagucaggagucgauguguucuuuaccccuccagagaagugcgacacucuguugugugauauaggcgaaagcucccccaacccgacaguagaggcgggucgaacccugagagugcucaaucuuguugagaacuggcugaauaacaauacucaguucugcaucaaaguguugaacccuuacaugccaagugucauugaaaagauggagacacugcagaggaaguacgggggagcucucgugcggaaucccuuaucucgcaacagcacccacgaaauguauugggucucaaacgcauccggcaauaucgugaguagcguuaacaugauuucuagaaugcugaucaauagguuuacgaugcgacauaaaaaggccaccuacgagccugacguagaucuuggcuccgggacacggaacauaggaauugaaucagagacuccaaaucuggacaucaucgguaaacguauugagaagauaaaacaagaacacgagaccagcuggcacuaugaccaggaucaucccuacaagacaugggcuuaucacggcucguacgaaacuaagcagaccgggucugccaguuccauggugaacggagucgugagacuacucacaaaaccgugggacguuaucccuauggugacccagauggcaaugacugauacgacacccuucggccaacagcgcgucuuuaaggagaaaguggacaccaggacucaggaaccaaaggaggguaccaaaaagcugaugaagauuacagccgagugguuguggaaagaacuggggaagaaaaagacgccucggauguguaccagagaggaguucgcucgcaaaguaaggagcaaugcggcccucggagcaaucuuuacugaugagaacaaguggaaaucagcucgagaggccguggaagacucccgguucugggagcuuguugauaaggaaagaaaucugcauuuagagggcaagugcgaaacaugugucuauaacaugaugggcaaaagggagaagaaaauuggggaguuuggaaaggcaaaagguucucgcgccaucugguacauguggcugggcgcucguuucuuggaauuugaggcccucggguuccugaaugaagaccacugguuuagccgggagaacagucuauccggaguggaaggcgagggucuucacaagcugggguacauacucagagaggugagcaagaaagaaggaggcgcgauguaugcagaugacaccgccggcugggauacuaggaucacacuggaggacuugaagaaugaagagauggucaccaaccauauggaaggggagcacaaaaagcuggcugaggccauuuucaaacucacauaccagaauaagguugugcgcguacaacgacccacuccacggggaaccgugauggacaucauuucuagaagggaucagcgcgguucaggccaggucgggacguauggacuuaacaccuucacaaacaugggcgcacaacugaucagacagauggaaggugaggggguguuuaagggcauucagcauuuaacugcuaccgaagagguugccgugcaggacuggcuggcucgggucggcagggagcguuugagucgaauggccauauccggcgaugacugcgugguaaaaccccucgaugaccgcuucgcaagcgcgcugacagcccuaaaugauauggggaagguuagaaaagacauccaacagugggaaccuucucggggauggaacgauuggacucaggugccauuuugcucgcaccauuuccacgagcuuauuaugaaggacgguaggguccugguggugccgugucgcaaucaggaugaacucaucggcagagcucggaucucacaaggggccggauggagccugagggagaccgcaugcuugggcaaauccuacgcucagauguggaguuuaauguauuuucaccgacgugaccugagacucgccgcaaacgccauuuguucugcgguccccagccauuggguuccuacgucccgcacaaccuggucaauacacgcucggcaugaauggaugacuacagaggauaugcuuaccguguggaauaggguauggauccaggagaacccauggauggaagacaagacucugguggagaguugggaagagauucccuaccuagguaagagagaagaccaguggugcgggucucugaucggacucaccagccgcgccacaugggcacggaauauucaaacggccaucaaccaggucagguccuugauaggcucagaggaguauaccgauuacaugccuagcaugaaacgauucagacgggaagaggaagaggcuggcgugcugugguga

SEQ ID NO: 14306 - RNA, 9876 nt, Artificial Sequence
  derived and/or modified CDS sequence (opt3) from DENV-2__KF041234__SS-prME
accgcaggagugaucauuaugcugauacccacugcuauggcauuccaccucacuacgagaaauggggaaccucauaugaucgucagcaagcaggaaaaaggaaagucccuucuguuuaaaaccgaagacgguguuaauaugugcacauugauggccauggauuuaggcgaacugugugaagacacuauuaccuacaacugcccacugcucaggcaaaaugaaccggaagauaucgacuguuggugcaacgcgacaucuaccugggugacuuaugggacauguaccgcuacgggagaacaccggcgcgaaaagcgaucaguagcccuggugccccaugucggcaugggucuugagacucguaccgaaacauggaugaguagcgagggggcauggaaacacgcccagagaauugagacuuggauccugaggcauccuggauucaccauaauggcugcaaucuuggccuacacaauuggcaccacguauuuucagcgggugcucaucuucauucugcugacugcuguugccccauccaugacaaugcgcugcaucggcauaucuaauagagauuuuguggaaggggucucgggagguucauggguggacauuguacucgagcacggcagcuguguuaccacuauggcgaagaacaagcccacauuagauuucgaacugaucaaaaccgaggcaaagcagccugccacgcuuaggaaauacugcauugaagcuaaguugaccaauacaacuaccgccagucgguguccaacacaaggggagcccucccugaacgaggaacaggacaaacgcuuugugugcaagcacucuauggucgaucgaggauggggcaaugguugugggcuauucggaaagggcggcaucgugacuugcgcaauguuuaccugcaaaaagaacauggaggggaaaaucgugcagccugaaaaucucgaguauacaauugucguuaccccacauagcggagaagagaacgcuguggguaaugacacuggcaagcacgggaaagagauaaagguaacgccgcaguccucaaucacagaagccgagcugaccggauacggcacugugaccauggaauguagucccagaacaggucuugauuucaacgagaugguccuguugcaaauggaaaauaaagcguggcucgugcauaggcagugguuucuggacuuaccucugccauggcuccccggggccgauauucagggcagcaacuggauccagaaggagacccuuguuacuuucaagaacccucacgccaagaagcaagacguggucgugcugggaucucaggagggcgcuaugcacacagccuugacgggggcuaccgaaauacagauguccucaggaaaucuacuguuuacuggucaucucaaaugccggcugcguauggacaaacuucaacugaaaggcaugagcuauaguauguguacagggaaguucaagguaauuaaagagaucgccgaaacccagcacggaacaaucguugugcgcguccaguacgagggcgaugguucuccaugcaagauucccuucgagaucauggacuuggagaagagacaugugcucgggaggcugauuacugucaacccgauagugaccgagaaggauuccccuguuaauaucgaagcagagcccccauuuggcgacagcuacauuaucaucggaguggaaccuggccaguuaaaacugucgugguucaagaaggggucuuccauuggacaaauguuugagacgaccaugcggggugccaaacgaauggcuauacuaggcgauacagcgugggacuucgggucacucggaggcguauuuacaaguaucgguaaggcacugcaccaggucuucggggccauuuauggcgcugccuuuagcggaguguccuggaccaugaaaauccuuauuggcguugugaucacauggauagggaugaacucucgcagcacuucauugagugucucccuggugcucguaggagugguuacccuguaccuuggcgucauggugcaggcagauagcgguuguguggucucuuggaagaauaaagagcugaagugcgggucaggaaucuucauuacggacaacguucauacauggaccgaacaguauaaguuucaacccgagaguccaagcaaauuggccuccgcuauccagaaggcccacgaagagggcauuugugguaucagaucugugacuaggcucgaaaaucugauguggaaacagauaacacccgaguuaaaccacauucugucggagaaugaagugaagcuaagcaucaugaccggcgauauuaaagggaucaugcaggcaggaaagcggucccuccgcccucaaccaacugagcugaaauacucauggaagaccuggggcaaggcgaaaaugcuuaguacagaaccgcauaaccagacguucuugauagacgggcccgagaccgcugaaugcccuaauacuaacagagccuggaacucucuggagguagaggauuauggauuuggcgucuucacaaccaacaucuggcucaagcugaaagaaaggcaggacguguuuugugacagcaaguuaauguccgcagccauuaaagauaaucgugcuguucacgccgacauggguuacuggaucgagucagcacugaacgauacauggaagauugaaaaggcuagcuucaucgaggugaaaucuugccauuggccaaagucccacacucuuuggaguaacggggucuuggagagcgaaaugauaauucccaaaaauuucgccggaccugugucucagcacaacuaucggccaggcuaccauacccaaacggcgggucccuggcaccucggcaagcuggagauggacuuugauuucugugaagggacaaccguugugguaacugaggacugcggaaaucgaggcccgucccuaagaaccacaacugccucagggaaacugaucaccgaauggugcuguaggaguugcacacucccuccacugcgcuaccggggagaggauggcuguugguaugguauggagaucagaccccuuaaggaaaaggaggaaaacuuggucaauagccuggugacggcugggcauggacagauugacaacuuuucguuaggcgugcucgguauggcacuguuccuugaggaaaugcugaggacccgcgucggcacuaaacacgccguuuugcucguggcuguauccuuuaugacacugaucaccgggaauaugucuuuccgagaucuaggacgggugauggucauggugggcgccgcaaugacugacgauauugggaugggaguuacauaccuggcgcuccuggccgcuuuuaaggugcguccuaccuucgccgcaggccuuuugcugagaaaauuaacgagcaaggagcucaugaugacuaccauagguaucguccugcuuucacagaguacaacccccgagacuauucuggaacuaacagacgcucucgcccuggggaugaugaucuugaaaauugugaggaacauggagaaguaucaacuggcaguuaccaucauggccauauuaugcgugccaaaugcugucauccuccagaacgcguggaagguauccuguacaauucuggccgcagugucuguuagcccucuucuguugacuuccucacagcagaaagcugauuggaucccccucgcccugaccauuaagggacuaaauccaacggccaucuuucugacaacccuuagccgcacuaacaaaaagcggaguuggccgcucaaugaagcuauaauggcagugggcauggucucuauucuggccuccagcuugcugaaaaacgacaucccuaugaccggccccuuaguggcugggggacuccugacaguaugcuacgugcuuacugguagaucggcggaccuggaguuggaaagggccgcagauguccgaugggaggaccaagccgagaucucaggcucuaguccaauucucuccauaaccaucagcgaagaugggucuaugagcauuaagaaugaggaagaggagcagacgcugacaauccuaauucgcaccggacugcuuguuaucuccggccucuuccccgugucaauaccuaucacugcugcagccugguaucugugggaagugaaaaagcagcgggcgggugucuugugggacgugccaagucccccuccgguugggaaggcugaguuagaagauggagccuacagaauuaaacagaagggcauccugggcuauagccaaauuggggcaggaguauacaaagaggguacauuucauaccauguggcacgugacuaggggcgccguccucaugcacaaggggaaacguaucgaaccaucuugggcugacgugcgcaaggaucugauauccuacggaggcgguuggaaacuugagggggaguggaaagaaggagaggaaguucaggugcuggccuuggagcccggcaagaacccucgggcaguccagacaaaaccaggccuauucaagaccaacacggggacuauuggagcugugucacuggacuuuagucccgguaccagcggcuccccuaucguagauaaaaaggggaaggucgugggacucuauggcaaugguguugugacaagaucugggaccuacgucucggccaucgcgcagacagagaaaagcauugaggacaacccggagaucgaagaugacauauucaggaagaaacgacugacuauuauggaucuucaucccggagccggcaagaccaaacgguauuuaccagcaaucgugcgcgaggcuauuaagagaggccugaggacgcucaucuuggccccuacacggguuguggcugcagaaauggaggaagcccugcgagggcuccccauaagauaccaaacuccagccauucgcgcugagcacaccggaagggagaucgucgaccugaugugucaugcgacauucaccaugcgucuucugucaccugugcggguacccaauuauaacuugaucauuauggacgaagcacacuuuacugauccagccuccaucgcugccagagguuacauuaguaccaggguggagaugggcgaagcagccgggauauucaugacagcuacgccgccuggaucucgcgaccccuuuccacagagcaaugcgcccaucauggaugaggagcgagaaauuccugagagauccuggaacucaggccaugaauggguuacugacuucaaggguaaaaccgucugguuugugccaucuaucaaggccgggaaugauaucgcagcuugccuacggaaaaacggaaagaaagugauucagcugagcaggaagacauucgacagugaguauauaaagacccgcacuaaugauugggacuuugucguaacaaccgauaucuccgaaaugggcgccaacuucaaagcagagcgugugauugaccccagacgguguaugaagccuguuauccucacggauggcgaggaaagggugauuuuagccgggccgaugccagucacucacagcucugcugcccaacgccgaggaagaaucggucggaaucccaaaaacgagaaugaccaguacauauacaugggcgaaccucuggagaacgacgaagauugcgcgcacuggaaggaggcaaaaaugcuucuggacaauaucaacacacccgaggggauuaucccaucaauguuugaaccugagagggaaaagguggaugccauugacggagaguaucgccucagaggcgaagcuaggaaaaccuucguugauuugaugcggcguggugaccugcccguguggcucgccuaccgcgucgcugcagaggggaucaacuaugccgaucgaagaugguguuuugacggcauaaagaauaaccagauucuggaggaaaauguggagguagaaaucuggaccaaggagggagagaggaagaaacuuaaaccacgguggcuagaugcucgcauuuacuccgacccucuggccuugaaggaguucaaagaguucgcagcgggcagaaagaguuuaacucugaaccucaucacagaaauggggaggcugccgaccuuuaugacacagaaggcccggaaugcucuugauaaccuggccgugcuccauacugcagaggcuggaggucgagccuauaaucacgcauugagcgaacugcccgagacgcuagagacccugcuccuucugacauuauuggccacuguuaccggcgggauauuccuguuucucaugucgggaaaaggcaucgguaagaugacacuggggaugugcugcauuaucaccgcuucuauucuucugugguacgcgcaaauccagccacauuggauagccgcauccauuauccucgaguucuuuuugaucguccuguuaauuccugagcccgaaaaacagagaacuccacaggacaaccaacuaacguauguggugaucgcuauacugaccgucguugccgccacaauggcaaaugagaugggcuuccucgaaaagacuaaaaaggauuuuggacuuggcagcauugcuacccagcagccugagucaaacauccuggacauugacuugcgccccgccagugcguggacacuguacgcuguggccaccacuuucaucacaccgaugcucaggcacucuauagaaaauuccagcguaaacgugucacugacggcaaucgccaaucaggcuaccguccuuauggggcucggaaaggguuggccacugaguaaaauggauauuggcgugccuuugcuggcaaucggguguuacagccaaguuaaccccauuacuuuaacagccgcgcuacugcuccuuguggcucacuaugccaucauuggaccaggccugcaggcaaaggccacccgggaagcucagaaacgugccgcagcugguaucaugaagaaucccaccgucgacgggauaacaguaauugauuuggacccuaucccguacgaucccaaauuugagaagcagcugggccaagugaugcuccugguucuuugcgugacucaggucuuaaugaugagaacgaccugggcccugugugaagcgcucacauuggccacuggaccaaucuccacccugugggagggcaacccugggagguucuggaauacaaccauugcagugucuauggcuaacauauuucgcggaagcuaucuagccggcgcaggucuacucuucuccaucaugaagaacacuacgaauacacggcgagggaccggaaacacuggcgaaacccuuggugagaaauggaagaauagacugaacucauugggcaaaucugaguuucagauuuacaagaggagugggauccaagaagucgaccgcacacuggcuaaagagggaauuaagcggggcgaaacugaucaucacgccgugucgagagggagcgccaaacuccguugguucguugagaggaaucuggugacccccgagggaaagguaguggacuuaggcugcggucgcgggggaugguccuauuacuguggcggucuuaagaacguccgggaaguuaaaggccugacaaaagggggaccuggccaugaggaaccaauccccaugucuacguauggguggaaucucgugcgacuacagucaggagucgauguguucuuuaccccuccagagaaaugcgacacucuguugugugauauaggcgaaagcucccccaacccgacaguagaggcggguagaacccugagggugcucaaucuuguugagaacuggcugaauaacaauacucaguucugcaucaagguguugaacccuuacaugccaagugucauugagaagauggagacacugcagcggaaguacgggggagcucucgugcgcaaucccuuaucuagaaacagcacccacgaaauguauugggucucaaacgcauccggcaauaucgugaguagcguuaacaugauuucuaggaugcugaucaaucgauuuacgaugcggcauaagaaagccaccuacgagccugacguagaucuuggcuccgggacacguaacauaggaauugaaucagagacuccaaaucuggacaucaucgguaagagaauugagaaaauaaagcaagaacacgagaccagcuggcacuaugaccaggaucaucccuacaaaacaugggcuuaucacggcucguacgaaacuaagcagaccgggucugccaguuccauggugaacggagucgugcgccuacucacaaagccgugggacguuaucccuauggugacccagauggcaaugacugauacgacacccuucggccaacagagggucuuuaaagagaagguggacacccggacucaggaaccaaaagaggguaccaagaaacugaugaagauuacagccgagugguuguggaaggaacuggggaaaaagaaaacgccuagaauguguacccgcgaggaguucgcuaggaagguacgaagcaaugcggcccucggagcaaucuuuacugaugagaacaaauggaagucagcucgggaggccguggaagacuccagauucugggagcuuguugauaaagaaagggaccugcauuuagagggcaagugcgaaacaugugucuauaauaugaugggcaagcgcgagaaaaagauuggggaguuuggaaaagcaaaggguucucgugccaucugguacauguggcugggcgcucgguucuuggaauuugaggcccucggguuccugaacgaagaucacugguuuagcagagagaauagucuauccggaguggaaggcgagggucuucacaaacugggguacauacucagggaggugagcaagaaggaaggaggcgcgauguaugcagacgauaccgccggcugggacacucgcaucacacuggaggacuugaaaaacgaagagauggucaccaaucauauggaaggggagcacaagaaacuggcugaggccauuuucaagcucacauaccagaacaaaguugugcgaguacaacggcccacuccaagaggaaccgugauggauaucauuucuaggcgcgaccagagagguucaggccaggucgggacguauggacuuaauaccuucacaaacaugggcgcacaacugauccggcagauggaaggugaggggguguuuaagggcauucagcauuuaacugcuaccgaagagguugccgugcaggauuggcuggcuagggucggccgugagcgauugagucgcauggccauauccggcgacgauugcgugguaaagccccucgacgauagauucgcaaacgcgcugacagcccuaaaugacauggggaaaguucggaaggauauccaacagugggaaccuagcaggggauggucugacuggacucaggugccauuuugcucgcaccauuuccacgagcuuauuaugaaagauggucgcguccugguggugccguguagaaaccaggacgaacucaucggccgggcuaggaucucacaaggggccggauggagccugcgagagaccgcaugcuugggcaaguccuacgcucagauguggaguuuaauguauuuucaccguagagaucugcgccucgccgcaaaugccauuuguucugcgguccccagccauuggguuccuacgucccggacaaccuggucaauacacgcuaggcaugaauggaugacuacagaggacaugcuuaccguguggaacagaguauggauccaggagaauccauggauggaagacaaaacucccguggagaguugggaagagauuccuuaccuggguaagcgcgaagaucaguggugcgggucucuaaucggacugaccagccgggccacaugggcaaggaacauucaaacggccaucaaucagguccgaucccucauaggcucagaggaguauaccgacuacaugccaagcaugaagagauuccggagggaagaggaagaggcuggcguguugugguga

SEQ ID NO: 14307 - RNA, 9876 nt, Artificial Sequence
  derived and/or modified CDS sequence (opt3) from DENV-2__KF041235__SS-prME
accgccggcgugaucauuaugcugauacccacugcuauggcauuccaccucacuacgcggaacggggaaccucauaugaucgucagcaagcaggaaaagggaaagucccuucuguuuaagaccgaagacgguguuaauaugugcacauugauggccauggauuuaggcgaacugugugaagacacuauuaccuacaacugcccacugcucaggcaaaaugaaccggaagauaucgacuguuggugcaacucuacaucaaccugggugacuuaugggacauguaccgcgacgggagaacaccggcgcgaaaagcgaaguguugcucuggugccccaugucggcaugggucuugagacucguaccgaaacauggaugagcuccgagggggccuggaaacacgcacagagaauugagacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagauuuuguggaaggggucucaggagguagcuggguggacauugugcucgagcacggcaguuguguuaccacuauggccaagaacaagcccacauuagauuucgaacugaucaaaaccgaggcgaagcagccugcaacgcuuaggaaauacugcauugaagccaaguugaccaauacaacuaccgcuucccgguguccaacacaaggggagcccucucugaacgaggaacaggacaaacgcuuugugugcaagcacagcauggucgaucgaggauggggcaaugguugugggcuauucggaaagggcggcaucgugacuugcgccauguuuaccugcaaaaagaacauggaggggaaaaucgugcagccugaaaaucucgaguauacaauugucguuaccccacauuccggagaagagaacgcaguggguaaugacacuggcaagcacgggaaagagauaaagguaacgccgcagucaaguaucacagaagcugagcugaccggauacggcacugugaccauggaauguagccccagaacaggucuugauuucaacgagaugguccuguugcaaauggaaaauaaagccuggcucgugcauaggcagugguuucuggacuuaccucugccauggcuccccggggcggauauucagggcucuaacuggauccagaaggagacccuuguuacuuucaagaacccucacgccaaaaagcaagacguggucgugcugggaucccaggagggcgcaaugcacacagcuuugacgggggccaccgaaauacagaugucaagcggaaaucuacuguuuacuggucaucucaaaugccggcugcguauggacaaacuucaacugaaaggcaugaguuauucuauguguacagggaaguucaagguaguuaaagagauugcugaaacccagcacggaacaaucgugguccgcgugcaguacgagggcgaugguuccccaugcaagauccccuucgagauuauggacuuggagaagagacauguccucgggaggcugaucacugugaacccgauuguuaccgagaaggauagcccugugaauauagaagccgagcccccauuuggcgacucguacaucauuaucggaguagaaccuggccaguuaaaacugucuugguucaagaagggguccucaaucggacaaauguuugagacgaccaugcggggugcaaaacgaauggccauucuaggcgauacagcuugggacuucgggagucucggaggcgucuuuacuagcauagguaaggcgcugcaccagguguucggggcaaucuauggcgccgcuuuuuccggaguuucuuggaccaugaaaauucuuaucggcguggucauuacauggaucgggaugaacagccgcucaaccagcuuguccgugagccugguacucgugggaguugucacacuguaccuuggcgugauggugcaggccgauucugguugugucguuucauggaagaauaaagagcugaagugcgggaguggaauauucaucacggacaacgugcauacauggaccgaacaguauaaguuucaacccgagagcccauccaaauuggcaucugccauucagaaggcucacgaagagggcaucugugguauuagaucggugacuaggcucgaaaaucugauguggaaacagaucacacccgaguuaaaccacauacugagcgagaaugaaguaaagcuauccauuaugaccggcgauaucaaagggauuaugcaggccggaaagcggucacuccgcccucaaccaacugagcugaaauacaguuggaagaccuggggcaaggcaaaaaugcuuucuacagaaccgcauaaccagacguucuugaucgacgggcccgagaccgcggaaugcccuaauacuaacagagcuuggaauagccuggaggucgaggauuauggauuuggcguguucacaaccaacauauggcucaagcugaaagaaaggcaggacguauuuugugacuccaaguuaaugucagccgcaaucaaagauaaucgugccgugcacgcugacauggguuacuggauugagagcgcccugaacgauacauggaagaucgaaaaggcaucuuucauugaggucaaauccugccauuggccaaagagucacacucuuuggagcaacgggguguuggagucugaaaugaucauacccaaaaauuucgcuggaccuguuucccagcacaacuaucggccaggcuaccauacccaaacggccggucccuggcaccucggcaagcuggagauggacuuugauuucugugaagggacaaccgugguagucacugaggacugcggaaaucgaggcccgucacuaagaaccacaacugcgagugggaaacugauuaccgaauggugcuguaggagcugcacacucccuccacugcgcuaccggggagaggauggcuguugguaugguauggagaucagaccccuuaaggaaaaggaggaaaacuugguaaauucgcuggugacggccgggcauggacagaucgacaacuuuuccuuaggcguccucgguauggcucuguuccuugaggaaaugcugaggacccgcguuggcacuaaacacgcaguguugcucguagccgugucuuuuaugacacugauuaccgggaauaugagcuuccgagaucuaggacgggucauggugaugguuggcgcugccaugacugacgauaucgggaugggagugacauaccuggcacuccuggcggccuuuaagguccguccuaccuucgcugccggccuuuugcugagaaaauuaacgucaaaggagcucaugaugacuaccauugguauagugcugcuuagucaguccacaacccccgagacuauccuggaacuaacagacgcacucgcucuggggaugaugauuuugaaaaucguuaggaacauggagaaguaucaacuggccgugaccauuauggcaaucuuaugcgucccaaaugccguaauacuccagaacgcuuggaaggugucuuguacaauccuggcggccguuagcguguccccucuucuguugacuucaagccagcagaaagcagauuggauuccccucgcucugaccaucaagggacuaaauccaacggccauuuuucugacaacccuuagucgcacuaacaaaaagcggucuuggccgcucaaugaagccaucauggcugucggcaugguguccauacuggcaagcucguugcugaaaaacgacauuccuaugaccggccccuuaguagccgggggacuccugacagugugcuacguccuuacugguagaucagcggaccuggaguuggaaagggcugccgauguucgaugggaggaccaagcagagaucucuggcaguuccccaauccucagcauuaccauaucugaagaugggagcauguccaucaagaaugaggaagaggagcagacgcugacaauucuaauccgcaccggacugcuugugauuucaggccucuuccccgugaguaucccuauaacugccgcugcaugguaucugugggaagucaaaaagcagcgggccgguguguugugggacguuccaagucccccuccgguagggaaggcggaguuagaagauggagcuuacagaaucaaacagaagggcauucugggcuauucucaaaucggggccggaguguacaaagaggguacauuucauaccauguggcacgucacuaggggcgcagugcucaugcacaaggggaaacguauugaaccauccugggccgacguucgcaaggaucugaucucauacggaggcgguuggaaacuugagggggaguggaaagaaggagaggaagugcagguccuggcuuuggagcccggcaagaacccucgggccgugcagacaaaaccaggccuauucaagaccaacacggggacuauaggagcaguaagucuggacuuuagccccgguaccuccggcucuccuauugucgauaaaaaggggaaggugguuggacucuauggcaaugguguggucacaagaucggggaccuacgugagcgcuaucgcccagacagaaaaaucaaucgaggacaacccggagauugaagaugacaucuucaggaagaaacgacugacuauaauggaucuucaucccggagcgggcaagaccaaacgguauuuaccagccauuguucgcgaggcaaucaagagaggccugaggacgcucauuuuggcuccuacacggguggucgccgcugaaauggaggaagcacugcgagggcuccccaucagauaccaaacuccagccauacgcgccgagcacaccggaagggagauuguggaccugaugugucaugcuacauucaccaugcgucuucuguccccuguacgggugcccaauuauaacuugaucaucauggacgaagcgcacuuuacugauccagcaaguauugccgcuagagguuacaucucuaccaggguugagaugggcgaagccgcagggauuuucaugacagccacgccgccuggaagccgcgaccccuuuccacaguccaaugcucccauaauggaugaggagcgagaaaucccugagagaucauggaacucuggccaugaaugggucacugacuucaaggguaaaaccgugugguuugugccaagcauuaaggcggggaaugauaucgccgcaugccuacggaaaaacggaaagaaagucauccagcugaguaggaagacauucgacuccgaguauauuaagacccgcacuaaugauugggacuuuguagugacaaccgauauaagcgaaaugggcgcuaacuucaaagccgagcguguuaucgaccccagacgguguaugaagccugugauucucacggauggcgaggaaagggucaucuuagcagggccgaugccagugacucacucuucagccgcucaacgccgaggaagaauuggucggaaucccaaaaacgagaaugaccaguacaucuacaugggcgaaccucuggagaacgacgaagauugcgcccacuggaaggaggcgaaaaugcuucuggacaauauaaacacacccgaggggaucauuccauccauguuugaaccugagagggaaaagguugaugcaaucgacggagaguaucgccucagaggcgaagccaggaaaaccuucguggauuugaugcggcguggugaccugcccgucuggcucgcuuaccgcguggccgcugaggggauuaacuaugcagaucgaagaugguguuuugacggcaucaagaauaaccagauacuggaggaaaauguagagguggaaauuuggaccaaggagggagagaggaagaaacuuaaaccacgguggcuagaugcccgcaucuacagugacccucuggcuuugaaagaguucaaagaguucgccgcaggcagaaagagcuuaacucugaaccucauuacagaaauggggaggcugccgaccuuuaugacacagaaggcgcggaaugcccuugauaaccuggcuguucuccauacugccgaggcaggaggucgagcuuauaaucacgccuugucggaacugcccgagacgcuagagacccugcuccuucugacauuauuggcaacugucaccggcgggaucuuccuguuucucaugucuggaaaaggcauagguaagaugacacuggggaugugcugcaucauuaccgccuccauccuucugugguacgcucaaauucagccacauuggaucgcggccagcauaauucucgaguucuuuuugaucgugcuguuaaucccugagcccgaaaaacagagaacuccacaggacaaccaacuaacguauguggucauugcaauccugaccguuguggcugccacaauggccaaugagaugggcuuccucgaaaagacuaaaaaggauuuuggacuuggcucaauagcaacccagcagccugagaguaacauucuggacaucgacuugcgccccgcuucugccuggacacuguacgcgguagcuaccacuuucauuacaccgaugcucaggcacuccaucgagaauagcucagugaacgucagucugacggccauagcaaaucaggccaccgugcuuauggggcucggaaaggguuggccacugagcaaaauggauaucggcguuccuuugcuggcuauuggguguuacucccaagugaaccccaucacuuuaacagcagcccuacugcuccuugucgcgcacuaugcuauuaucggaccaggccugcaggccaaggcaacccgggaagcccagaaacgugcugccgcagguauuaugaagaaucccaccguagacgggaucacagugauagauuuggacccuauuccguacgaucccaaauuugagaagcagcugggccaaguuaugcuccuggugcuuugcgucacucagguguuaaugaugagaacgaccugggcucugugugaagcccucacauuggcgacuggaccaaucucuacccugugggagggcaacccugggagguucuggaauacaaccaucgccgucagcauggcaaacauuuuucgcggauccuaucuagcuggcgccggucuacucuucucaauaaugaagaacacuacgaauacacggcgagggaccggaaacacuggcgaaacccuuggugagaaauggaagaauagacugaacucuuugggcaaaagugaguuucagaucuacaagaggucggggauucaagaaguggaccgcacacuggcaaaagagggaaucaagcggggcgaaacugaucaucacgcuguuagcagaggguccgccaaacuccguugguucguggagaggaaucugguaacccccgagggaaagguggucgacuuaggcugcgguagagggggauggucuuauuacuguggcggucuuaagaacguucgcgaagugaaaggccugacaaaagggggaccuggccaugaggaaccaauucccaugucaacguauggguggaaucucguccgacuacagagcggaguggauguauucuuuaccccuccagagaaaugcgacacucuguugugugauaucggcgaauccagucccaacccgacaguggaggccgguagaacccugaggguucucaaucuuguggagaacuggcugaauaacaauacucaguucugcauaaaggucuugaacccuuacaugccaucugugaucgagaagauggagacacugcagcggaaguacgggggagcgcucguccgcaaucccuuaagcagaaacucaacccacgaaauguauuggguguccaacgcuaguggcaauauuguuagcucuguaaacaugaucuccaggaugcugauuaaucgauuuacgaugcggcauaagaaagcaaccuacgagccugacguggaucuuggcucagggacacguaacaucggaauagaaagcgagacuccaaaucuggacauuaucgguaagagaaucgagaaaauuaagcaagaacacgagaccucguggcacuaugaccaggaucaucccuacaaaacaugggccuaucacggcucuuacgaaacuaagcagaccgggagugcuuccagcauggucaacggagugguucgccuacucacaaagccgugggacgugauaccuauggucacccagauggccaugacugauacgacacccuucggccaacagaggguguuuaaagagaagguagacacccggacucaggaaccaaaagaggguaccaagaaacugaugaagaucacagcagagugguuguggaaggaacuggggaaaaagaaaacgccuagaauguguacccgcgaggaguucgccaggaaggugcgaucaaaugcugcgcucggagccauuuuuacugaugagaacaaauggaaguccgcacgggaggcuguugaagacucuagauucugggagcuugucgauaaagaaaggaaucugcauuuagagggcaagugcgaaacauguguguauaacaugaugggcaagcgcgagaaaaagaucggggaguuuggaaaagccaaggguagccgugcaauuugguacauguggcugggcgcccgguucuuggaauuugaggcucucggguuccugaaugaagaccacugguuuaguagagagaacucccuaagcggaguggaaggcgagggucuucacaaacugggguacauccucagggaggucucuaagaaggaaggaggcgccauguaugcggaugacaccgcaggcugggauacucgcauaacacuggaggacuugaaaaaugaagagaugguuaccaaccauauggaaggggagcacaagaaacuggccgaggcuaucuucaagcucacauaccagaauaaagugguacgagugcaacggcccacuccaagaggaaccgucauggacauuaucucaaggcgcgaucagagagguaguggccagguggggacguauggacuuaacaccuucacaaacaugggcgcccaacugauucggcagauggaaggugaggggguuuuuaagggaauccagcauuuaacugcaaccgaagagguggcuguccaggacuggcuggccagggugggccgugagcgauugucccgcauggcuauuagcggcgaugacugcguaguuaagccccucgaugacagauucgccucugcacugacagcgcuaaaugauauggggaaagugcggaaggacauacaacagugggaaccuucgaggggauggaacgauuggacucaggucccauuuugcucacaccauuuccacgagcuuaucaugaaagacggucgcgugcugguggucccguguagaaaucaggaugaacucauuggccgggccaggaucagccaaggggcuggauggucccugcgagagaccgccugcuugggcaagaguuacgcacagauguggucuuuaauguauuuucaccguagagaccugcgccucgcugccaacgcaaucuguagcgccguucccucccauugggugccuacgucacggacaaccuggaguauucacgcgaggcaugaauggaugacuacagaggauaugcuuaccguauggaauagaguguggauacaggagaacccauggauggaagacaaaacucccgucgagucuugggaagagaucccuuaccuggguaagcgcgaagaccaguggugcgggagccuaauuggacugaccucccgggcuacaugggccaggaauauccaaacggcaauuaaccaggugcgaucacucaucggcagcgaggaguauaccgauuacaugccaucuaugaagagauuccggagggaagaggaagaggccggcguuuugugguga

SEQ ID NO: 14308 - RNA, 9876 nt, Artificial Sequence
  derived and/or modified CDS sequence (opt3) from DENV-2__KF041237__SS-prME
accgccggcgugaucauuaugcugauacccacugcuauggcauuccaccucacuacgcggaacggggaaccucauaugaucgucagcaagcaggaaaagggaaagucccuucuguuuaagaccgaagacgguguuaauaugugcacauugauggccauggauuuaggcgaacugugugaagacacuauuaccuacaacugcccacugcucaggcaaaaugaaccggaagauaucgacuguuggugcaacucuacaucaaccugggugacuuaugggacauguaccgcgacgggagaacaccggcgcgaaaagcgaaguguugcucuggugccccaugucggcaugggucuugagacucguaccgaaacauggaugagcuccgagggggccuggaaacacgcacagagaauugagacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagauuuuguggaaggggucucaggagguagcuggguggacauugugcucgagcacggcaguuguguuaccacuauggccaagaacaagcccacauuagauuucgaacugaucaaaaccgaggcgaagcagccugcaacgcuuaggaaauacugcauugaagccaaguugaccaauacaacuaccgcuucccgguguccaacacaaggggagcccucucugaacgaggaacaggacaaacgcuuugugugcaagcacagcauggucgaucgaggauggggcaaugguugugggcuauucggaaagggcggcaucgugacuugcgccauguuuaccugcaaaaagaacauggaggggaaaaucgugcagccugaaaaucucgaguauacaauugucguuaccccacauuccggagaagagaacgcaguggguaaugacacuggcaagcacgggaaagagauaaagguaacgccgcagucaaguaucacagaagcugagcugaccggauacggcacugugaccauggaauguagccccagaacaggucuugauuucaacgagaugguccuguugcaaauggaaaauaaagccuggcucgugcauaggcagugguuucuggacuuaccucugccauggcuccccggggcggauauucagggcucuaacuggauccagaaggagacccuuguuacuuucaagaacccucacgccaaaaagcaagacguggucgugcugggaucccaggagggcgcaaugcacacagcuuugacgggggccaccgaaauacagaugucaagcggaaaucuacuguuuacuggucaucucaaaugccggcugcguauggacaaacuucaacugaaaggcaugaguuauucuauguguacagggaaguucaagguaguuaaagagauugcugaaacccagcacggaacaaucgugguccgcgugcaguacgagggcgaugguuccccaugcaagauccccuucgagauuauggacuuggagaagagacauguccucgggaggcugaucacugugaacccgauuguuaccgagaaggauagcccugugaauauagaagccgagcccccauuuggcgacucguacaucauuaucggaguagaaccuggccaguuaaaacugucuugguucaagaagggguccucaaucggacaaauguuugagacgaccaugcggggugcaaaacgaauggccauucuaggcgauacagcuugggacuucgggagucucggaggcgucuuuacuagcauagguaaggcgcugcaccagguguucggggcaaucuauggcgccgcuuuuuccggaguuucuuggaccaugaaaauucuuaucggcguggucauuacauggaucgggaugaacagccgcucaaccagcuuguccgugagccugguacucgugggaguugucacacuguaccuuggcgugauggugcaggccgauucugguugugucguuucauggaagaauaaagagcugaagugcgggaguggaauauucaucacggacaacgugcauacauggaccgaacaguauaaguuucaacccgagagcccauccaaauuggcaucugccauucagaaggcucacgaagagggcaucugugguauuagaucggugacuaggcucgaaaaucugauguggaaacagaucacacccgaguuaaaccacauacugagcgagaaugaaguaaagcuauccauuaugaccggcgauaucaaagggauuaugcaggccggaaagcggucacuccgcccucaaccaacugagcugaaauacaguuggaagaccuggggcaaggcaaaaaugcuuucuacagaaccgcauaaccagacguucuugaucgacgggcccgagaccgcggaaugcccuaauacuaacagagcuuggaauagccuggaggucgaggauuauggauuuggcguguucacaaccaacauauggcucaagcugaaagaaaggcaggacguauuuugugacuccaaguuaaugucagccgcaaucaaagauaaucgugccgugcacgcugacauggguuacuggauugagagcgcccugaacgauacauggaagaucgaaaaggcaucuuucauugaggucaaauccugccauuggccaaagagucacacucuuuggagcaacgggguguuggagucugaaaugaucauacccaaaaauuucgcuggaccuguuucccagcacaacuaucggccaggcuaccauacccaaacggccggucccuggcaccucggcaagcuggagauggacuuugauuucugugaagggacaaccgugguagucacugaggacugcggaaaucgaggcccgucacuaagaaccacaacugcgagugggaaacugauuaccgaauggugcuguaggagcugcacacucccuccacugcgcuaccggggagaggauggcuguugguaugguauggagaucagaccccuuaaggaaaaggaggaaaacuugguaaauucgcuggugacggccgggcauggacagaucgacaacuuuuccuuaggcguccucgguauggcucuguuccuugaggaaaugcugaggacccgcguuggcacuaaacacgcaguguugcucguagccgugucuuuuaugacacugauuaccgggaauaugagcuuccgagaucuaggacgggucauggugaugguuggcgcugccaugacugacgauaucgggaugggagugacauaccuggcacuccuggcggccuuuaagguccguccuaccuucgcugccggccuuuugcugagaaaauuaacgucaaaggagcucaugaugacuaccauugguauagugcugcuuagucaguccacaacccccgagacuauccuggaacuaacagacgcacucgcucuggggaugaugauuuugaaaaucguuaggaacauggagaaguaucaacuggccgugaccauuauggcaaucuuaugcgucccaaaugccguaauacuccagaacgcuuggaaggugucuuguacaauccuggcggccguuagcguguccccucuucuguugacuucaagccagcagaaagcagauuggauuccccucgcucugaccaucaagggacuaaauccaacggccauuuuucugacaacccuuagucgcacuaacaaaaagcggucuuggccgcucaaugaagccaucauggcugucggcaugguguccauacuggcaagcucguugcugaaaaacgacauuccuaugaccggccccuuaguagccgggggacuccugacagugugcuacguccuuacugguagaucagcggaccuggaguuggaaagggcugccgauguucgaugggaggaccaagcagagaucucuggcaguuccccaauccucagcauuaccauaucugaagaugggagcauguccaucaagaaugaggaagaggagcagacgcugacaauucuaauccgcaccggacugcuugugauuucaggccucuuccccgugaguaucccuauaacugccgcugcaugguaucugugggaagucaaaaagcagcgggccgguguguugugggacguuccaagucccccuccgguagggaaggcggaguuagaagauggagcuuacagaaucaaacagaagggcauucugggcuauucucaaaucggggccggaguguacaaagaggguacauuucauaccauguggcacgucacuaggggcgcagugcucaugcacaaggggaaacguauugaaccauccugggccgacguucgcaaggaucugaucucauacggaggcgguuggaaacuugagggggaguggaaagaaggagaggaagugcagguccuggcuuuggagcccggcaagaacccucgggccgugcagacaaaaccaggccuauucaagaccaacacggggacuauaggagcaguaagucuggacuuuagccccgguaccuccggcucuccuauugucgauaaaaaggggaaggugguuggacucuauggcaaugguguggucacaagaucggggaccuacgugagcgcuaucgcccagacagaaaaaucaaucgaggacaacccggagauugaagaugacaucuucaggaagaaacgacugacuauaauggaucuucaucccggagcgggcaagaccaaacgguauuuaccagccauuguucgcgaggcaaucaagagaggccugaggacgcucauuuuggcuccuacacggguggucgccgcugaaauggaggaagcacugcgagggcuccccaucagauaccaaacuccagccauacgcgccgagcacaccggaagggagauuguggaccugaugugucaugcuacauucaccaugcgucuucuguccccuguacgggugcccaauuauaacuugaucaucauggacgaagcgcacuuuacugauccagcaaguauugccgcuagagguuacaucucuaccaggguugagaugggcgaagccgcagggauuuucaugacagccacgccgccuggaagccgcgaccccuuuccacaguccaaugcucccauaauggaugaggagcgagaaaucccugagagaucauggaacucuggccaugaaugggucacugacuucaaggguaaaaccgugugguuugugccaagcauuaaggcggggaaugauaucgccgcaugccuacggaaaaacggaaagaaagucauccagcugaguaggaagacauucgacuccgaguauauuaagacccgcacuaaugauugggacuuuguagugacaaccgauauaagcgaaaugggcgcuaacuucaaagccgagcguguuaucgaccccagacgguguaugaagccugugauucucacggauggcgaggaaagggucaucuuagcagggccgaugccagugacucacucuucagccgcucaacgccgaggaagaauuggucggaaucccaaaaacgagaaugaccaguacaucuacaugggcgaaccucuggagaacgacgaagauugcgcccacuggaaggaggcgaaaaugcuucuggacaauauaaacacacccgaggggaucauuccauccauguuugaaccugagagggaaaagguugaugcaaucgacggagaguaucgccucagaggcgaagccaggaaaaccuucguggauuugaugcggcguggugaccugcccgucuggcucgcuuaccgcguggccgcugaggggauuaacuaugcagaucgaagaugguguuuugacggcaucaagaauaaccagauacuggaggaaaauguagagguggaaauuuggaccaaggagggagagaggaagaaacuuaaaccacgguggcuagaugcccgcaucuacagugacccucuggcuuugaaagaguucaaagaguucgccgcaggcagaaagagcuuaacucugaaccucauuacagaaauggggaggcugccgaccuuuaugacacagaaggcgcggaaugcccuugauaaccuggcuguucuccauacugccgaggcaggaggucgagcuuauaaucacgccuugucggaacugcccgagacgcuagagacccugcuccuucugacauuauuggcaacugucaccggcgggaucuuccuguuucucaugucuggaaaaggcauagguaagaugacacuggggaugugcugcaucauuaccgccuccauccuucugugguacgcucaaauucagccacauuggaucgcggccagcauaauucucgaguucuuuuugaucgugcuguuaaucccugagcccgaaaaacagagaacuccacaggacaaccaacuaacguauguggucauugcaauccugaccguuguggcugccacaauggccaaugagaugggcuuccucgaaaagacuaaaaaggauuuuggacuuggcucaauagcaacccagcagccugagaguaacauucuggacaucgacuugcgccccgcuucugccuggacacuguacgcgguagcuaccacuuucauuacaccgaugcucaggcacuccaucgagaauagcucagugaacgucagucugacggccauagcaaaucaggccaccgugcuuauggggcucggaaaggguuggccacugagcaaaauggauaucggcguuccuuugcuggcuauuggguguuacucccaagugaaccccaucacuuuaacagcagcccuacugcuccuugucgcgcacuaugcuauuaucggaccaggccugcaggccaaggcaacccgggaagcccagaaacgugcugccgcagguauuaugaagaaucccaccguagacgggaucacagugauagauuuggacccuauuccguacgaucccaaauuugagaagcagcugggccaaguuaugcuccuggugcuuugcgucacucagguguuaaugaugagaacgaccugggcucugugugaagcccucacauuggcgacuggaccaaucucuacccugugggagggcaacccugggagguucuggaauacaaccaucgccgucagcauggcaaacauuuuucgcggauccuaucuagcuggcgccggucuacucuucucaauaaugaagaacacuacgaauacacggcgagggaccggaaacacuggcgaaacccuuggugagaaauggaagaauagacugaacucuuugggcaaaagugaguuucagaucuacaagaggucggggauucaagaaguggaccgcacacuggcaaaagagggaaucaagcggggcgaaacugaucaucacgcuguuagcagaggguccgccaaacuccguugguucguggagaggaaucugguaacccccgagggaaagguggucgacuuaggcugcgguagagggggauggucuuauuacuguggcggucuuaagaacguucgcgaagugaaaggccugacaaaagggggaccuggccaugaggaaccaauucccaugucaacguauggguggaaucucguccgacuacagagcggaguggauguauucuuuaccccuccagagaaaugcgacacucuguugugugauaucggcgaauccagucccaacccgacaguggaggccgguagaacccugaggguucucaaucuuguggagaacuggcugaauaacaauacucaguucugcauaaaggucuugaacccuuacaugccaucugugaucgagaagauggagacacugcagcggaaguacgggggagcgcucguccgcaaucccuuaagcagaaacucaacccacgaaauguauuggguguccaacgcuaguggcaauauuguuagcucuguaaacaugaucuccaggaugcugauuaaucgauuuacgaugcggcauaagaaagcaaccuacgagccugacguggaucuuggcucagggacacguaacaucggaauagaaagcgagacuccaaaucuggacauuaucgguaagagaaucgagaaaauuaagcaagaacacgagaccucguggcacuaugaccaggaucaucccuacaaaacaugggccuaucacggcucuuacgaaacuaagcagaccgggagugcuuccagcauggucaacggagugguucgccuacucacaaagccgugggacgugauaccuauggucacccagauggccaugacugauacgacacccuucggccaacagaggguguuuaaagagaagguagacacccggacucaggaaccaaaagaggguaccaagaaacugaugaagaucacagcagagugguuguggaaggaacuggggaaaaagaaaacgccuagaauguguacccgcgaggaguucgccaggaaggugcgaucaaaugcugcgcucggagccauuuuuacugaugagaacaaauggaaguccgcacgggaggcuguugaagacucuagauucugggagcuugucgauaaagaaaggaaucugcauuuagagggcaagugcgaaacauguguguauaacaugaugggcaagcgcgagaaaaagaucggggaguuuggaaaagccaaggguagccgugcaauuugguacauguggcugggcgcccgguucuuggaauuugaggcucucggguuccugaaugaagaccacugguuuaguagagagaacucccuaagcggaguggaaggcgagggucuucacaaacugggguacauccucagggaggucucuaagaaggaaggaggcgccauguaugcggaugacaccgcaggcugggauacucgcauaacacuggaggacuugaaaaaugaagagaugguuaccaaccauauggaaggggagcacaagaaacuggccgaggcuaucuucaagcucacauaccagaauaaagugguacgagugcaacggcccacuccaagaggaaccgucauggacauuaucucaaggcgcgaucagagagguaguggccagguggggacguauggacuuaacaccuucacaaacaugggcgcccaacugauucggcagauggaaggugaggggguuuuuaagggaauccagcauuuaacugcaaccgaagagguggcuguccaggacuggcuggccagggugggccgugagcgauugucccgcauggcuauuagcggcgaugacugcguaguuaagccccucgaugacagauucgccucugcacugacagcgcuaaaugauauggggaaagugcggaaggacauacaacagugggaaccuucgaggggauggaacgauuggacucaggucccauuuugcucacaccauuuccacgagcuuaucaugaaagacggucgcgugcugguggucccguguagaaaucaggaugaacucauuggccgggccaggaucagccaaggggcuggauggucccugcgagagaccgccugcuugggcaagaguuacgcacagauguggucuuuaauguauuuucaccguagagaccugcgccucgcugccaacgcaaucuguagcgccguucccucccauugggugccuacgucacggacaaccuggaguauucacgcgggucaugaauggaugacuacagaggauaugcuuaccguauggaauaggguguggauacaggagaacccauggauggaagacaaaacucccgucgagucuugggaagagaucccuuaccuggggaagagagaagaccaguggugcggaagccuaauuggccugaccucccgcgcuacaugggcccggaauauccaaacggcaauuaaccaggugaggucacucaucggcagcgaggaguauaccgauuacaugccaucuaugaagcgauucagacgggaagaggaagaggccgggguuuugugguga

SEQ ID NO: 14309 - RNA, 9876 nt, Artificial Sequence
  derived and/or modified CDS sequence (opt3) from DENV-2__KM217156__SS-prME
accgcaggcgugaucauuaugcugauacccacugcuauggcauuccaccucacuacgagaaauggggaaccucauaugaucgucagcaagcaggaaaaaggaaagucccuucuguuuaaaaccgaagacgguguuaauaugugcaccuugauggccauggauuuaggcgaacugugugaagacacuauuaccuacaacugcccacuacucaggcaaaaugaaccggaagauaucgacuguuggugcaacgcgacaucuaccugggugacuuaugggacauguaccgcuacgggagaacaccggcgcgaaaagcgaucaguagcccuggugccccaugucggcaugggucuugagacucguaccgaaacauggaugaguagcgagggggcauggaaacacgcccagagaauugagacuuggauccugaggcauccuggauucaccauaauggcugcaaucuuggccuacacaauuggcaccacguauuuucagcgggugcucaucuucauucugcugacugcuguugccccauccaugacaaugcgcugcaucggcauaucuaauagagauuuuguggaaggggucucgggagguucauggguggacauuguacucgagcacggcagcuguguuaccacuauggcgaagaacaagcccacauuagauuucgaacugaucaaaaccgaggcaaagcagccugccacgcuuaggaaauacugcauugaagcuaaguugaccaauacaacuaccgccagucgguguccaacacaaggggagcccucccugaacgaggaacaggacaaacgcuuugugugcaagcacucuauggucgaucgaggauggggcaaugguugugggcuauucggaaagggcggcaucgugacuugcgcaauguuuaccugcaaaaagaacauggaggggaaaaucgugcagccugaaaaucucgaguauacaauugucguuaccccacauagcggagaagagaacgcuguggguaaugacacuggcaagcacgggaaagagauaaagguaacgccgcaguccucaaucacagaagccgagcugaccggauacggcacugugaccauggaauguagucccagaacaggucuugauuucaacgagaugguccuguugcaaauggaaaauaaagcguggcucgugcauaggcagugguuucuggacuuaccucugccauggcuccccggggccgauauucagggcagcaacuggauccagaaggagacccuuguuacuuucaagaacccucacgccaaaaagcaagacguggucgugcugggaucucaggagggcgcuaugcacacagccuugacgggggcuaccgaaauacagauguccucaggaaauccacuauuuacuggucaucugaaaugccggcuccguauggacaagcugcaacuuaaaggcaugagcuauaguauguguacagggaaguucaagguaguuaaagagauugccgaaacccagcacggaacaaucgugguccgcauccaguacgagggcgaugguucucccugcaagauuccguucgagaucauggaccuggagaaaagacauguguuggggaggcucauuacugucaacccuauagugaccgagaaggauucccccguuaauaucgaagcagagccaccuuuuggcgacagcuacauuaucaucggaguggaacccggccagcugaaauuaucgugguucaagaaggggucuuccauuggacaaauguuugagacgaccaugcggggugccaaacgaauggcuauacugggcgauacagcgugggacuucgggucacuaggaggcguauuuacaaguaucgguaaggcacuccaccaggucuucggggccauuuauggcgcugccuuuagcggaguguccuggaccaugaaaauccugauuggcguugugaucacauggauagggaugaacucucgcagcacuucacuuagugucuccuuggugcugguaggagugguuacccucuaccugggcgucauggugcaggcagauagcgguuguguggucucuuggaagaauaaagagcuuaagugcgggucaggaaucuucuuuacggacaacguucauacauggaccgaacaguauaaguuccaaccagagagucccagcaaacuggccuccgcuauucagaaggcccacgaagagggcaucugugguauuagaucuaucacuagguuggauaaucucauguggaaacagauaacaccugaacugaaccacauuuuaucggagaaugaggugaagcugagcaucaugaccggcgacauuaaagggaucaugcaggcaggaaagcggucccuacgcccacaaccgacugaacucaaauacucauggaagaccuggggcaaggcgaaaaugcugaguacagagccccauaaccagacguuucuuauagaugggccugaaaccgcucagugcccaaauacuaacagagccuggaacucuuuggagguggaagacuauggauucggcguauuuacaaccaacaucuggcugaagcucaaagagaggcaggacgucuucugugauagcaagcugauguccgcagccauuaaagacaaucgugcugugcacgccgauauggguuacuggaucgagucagcauuaaacgacacauggaagauugaaaaggcuagcuucaucgagguuaaaucuugccauuggcccaagucccacacucuguggaguaacggggugcuugaaagcgagaugauaauuccuaaaaauuuugccggaccagucucucaacacaacuaucggcccggcuaccauacccagacggcggguccguggcacuugggcaagcucgagauggauuucgacuuuugugaagggacaaccgugguugugacugaggauugcggaaaucgaggcccuucccugagaaccacaacugccucagggaaacuaaucaccgaauggugcuguaggaguugcacacugccaccccuccgcuaccggggagaggacggcuguugguaugguauggaaaucagaccucugaaggagaaggaggaaaaccuuguaaauagcuuggucacggcugggcauggacagauugauaacuucucgcugggcguguuagguauggcacucuuucuggaggaaaugcuuaggacccgcgugggcacuaaacacgccguccuguugguugcuguguccuucaugacacucaucaccgggaauaugucuuuucgagaccugggacggguaauggugauggucggcgccgcaaugacugaugacauugggaugggagugacauaccuagcgcugcucgccgcuuucaagguucgucccaccuuugccgcaggccugcuuuugagaaaacugacgagcaaggaguuaaugaugacuaccauagguaucgugcuccugucacaaaguacaaccccagaaacuauucuugagcugacagaugcucuagcccucgggaugaugauccugaaaauugucaggaacauggagaaguaucaguuggcagugaccaucauggccauacugugcguuccuaaugcugugaucuuacagaacgcguggaaggucuccuguacaauucucgccgcaguaucugugagcccccugcuucugacuuccucacagcaaaaagcugacuggaucccauuggcccucaccauuaagggacugaauccgacggccaucuuccuaacaacccugagccgcacuaacaaaaagcggaguuggccucuuaaugaagcuauaauggcaguuggcauggugucuauucucgccuccagccuguugaaaaacgacauccccaugaccggcccacuggucgcugggggauuacucacagugugcuacguacugacugguagaucggcggaucuugagcuggaaagggccgcagacgugcgaugggaggaucaggccgaaaucucaggcucuagucccauuuuguccauaaccaucagcgaggacgggucuaugagcauuaagaaugaggaagaggaacagacgcucacaauccugauucgcaccggacuacuggucaucuccggccuuuuuccuguuucaauaccaaucacugcugcagccugguaucucugggaggugaaaaagcagcgggcgggugugcugugggauguccccaguccuccgccaguggggaaggcugaguuggaagacggagccuacagaauuaaacaaaagggcaucuuaggcuauagccagauuggggcaggaguuuacaaagaggguacauuccauaccauguggcacguaacuaggggcgccgugcugaugcacaaggggaaacguaucgaacccucuugggcugauguccgcaaggaccucauauccuacggaggcgguuggaagcuggagggggaauggaaagagggagaggaagugcagguucuugcccuggagccuggcaagaacccacgggcagugcagacaaaacccggcuuguuuaagaccaacacggggacuauuggagcugucucacuagauuucaguccugguaccagcggcuccccgaucguggacaaaaaggggaagguagucggacuguauggcaauggugugguuacaagaucugggaccuacgugucggccaucgcgcaaacagagaaaagcauugaggauaaccccgaaaucgaggacgauauauucaggaagaaacgacucacuauuauggaccugcauccaggagccggcaagaccaaacgguaucuuccugcaaucguccgcgaggcuauuaagagaggcuuaaggacgcugauccucgcccccacacgggugguugcugcagaaauggaggaagccuugcgagggcugccaauaagauaccagacuccugccauucgcgcugagcacaccggaagggaaaucguggaccucaugugucaugcgacauuuaccaugcgucugcuuucacccguccgggugccaaauuauaaccugaucauuauggaugaggcacacuucacugacccggccuccaucgcugccagagguuacauuaguaccaggguagagaugggcgaagcagccgggauauuuaugacagcuacgccucccggaucucgcgauccauucccccagagcaaugcgccuaucauggacgaggaacgagagauuccagagagauccuggaacucaggccaugaaugggugacugauuuuaaggguaaaaccguuugguucguccccucuaucaaggccgggaaugacaucgcagcuugcuugcggaaaaacggaaagaaagugauucaacuaagcaggaagacauuugauagugaguauauaaagacccgcacuaaugacugggauuucguggucacaaccgacaucuccgaaaugggcgccaacuuuaaagcagagcguguaauugauccuagacgguguaugaagccggugauccugacggacggcgaagagaggguuauucucgccgggccaaugcccgugacucacagcucugcugcccagcgccgaggaagaaucggucggaauccuaaaaacgagaaugaccaguacauauacaugggcgaacccuuagagaacgaugaagacugcgcgcacuggaaggaggcaaaaaugcugcuugauaauaucaacacaccagaagggauuaucccuucaauguucgagcccgagagggaaaaggucgacgccauugauggagaguaucgccugagaggcgaagcuaggaaaaccuuuguggaccucaugcggcguggugauuugccaguuuggcuggccuaccgcguggcugcagaggggaucaacuaugccgaccgaagaugguguuucgauggcauaaagaauaaccagauucucgaagagaaugucgagguggaaaucuggaccaaggagggagaaaggaaaaagcugaaaccucgguggcuugacgcucgcauuuacuccgauccgcuagcccugaaggaguucaaagaguuugcagcggccagaaagaguuugacuuuaaaccugaucacagaaaugggcaggcuccccaccuucaugacacaaaaggcucggaaugcccuggacaaccuugcaguacugcauacugcugaggccgggggacgagcauauaaucacgcccucagcgaauugccagagacgcuggaaacccuacugcuccuuacacuguuagcuacugugaccgguggcauauuuuuguuccugaugucggggaaaggaaucggcaagaugacacucgguaugugcugcauuaucaccgcgucuauucugcuuugguacgcccagauccagccucauuggauagcagcuuccauuauccuggaguuuuuccucaucguuuugcugauucccgagccagaaaaacagagaacuccucaagauaaccaguuaacguaugucgugaucgccauacuaaccguggucgccgcaacaauggcuaaugagaugggguuucuggaaaagacuaaaaaggacuucggccucggaagcauugccacccagcagcccgagucaaacauccuugacauugaucugcgcccggcgagugcuuggacauuguacgccguugcaaccacuuuuaucacaccaaugcugaggcacucuauagaaaauuccagcgugaacguaucacucacggccaucgcuaaucaagcaaccgugcugaugggccuugggaagggauggccucucaguaaaauggacauuggugucccccuguuggccaucggcuguuacagccaggugaacccaauuacucugacagcggcuuuacuacugcucguugcccacuaugcaaucauugggcccggacuucaggccaaggcuucccgggaggcccagaaacgugcagcugccggcaucaugaagaauccuaccguggaugguauaaccgucauugaccuggauccgauccccuacgacccaaaauucgagaagcaauuggggcagguaaugcugcucauccugugcgugacacagguucuuaugaugagaacuacgugggcguuaugugaagcccugacccucgcaacaggcccuauuucuacuuugugggagggaaaccccggcagguuuuggaauaccacaauagcugugagcauggccaacaucuuccgcggguccuaucuggcaggagcuggccuacuguuuucaauuaugaagaacaccacuaauacgcggcgagguacagggaacaccggagaaacucucggcgagaaauggaagaauagagucucucuucuggguaaaagugaguuccaaaucuacaagaggucgggcauucaggagguggaucgcaccuuggccaaagaggggaucaagcggggagaaacagaccaucacgccgucagcagaggcuccgcgaaacugcguugguucguggagaggaaccucguuacuccugaagggaaggugguagaucugggaugcggccgggguggguggucuuauuacuguggaggcuuaaagaaugugcgcgaggucaaaggucuuaccaagggcgggccaggacaugaggaacccauaccuaugucaacauauggcuggaaccugguucgacuccuaacgggggcugacguguuuuucaccccacccgagaaaugcgauacucuguugugugacaucggagaaagcuccccgaauccuacagucgaggcaggcagaacccugagggugcucaaccuuguagaaaauuggcugaacaauaacacucaguuuugcauuaagguguugaauccauacaugcccaguguuaucgagaaaauggagacacugcagcggaaguacgguggggcccucgugcgcaacccuuuaucuagaaauagcacccacgaaauguauugggucucaaacgcuuccggaaacauugugaguagcgucaauaugaucucuaggaugcugauaaaccgauucacgaugcggcauaagaaagccaccuacgauccagacguggaccuuggcuccggcacacguaauauugggaucgagucagaaacucccaaccuggauaucauuggaaagagaauagagaaaaucaagcaagaacacgagaccagccgccacuaugaccaggaucauccguacaaaacaugggcauaucacgguucguacgagacuaagcagaccggcucugccaguuccacaguuaaugggguagugaggcuacucaccaagccuugggacgucauucccauggugacucagauggcuaugacggauacaaccccauuuggacaacagcggguuuucaaagaaaagguggacacuagaacccaggagccuaaagaaggcacaaagaaacugaugaagaucacggcggagugguuguggaaggaacuggguaaaaagaaaacaccccgcauguguacuagggaggaguuugcccgaaagguccggagcaacgcagcucucggggccauuuucacagaugaaaauaaauggaagucagcaagagaggccguggaagacuccagguuuugggagcuuguagauaaagagcgcaaccugcauuuagaaggaaagugcgagaccuguguguauaauaugaugggcaagcgugagaaaaagaucggcgaguucgggaaagcuaagggaucucgggccauaugguacauguggcugggugcgagauuuuuggaguucgaggcacucggcuuucugaacgaggaccacugguucagcagggaaaauagucuauccgggguugagggagaaggccuucacaaacuggguuacauccuccgcgaggucagcaagaaggaagggggagccauguaugcugaugacacugccggcugggacacacgaauuacccuggaggauuugaaaaacgaggaaauggugacaaaucauauggagggcgaacacaagaaacuggcagaggcuaucuucaagcucacuuaccagaacaaagugguccggguucaaagaccaacccccagggggacggugauggacauuaucucucgcagagaucagcggggaucaguacagguggguaccuauggccuugggacauuuacuaauaugggagcccaacugauuaggcagauggaaggcgagggugucuucaaggggauacagcauuuaaccgcuacagaggaaguggccguucaggacuggcuggcacgugugggacgagagcgcuugaguagaauggcgaucuccggcgaugacugcgucgugaagccucucgaugaccgguuugccagcgcucugacugcccuaaacgauaugggcaaaguaaggaaggacauucaacagugggaaccaucucgcggguggaacgauuggacccagguuccguucugcucgcaccauuuucacgagcuuaucaugaaagacggaagagugcuggucguggcaugucggaaucaggaugagcucaucgguagggcucgaauuucacaaggcgccggguggagccugcgugaaacggcaugcuugggaaaguccuacgcccagauguggaguuuaauguauuuccacagacgcgaccugcggcucgcggcuaacgccauauguucugcagugcccagccauugggucccuacauccaggaccacuuggucaauccacgccggccaugaguggaugacaaccgaagacaugcuuacuguuuggaauagaguguggauucaggagaacccauggauggaagauaaaacccccguagagaguugggaggaaaucccuuaccuggguaagcgcgaggaccaguggugcgggucucuaauuggacugacaagccgggcuacgugggccaggaauauccaaaccgcaauaaaccaggugcgaucccucaucggcucagaagaguauacugauuacaugccaagcaugaagagauuuggccgggaagaggaggaagcuggggucuugugguga

SEQ ID NO: 14310 - RNA, 9876 nt, Artificial Sequence
  derived and/or modified CDS sequence (opt3) from DENV-2__KX380809__SS-prME
accgcaggaaucauuauaaugaugauccccaccgugauggcuuuccaccugacuacgagaaacggggaaccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggacuaaaccccacagcuauauuucugaccacucuuagcagaaccaguaaaaagaggucuuggccacucaaugaagccauuauggccgucggcaugguguccauccuggcuagcucguugcugaaaaacgauaucccgaugacaggcccuuuaguagcagggggacuccugacugugugcuacguccuuaccggucgaucagccgaccuggaguuggaacgcgcggcugacguucggugggaggagcaggccgaaauuucuggcaguucccccauacucagcaucacgauuucugaggaugggagcauguccaucaagaaugaagaggaggaacagacacugaccauucuaaucagaacuggacugcuugugauaucaggccucuucccagugaguauccccauuacagcagccgcuugguaucugugggaggucaaaaagcaaagggccgguguguugugggacguuccuagcccacccccuguagggaaagccgaauuagaggauggagcguaccguaucaagcagaagggcauucugggcuauucucagaucggggcuggaguguacaaagaagguaccuuucacacuauguggcaugucacacgcggcgccgugcucaugcacaaggggaaacggauagagccguccugggcagacguuaagaaagaucugauuucauacggaggcgguuggaaacuugagggggaauggaaggagggagaagaggugcagguccuggccuuggaaccaggcaaaaaccccagagcugugcaaaccaagccuggccuauucaaaacgaacacugggaccaucggagccguaagucuggacuuuagcccagguacauccggcucucccaucgucgauaagaaagggaaggugguuggacucuauggcaaugguguggucaccaggucggggacauacgugagcgcaauugcucagacugagaagucaaucgaggacaacccugaaauagaggaugacauuuucagaaagaaacggcugaccaucauggaucuucauccgggagccggcaaaacgaagcgcuauuuacccgcgauuguuagagaagccaucaaaaggggccugcggacacucauauuggcaccaacucgaguggucgcugccgagauggaagaggcucugagagggcucccuauucgcuaccagacccccgcaaucagggccgagcacacaggacgugaaaucguggaccugaugugucaugccaccuucacuaugcggcuucuguccccaauuagaguaccuaauuauaacuugaucauuauggaugaggcucacuuuaccgaccccgcgaguauagcagccagggguuacaucucuacacgcguggaaaugggcgaggcugccgggauuuucaugacggcaacuccaccgggaagccgagacccuuuuccccaguccaaugccccaaucauggaugaggaaagagagauccccgaacggucauggaacucuggccacgaguggguuaccgacuucaaggguaagacagucugguuugugccuagcauuaaagcugggaaugauauagcggccugccuaaggaagaacggcaaaaaggugauccaacugagucgcaaaaccuucgacuccgaauauauuaagacucguacaaaugauugggacuuugucguaaccacggauaucagcgagaugggcgcaaacuucaaggcugagagagugauugacccacggagguguaugaaacccguuauccucacugauggcgaagaacgcgugauauuagccgggccuaugccggucacacauucuucagcagcccagcgaagaggacggguggguaggaauccaaagaacgaaaaugaccaguacaucuacaugggcgagccccuggaaaacgaugaggacugcgcucacuggaaagaggccaagaugcuucuggacaauauuaacaccccugaagggaucauucccuccauguuugagccagaacgcgagaaaguugaugcgaucgacggagaauauagacucaggggcgaggcacggaagaccuucguggauuugaugcgucgcggugaccugccugucuggcucgccuaccgaguggcugccgaggggauaaacuaugcugauagaaggugguguuuugacggcgucaaaaauaaccaaauucuggaagagaauguggaaguugagaucuggacuaaggagggagaacggaagaaacuuaagccccgcuggcuagaugcaagaauuuacagugacccacuggccuugaaagaguucaaggaguucgcugccggcaggaagucguuaacacugaaccucaucaccgagauggggcggcugccuacauuuaugacucagaaggcacgaaaugcgcuugauaaccuggccguccuccauacggcugaagccggagguagagcauauaaucacgcuuugagcgagcugccggagacccuagaaacacugcuccuucugacuuuauuggccaccgugacaggcgggauauuccuguuucucaugucuggaaagggcaucgguaaaaugacccuggggaugugcugcauuaucacugcauccauucuucugugguacgcccagauccagccccacuggauagcugcgagcauuauccucgaguucuuuuugaucgugcuguuaauuccagaaccugagaagcaacgcacgccccaggacaaccagcuaaccuaugucguuaucgccauacugacagugguagcagcuacuauggccaaugaaaugggcuuccucgagaaaaccaagaaagauuuuggacuuggcucaauuacaacccagcaaccagacaguaacauccuggauauugacuugaggccugccucugcauggacucuguacgcuguggccacaacguucaucacccccaugcuccggcauuccauagagaauagcucagucaacgugagucugacugcgaucgcuaaucaggccacaguucuuauggggcucggaaaggguuggccgcugagcaagauggacauuggcgugccauugcuggcaaucggguguuacucccaggucaacccuauuaccuuaaccgccgcucuacugcuccuuguagcacacuaugccaucauuggacccggccugcaggcgaaagcuacacgugaagcccaaaagagagcagccgcugguaucaugaaaauaccaacuguggaugggauuacgguuaucgacuuggaucccaucccuuacgacccgaaguuugagaaacagcugggccaggugaugcuccugguccuuugcgugacccaggucuuaaugaugaggacaacuugggcccugugugaagcacucaccuuggcuacaggacccauuucuacccugugggagggcaauccagggcgcuucuggaacacuacgauagccgugagcauggcgaauaucuuucggggauccuaucuagccggcgcaggucuacucuucucaauuaugaagaacacagcuaacacccgaagagggacuggaaauaccggcgaaacacuuggugagaaguggaaaaacaggcugaaugccuugggcaagucugaguuucaaaucuacaaaaagagugggauucaggaaguugaucgcacucuggcaaaagagggaaucaagcggggcgaaaccgaccaucacgcugugucgagagggagcgccaaacuccguugguucguagagaggaaccuggugacaccugagggaaaggucguugauuuaggcugcgguagagggggaugguccuauuacuguggcggucuuaagaaugugaaagaagucaagggccugacgaaagggggacccggccaugaggaaccuauaccaaugucuaccuauggguggaaccucgugcgccuacagucaggaguagacguguucuuuacucccccugagaagugcgauacacuguugugugacaucggcgaaagcuccccaaaucccaccguugaggccggucgaacucugagagugcucaaccuugucgagaauuggcugaacaauaacacacaauucugcauuaaaguguugaauccguacaugccuagugucaucgaaaagauggaggcgcugcagaggaaguacgggggagcucucgugcggaacccauuaucucgcaauagcacccacgaaauguauuggguuucaaacgcauccggcaacauuguaaguagcgugaauaugaucucuagaaugcugauaaacagguuuacgaugaaacacaagaaagccaccuacgagcccgaugucgaccuuggcuccgggacacgaaauauuggaaucgaaucagagacuccuaaccuggauaucauugguaagcggauagagaaaaucaagcaggaacaugagaccagcuggcacuaugaccaggaccauccauacaagacaugggcuuaucacggcucguacgaaacuaaacaaaccgggucugccaguuccauggugaauggaguugugcgucuacucacaaagcccugggaugucauuccgauggugacccagauggcaaugacugacacgacaccuuucggccagcagagaguauuuaaagagaagguggauacccgcacucaagaacccaaagaggguaccaagaagcugaugaaaaucacagccgagugguuguggaaggaacuggggaaaaagaaaacgccaaggauguguacccgggaggaguucacuagaaagguucgcagcaacgcugcgcucggagccauuuuuacagacgagaauaaauggaagucagcaagggaggcugucgaagauuccggcuucugggagcuuguggacaaggaacgaaaccugcacuuagagggcaaaugcgaaaccuguguguauaauaugauggggaagcgggagaaaaagcugggagaguuugguaaagccaagggcucuagagcaaucugguacaugugguugggggccagguuccucgaauuugaggcucugggauuccuaaacgaagaucauugguuuagccgcgagaauagucuuuccggcgucgaaggugaggggcugcacaagcucggauacauacugcgugacguuagcaaaaaggagggcggcgccauguaugcggaugacacugcagggugggauacacggaucaccuuggaagaccugaaaaacgaggaaauggugacaaaucauauggagggagaacacagaaagcucgccgaggcuauuuucaggcuuacuuaccagaacaaaguagugcgcguccagcgaccuacaccccgggguacggugauggacaucauuucuagaagggaucagcgcggcucagggcaaguugugaccuauggacugaauacauucacuaacauggaggcccaguuaaucagacagauggaaggcgagggugucuuuaagaguauucaacaucugaccgugacagaagagauagcaguaaagaacugguuggagcggguugggagggaacgucucucccgaauggcuaucagcggagacgauugcguggucaaaccacuggacgaucgcuucgccucugcucuaacugcccuuaaugacaugggcaaggugagaaaagauauucagcagugggagcccucgcggggcuggaacgacuggacccaggugccuuuuugcucacaccacuuccaugaacugaucaugaaggaugggaggguccucguugugccaugucgcaaucaagacgagcugaucggacgagcacggauuagccagggugcgggcugguccuugagggaaacggccugcuuagggaaaaguuacgcucagauguggucucugauguauuuucaccgacgugaucucagacuugccgcaaacgcuauauguagcgccguaccgucccauugggugcccacaucacgcaccacuuggaguauccacgcaacacacgaguggaugaccacugaggacaugcugaccgucuggaaucggguguggauucaggaaaacccuuggauggaggauaagacaccaguugaaucuugggaggaaauccccuaccuaggaaagagggaggaccaauggugcggcagccugauuggucucacguccagagccaccugggcgaaaaauauccagacugcuauaaaccaggugcgcucauugaucgggaaugaggaauauacagacuacaugccuagcaugaagcgguucaggcgagaggaagaggaagccggaguccugugguga

SEQ ID NO: 14311 - RNA, 9876 nt, Artificial Sequence
  derived and/or modified CDS sequence (opt3) from DENV-2__KX380810__SS-prME
accgccggaaucauuauaaugaugauccccacagugauggcuuuccaccugacuacgcgaaacggggaaccucauaugauuguaagcaggcaggaaaagggaaaaucccuccuuuuuaagaccgagaaugguguuaacaugugcacccugauggcaauggacuugggagaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacgggcaaagacagcccuguuaacauagaggccgaacccccauuuggagauucguacaucauuaucggcguggagccugggcagcugaaguuaucuugguucaaaaagggauccucaaucggucagauguuugaaaccacaaugcgaggcgcaaagcgcauggccauucugggggacacugcuugggauuucggaagucuaggcgguguauuuaccagcauagggaaagcgcuccaucaagucuucggcgcaaucuauggagccgcuuuuuccggcgugucuuggacaaugaagauucugaucgggguugugauuacuuggaucggaaugaauagcagaucaaccagucuuuccgucagcuuggugcugguaggcauagugacgcucuaccuggguguuaugguccaggccgacucuggguguguggugucauggaaaaacaaggagcuuaaaugcggaaguggcaucuucauuacagauaauguccacaccuggacugagcaguauaaguuucagcccgaaagcccauccaagcuggcaucugccauccaaaaagcucacgaggaagguauuuguggcaucaggucgguuacacgguuggagaaccucauguggaagcagauaacccccgaacugaaucauauuuuaagcgagaacgaggugaaacugacuaucaugaccggggacauuaagggaaucaugcaggccggcaaacgcucccuaagaccucagccaacagaacucaaguacucauggaaagcaugggggaaggcgaagaugcugaguacggagcuucacaaucauaccuucuugauagauggaccggaaacugcugagugccccaacacaaauagggccuggaacucucuggaaguggaggacuauggcuuugguguauucaccacaaauaucuggcucaaacugaaggagcgucaagaugucuuuugugacagcaaauuaauguccgcagccauuaaggacaaccgggcugugcacgccgauaugggguacuggaucgaaucagcacugaacgacacuuggaaaauugagaaggcuagcuucaucgaaguuaagucuugccacuggccuaaaucccauacccuuuggaguaauggaguguuggagagcgagaugauaauuccaaagaacuucgccggccccgucucucagcacaauuaucgaccugguuaccauacgcagacagcgggcccauggcaccucgggagacuggaaauggauuuugacuucugugagggaaccacugugguugugaccgaagauugcggcaacagggggcccucccuacgcacaacuaccgccucaggaaaacugaucacagaguggugcugucggaguugcacgcucccgccucugagauacaggggcgaagacgguuguugguaugggauggagauccgcccacuuaaggagaaagaagagaauuugguaaacagccuggucaccgcuggacauggccagauugauaauuuuucguuaggugugcucggcauggcacuguuccuugaagagaugcugcgaacucggguggggacaaagcacgccaucuugcucgucgcuguuuccuuugugacccugauuacuggaaacaugucuuuccgugaccuaggcagaguaauggugauggucggggccacaaugaccgaugacauaggaaugggcgugacguaccuggcacuccuggcggccuuuaagguuaggcccacuuucgcugccggucuuuugcugcgcaaauuaaccagcaaggaacucaugaugacaaccaucgggauugugcugcuuucacaaaguacuaucccugagacaauucuggagcuaaccgaugcacucgcucugggaaugauggucuugaaaaucgugcggaauauggaaaaguaucagcuggccguuacaauaauggcaaucuuaugcgugcccaacgccgucauucuccagaaugcuuggaaaguauccuguacuauccuggcggugguuucugugagcccacuucuguugaccuccucacaacagaaggccgacuggauuccucucgcacugacgaucaagggccuaaaccccacagcuauauuucugaccacucuuagcagaaccaguaaaaagaggucuuggccacucaaugaggccauuauggccgucggcaugguguccauccuggcuagcucguugcugaaaaacgauaucccgaugacagggccuuuaguagcaggaggucuccugacugugugcuacguccuuaccggccgaucagccgaccuggaauuggagcgcgcggcugacguucggugggaagaacaggccgagauuucugggaguucccccauacucagcaucacgauuucugaagauggaagcauguccaucaagaaugaggaagaggagcagacacugaccauucuaaucagaacuggccugcuugugauaucaggucucuucccagugaguauccccauuacagcagccgcuugguaucugugggaagucaaaaagcaaagggcagggguguugugggacguuccuagcccacccccuguaggaaaagccgaguuagaagauggcgcguaccguaucaagcagaagggcauucugggguauucucagaucggagcugguguguacaaagagggcaccuuucacacuauguggcaugucacacgcggggccgugcucaugcacaagggaaaacggauagaaccguccugggcagacguuaagaaagaucugauuucauacggcgguggguggaaacuugagggagaguggaaggaaggcgaggaagugcagguccuggccuuggagccaggcaaaaaccccagagcugugcaaaccaagccugggcuauucaaaacgaacacuggaaccaucggugccguaagucuggacuuuagcccaggcacauccgggucucccaucgucgauaagaaaggaaaggugguuggccucuaugguaaugggguggucaccaggucgggaacauacgugagcgcaauugcucagacugaaaagucaaucgaggacaacccugagauagaagaugacauuuucagaaagaaacggcugaccaucauggaucuucauccgggcgccggcaaaacgaagcgcuauuuacccgcgauuguuagagaggccaucaaaagggggcugcggacacucauauuggcaccaacucgaguggucgcugccgaaauggaggaagcucugagaggacucccuauucgcuaccagacccccgcaaucagggccgagcacacaggucgugagaucguggaccugaugugucaugccaccuucacuaugcggcuucuguccccaauuagaguaccuaauuauaacuugaucauuauggaugaagcucacuuuaccgaccccgcgaguauagcagccaggggcuacaucucuacacgcguggagaugggggaagcugccggaauuuucaugacggcaacuccaccgggcagccgagacccuuuuccccaguccaaugccccaaucauggaugaggagagagaaauccccgagcggucauggaacucuggucacgaauggguuaccgacuucaaggggaagacagucugguuugugccuagcauuaaagcuggaaaugauauagcggccugccuaaggaagaacggcaaaaaggugauccaacugagucgcaaaaccuucgacuccgaguauauuaagacucguacaaaugauugggacuuugucguaaccacggauaucagcgaaaugggcgcaaacuucaaggcugagagagugauugacccacggagguguaugaaacccguuauccucacugauggggaggaacgcgugauauuagccggaccuaugccggucacacauucuucagcagcccagcgaagaggucgggugggcaggaauccaaagaacgagaaugaccaguacaucuacaugggggaaccccuggagaacgaugaagacugcgcucacuggaaagaggccaagaugcuucuggacaauauuaacaccccugagggaaucauucccuccauguuugaaccagagcgcgaaaaaguugaugcgaucgacggcgaguauagacucaggggugaagcacggaagaccuucguggauuugaugcgucgcggggaccugccugucuggcucgccuaccgaguggcugccgagggcauaaacuaugcugauagaaggugguguuuugacggagucaaaaauaaccaaauucuggaggaaaauguggagguugaaaucuggacuaaggagggcgagcggaagaaacuuaagccccgcuggcuagaugcaagaauuuacagugacccacuggccuugaaagaguucaaggaguucgcugccgggaggaagucguuaacacugaaccucaucaccgaaaugggacggcugccuacauuuaugacucagaaggcacgaaaugcgcuugauaaccuggccguccuccauacggcugaggccgguggcagagcauauaaucacgcuuugagcgaacugccggagacccuagagacacugcuccuucugacuuuauuggccaccgugacagggggaauauuccuguuucucaugucuggcaaggguaucgggaaaaugacccugggcaugugcugcauuaucacugcauccauucuucugugguacgcccagauccagccccacuggauagcugcgagcauuauccucgaguucuuuuugaucgugcuguuaauuccagagccugaaaagcaacgcacgccccaggacaaccagcuaaccuaugucguuaucgccauacugacagugguagcagcuacuauggccaaugagaugggauuccucgagaaaaccaagaaagauuuuggccuugggucaauuacaacccagcaaccagacaguaacauccuggauauugacuugaggccugccucugcauggacucuguacgcuguggccacaacguucaucacccccaugcuccggcauuccauagagaauagcucagucaacgugagucugacugcgaucgcuaaucaggccacaguucuuaugggacucgguaagggcuggccgcugagcaagauggacauuggggugccauugcuggcaaucggauguuacucccaggucaacccuauuaccuuaaccgccgcucuacugcuccuuguagcacacuaugccaucauuggccccggucugcaggcgaaagcuacacgugaggcccaaaagagagcagccgcugggaucaugaaaauaccagccgcagauauuggcacugugaucgacuuggaucccaucccuuacgacccgaaguuugaaaaacagcugggacagguuaugcuccuggugcuuugcucuacgcaggucuuaaugaugaggaccacaugggcucugugugaggcccucacuuuggcgaccggccccauuagcacacugugggaagggaauccaggacgcuucuggaacaccacuauagccguguccauggcaaauaucuuucggggcucauaucuagcuggugccgggcuacucuucucuauuaugaagaacacggcaaacacacgaagaggaaccggcaauacuggugagacccuuggcgaaaaguggaaaaacaggcugaaugcuuuggggaagagugaguuucaaaucuacaaaaagucgggcauucaggaggucgaucgcacacuggccaaagaaggcaucaagagaggggaaacugaccaucacgccgugagccggggauccgcgaaacuccguugguucguugaaaggaaccuggugaccccugagggcaagguaguggauuuagguugcgggcggggaggcuggucuuauuacugugguggccuuaagaaugucaaagagguuaaggggcugacaaaaggaggccccgggcaugaagaaccuauaccaaugucaacguauggauggaaccucgugcgccuacagagcggcgucgacguguucuuuacacccccugaaaagugcgauacucuguugugugacaucggugaguccaguccaaaucccacaguagaagcugggcgaacccugagagugcucaaccuuguugagaauuggcugaacaauaacacucaauucugcauuaaaguguugaauccguacaugccuucugucaucgagaagauggaagcacugcagaggaaguacggaggcgcccucgugcggaacccauuaagccgcaauucaacacacgagauguauugggucuccaacgcuaguggcaacauugugagcucuguuaauaugaucuccagaaugcugauaaacagguuuaccaugaaacacaagaaagccacguacgaacccgauguagaccuugggucaggaacccgaaauauugguaucgagagcgaaacaccuaaccuggauaucauuggcaagcggauagagaaaaucaagcaggagcaugaaacuucguggcacuaugaccaggaccauccauacaagaccugggcauaucacgggucuuacgagacaaaacaaacuggaagugccuccagcauggugaauggcgucgugcgucuacucaccaagcccugggauguuauuccgauggugacacagauggcuaugaccgacacuacgccuuucggucagcagagagucuuuaaagaaaagguggauacacgcacccaagagcccaaagaagggacuaagaagcugaugaaaaucaccgcggagugguuguggaaggagcugggcaaaaagaaaacaccaaggauguguacgcgggaagaguucaccagaaagguacgcucaaacgccgcacucggcgcuauuuuuacugacgaaaauaaauggaaguccgccagggaggcaguggaggauucuggcuucugggaacuuguugacaaggagcgaaaccugcacuuagaagggaaaugcgagacaugugucuauaauaugaugggaaagcgggagaaaaagcugggugaguuuggcaaagccaaggggagcagagcuaucugguacaugugguugggagccagguuccucgaguuugaagcgcugggcuuccuaaacgaggaucauugguuuagucgcgaaaauucccuuagcgguguggagggggaaggacugcacaagcucggcuacauacugcgugacgugucuaaaaaggagggcggggcaauguaugccgaugacaccgcuggaugggauacucggaucacauuggaggaccugaaaaacgaagagauggucaccaaucauauggaaggugagcacagaaagcucgccgaagcaauuuucaggcuuacauaccagaacaaaguugugcgcguacagcgaccuacuccccggggcaccgugauggacaucauuucaagaagggaucagcgcgggaguggacaagucgugacguauggccugaauaccuucacaaacauggaggcucaguuaaucagacagauggagggugaagggguuuuuaaguccauucaacaucugacugugaccgaggaaauagccgucaagaacugguuggagcgggugggaagggagcgucucagccgaauggcuaucucuggcgacgauugcguaguuaaaccacuggacgaucgcuucgccucggcacuaacagcgcuuaaugacaugggcaaggugagaaaagauauucagcagugggaacccucacggggguggaacgacuggacucaggucccuuuuugcagccaccacuuccaugagcugaucaugaaggauggaagggugcucguggucccaugucgcaaucaagacgaacugaucgguagagcccggauuucccagggcgcuggguggaguuugagggagaccgccugcuuaggaaaaucuuacgcacagauguggagccugauguauuuucaccgacgugaucucagacuugcugccaacgcaauauguuccgccguuccgucacauugggugcccaucagucgcacgacauggucuauucacgcgacccacgaauggaugacuacagaggacaugcugaccguauggaaucggguguggauccaggagaacccuuggauggaagauaagacuccagucgagagcugggaagagauucccuaccuaggcaagagggaagaccaauggugcgguucccugaucgggcucaccucaagagcuacaugggccaaaaauauacagacggcaaucaaccaggugcgcagcuugauuggaaaugaggaguauaccgacuacaugccuucuaugaagcgguucaggcgagaagaggaagaggccggcguucugugguga

SEQ ID NO: 14312 - RNA, 9876 nt, Artificial Sequence
  derived and/or modified CDS sequence (opt3) from DENV-2__KX380811__SS-prME
accgccggcaucauuauaaugaugauccccacagugauggcuuuccaccugacuacgaggaauggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcagccucagaccccagccuacggagcugaaguacuccuggaaagccuggggcaaggcaaagaugcuuucaaccgaauugcacaaucauacuuuccugaucgaugggccagagacagcggaaugcccgaacaccaauagggcuuggaacagucucgaggucgaggacuauggauuuggcguguucacaacuaauauauggcugaaauuaaaggaacgucaagauguauuuugugacucuaaccugaugagcgccgcaaucaaagacaaccgggccgugcacgcugauauggguuacuggauugaguccgcccuuaaugacaccuggaagaucgaaaaagcaucauucauugaggucaagagcugccacuggcccaagucucauacguugugguccaacggggugcucgagagugaaaugaucauaccuaaaaauuucgcuggaccaguuagccagcacaacuaucgacccggcuaccauacacagaccgccgguccuuggcaccugggcagacuagagauggauuuugacuucugugaagggacuaccgugguagucacagaggauugcggaaauaggggcccaucucugcgcacuaccacagcguccgggaagcucauuacggaauggugcugucggucaugcacccugcccccgcuuagauacaggggagaggacggcuguugguaugguauggagauccgcccuuugaaagaaaaggaggaaaaccuggugaauaguuuagugacugccgggcauggacagaucgauaacuuuagccucggcguccuggguauggcucuuuuccuggaggaaauguugcgaacacggguuggcaccaaacacgcaauucuccugguggccguaucguuugugacucuaaucacagggaauauguccuuccgugaccugggaagagucauggugaugguuggcgcuaccaugacggaugacauugggaugggagugacuuaccucgcccugcuugcagcguuuaaggucaggccaaccuucgccgcuggcuugcuguuacgcaagcucacaucuaaagagcugaugaugaccacuauagguaucgugcuucugagccaaucaacaauucccgagaguauccuagaacucaccgaugcccuggcauuggggaugaugguucugaagauugugcggaacauggagaaauaucaguuagcugucacaaucauggccauacucugcguaccuaaugcagugauccugcagaacgccuggaagguuuccuguacuacccuugcuguggucucugugagcccccuguugcucacguccucacaacagaaagcggacuggauuccacuggcccuaacaaucaagggacugaauccuaccgcaauuuuucuuacuacccucagcagaacaaguaagaaaaggucuuggccccugaacgaagcuaucauggccguaggcaugguguccauauuggccagcucgcuguuaaagaaugauauuccaaugacuggcccgcucgucgcugggggacugcuuaccguuugcuacgugcugacgggucgaucagcagacuuggagcucgaacgcgccgcggacgugcggugggaggagcaggcugaaaucucuggcaguuccccuauccugagcauuacaauaucugaggaugggagcauguccaucaaaaacgaagaggaggaacagacccuaacuauucugaucagaacaggacuucucgucauuucaggccuguuccccgugaguaucccaauaaccgccgcagccugguauuugugggagguuaagaaacaaagggcugguguauuaugggacgugcccagcccuccacccgucgggaaggcagaacuggaggauggagccuaccguaucaaacagaagggcauucucggcuauucucagaucggggcgggaguguacaaggaagguacuuuucacacaauguggcauguuacccgcggcgcugugcugaugcacaaagggaagcggauugagccuuccugggccgacgucaaaaaggaucuuaucucauacggaggcgguuggaaacuggagggggaauggaaggagggagaagaggugcagguauuggcacuagaaccgggcaagaacccaagagccguccaaacgaaacccggccuguucaagacuaauaccgggacaauaggagcugugagucucgacuuuagcccugguaccuccggcucuccaauuguugauaaaaaggggaaaguggucggacuguauggcaacggugugguuacaaggucggggacuuacgugagcgccaucgcacagaccgagaagucaaucgaggacaaucccgaaauugaggaugacaucuuccgaaagaaacggcuuacgauaauggauuuacauccuggagcuggcaagacaaaacgcuaucugccggccauugucagagaagcgaucaagaggggccuccggacuuugauucuggcccccacccgagugguagcagcugagauggaagaggcccucagagggcugccaauccgcuaccagaccccugcuauaagggcagagcacaccggacgugaaauuguggaccuuaugugucaugccacuuucaccaugcggcuguugucccccaucagaguuccaaacuauaaucuaaucauuauggaugaggcccacuuuacagacccugcuaguaucgcggcaagggguuacauuucuacgcgcgucgaaaugggcgaggccgcugggauauucaugacugccacacccccaggaagccgagacccguuuccucaguccaacgcacccaucauggaugaggaaagagagauuccagaacggucauggaacucuggccacgagugggugacagacuucaaagguaagaccgugugguuuguccccagcaucaaggccgggaacgauaucgcugcgugccugaggaaaaauggaaagaaaguaauucaacucagucgcaagacuuucgacuccgaauauauaaaaacacguaccaacgauugggacuuugugguuacgacugauaucagcgagaugggcgccaauuucaaggcagagagagugauugacccucggagguguaugaagccagucaucuuaacagauggcgaagaacgcgugauucuggcugggcccaugccuguuacccauucuucagccgcacagcgaagaggacggguggguaggaacccgaaaaaugaaaacgaccaguacaucuacaugggcgagccacuugaaaaugaugaggacugcgcccacuggaaggaggcuaaaaugcugcucgacaacauaaacacccccgaagggaucauuccuuccauguuugagcccgaacgcgagaaggucgaugccaucgacggagaauauagauugaggggcgaggcgcggaaaacuuucguggaucugaugcgucgcggugaccucccaguauggcuggcauaccgaguggccgcugaggggauuaauuaugccgauagaaggugguguuuugacggcguuaagaacaaucaaauccuugaagagaacgucgaaguggagauauggacaaaagagggagaacggaagaagcuaaaaccucgcuggcuggaugcuagaauuuacagugaccccuuggcauuaaaggaguucaaagaguucgccgcuggcagaaagagccugacccucaaucugaucacagagauggggcggcuuccaacuuuuaugacgcagaaagccaagaacgcacuggauaaucucgcgguguugcauaccgccgaagcuggaggucgagccuauaaccacgcacugucggagcuaccugagacacuggaaacucuccuucuguuaaccuugcuggcuacagucaccggcgggauuuuccucuuucugaugucuggaaagggcaucgguaaaaugacucuugggaugugcugcauaaucacggccuccauucugcucugguacgcacagauccagccgcacuggauugccgcuagcaucauauuggaguucuuucugauuguuuuacuaauccccgaaccagagaagcaaagaaccccucaggacaaucagcugacauaugugguaaucgcgauucucacuguggucgccgcaaccauggcuaacgaaaugggcuuccuugagaaaacaaagaaagauuuuggacugggcucaaucaccacucagcaacccgagaguaauauauuggacauugaucugcgcccagccucugccuggacacucuacgcaguggcuacgaccuucaucacuccuaugcugaggcauuccauugaaaacagcucaguuaaugugagucuuacagccaucgcgaaccaggcuaccguccucauggggcugggaaaggguuggcccuugagcaagauggacauaggcguaccgcuguuagccaucggguguuacucccaggugaauccaauuacccuaacagcagcccugcuccuucugguugcucacuaugcaaucauuggaccuggcuugcaggccaaagcgacucgggaggcucaaaagcgugccgcagccgguaucaugaaaauucccacgguggacgggaugaccgucaucgaucuggacccaauacccuacgauccuaaguuugaaaaacagcucggccaggugaugcugcuugucuuaugcgugacacagguucugaugaugagaacuaccugggcucucugugaggccuugacacuggcaaccggaccgauuucuacucuaugggaaggcaaccccgggagguucuggaauacgacaaucgcugugagcauggccaacaucuuucgcggauccuaucuggcgggcgccggucuccuuuucucaauuaugaagaacaccgcaaauacucggcgagggaccggaaacacaggcgagacucugggugagaaguggaaaaauagauugaacgcucugggcaagucugaauuucaaauauacaaaaagagugggauccaggagguagacaggacccucgccaaagaaggaauuaagcgcggcgagacagaucaucacgcagugucgcgggggagcgcuaaacugagaugguucgucgagcguaauuuaguuacgccagaaggaaagguggucgaccuuggcugcgguagagggggaugguccuauuacuguggcggucugaagaacgugaaagagguaaagggccucaccaaagggggaccuggccaugaggaacccaucccuaugucuacuuauggguggaaucuagugcggcugcagucaggaguugauguguucuuuacaccacccgaaaagugcgacaccuugcugugugauauuggcgagagcuccccuaacccaacugucgaggccggucgcacacuccgagugcuuaaucuggucgaaaacugguugaauaacaauacccaauucugcaucaaagugcugaaccccuacaugccgaguguuauagagaagauggaagcccuccagagaaaguacgggggagcguuaguaaggaauccucugucucggaacagcacgcacgagauguauugggugucaaacgcuuccggcaauaucgucaguagcgugaacaugauuucucgcaugcuuaucaauagauuuaccaugaggcacaaaaaggcaacauacgaaccagacguugaucugggcuccgggacucgaaacauuggaaucgagucagagacccccaaucuagacauaauugguaaacggaucgaaaagaucaaacaggagcaugaaacaagcuggcacuaugaucaggaccauccuuacaagacuugggccuaucacggcucguacgagaccaagcaaacagggucugcuaguuccauggugaacggagucgugcgucuccugaccaaaccaugggacguaauucccauggugacucagauggccaugacggauacaaccccguucggccagcagagaguuuuuaaggaaaaagucgacacucgcacccaagagccuaaggaggguaccaagaaguugaugaagauaacggcagaauggcuguggaaagagcucgggaagaaaaagacccccaggauguguacucgggaagaguucacaagaaaagugcgcagcaaugccgcucuuggagcgaucuuuaccgaugagaacaaguggaaaucagccagggaagcaguggaggacuccggcuucugggaacuggucgauaaggagcgaaauuuacaccuggaaggcaagugcgagacuuguguuuauaacaugauggggaaacgggagaagaaauugggagaauuugguaaggcuaaaggcucuagagccauuugguacauguggcucggggcaagguuccuggaguuugaagcccuaggauuccuuaaugaggaccauugguuuagccgcgaaaacagucuguccggcguggagggugaggggcuccacaagcugggauacaucuugcgugauguaagcaagaaagaaggcggcgcuauguaugccgacgauacagcggggugggacacccggauuacacuggaggaucucaagaaugaagagauggugacuaaccauauggaaggagagcacaagaaacuugcagaggccaucuucaaacugaccuaccagaauaaagucgugagaguucagaggccaacgccucgcgguaccgugauggacauaaucucucgacgggaccagagaggcucagggcaagucgugacauauggauuaaacacuuucaccaacauggaagcucagcugauuaggcagauggagggcgaagguguauuuaagaguauccaacaguugacaguuaaagaggagauugccgugaagaauuggcucauccgcgucgggagagaacggcuguccaggauggcaauuagcggagaugacugcguggugaaaccccuagaugaccguuucgcuucugcccuuacugcucugaacgauaugggcaagguccgaaaagacauacagcagugggagccaucgcgcggcuggaaugauuggacccaaguucccuuuugcucacaucacuuccacgaacucaucaugaaggacgggagagugcugguagugccuugucggaaccaggaugaguugauuggaagggcccgcaucagccagggugcaggcugguccuuaagagaaacggcgugccuggggaagaguuacgcccagauguggucucucauguauuuucaucggagggaccuucgacuggcugccaaugcaaucuguagcgcugucccaucccacuggauuccgacaucacguaccacuuggaguauacaugccacacacgaguggaugaccacugaggauaugcuaaccguguggaacagaguuuggauccaagaaaaucccuggauggaggacaaaacaccuguggaaucuugggaggaaauuccauaccugggaaagcgcgaggaucaguggugcggcagccucaucgguuugacgucccgggcaaccugggccaaaaacauucagacugcgaucaaucaggucaggucacugauagggaacgaggaauauacagacuacaugcccagcaugaagagauuccgccgggaggaagaggaagcuggagugcuuugguga

SEQ ID NO: 14313 - RNA, 9876 nt, Artificial Sequence
  derived and/or modified CDS sequence (opt3) from DENV-2__KX380813__SS-prME
accgccggcaucauuauaaugaugauccccacugugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguugcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggaguccgccgaaacacaacauggaacuauagucauuagagugcaguacgagggcgacgguagcccuugcaaaaucccauucgagaucauggauuuggaaaagaggcacguccucgggcggcugauuaccgugaaucccaucguuacggagaaagacucgccggugaacauugaagcugagccucccuuuggcgauucuuacauaaucauuggaguagaaccaggccaguuaaagcuguccugguucaaaaaggggucaaguaucggacagauguuugagaccacaaugcgaggugccaagcgcauggcaauccuaggcgacacugccugggauuucgggagccucggaggcgucuuuaccuccauugguaaagcucugcaucaaguguucggggcgauauauggcgcagccuuuucuggaguuagcuggacaaugaagauccuuauuggcguggucaucacuuggauugggaugaacucaagaaguaccuccuugagcgugucucugguacucgugggaguugucacgcuguaccuuggcgugauggugcaggcugacucagguugugucguuaguuggaaaaacaaggagcugaaaugcgggagcggaaucuucauaacagauaaugugcacaccuggacugaacaguauaaguuucagccugagucccccucuaaguuggccucggcaauccaaaaagcccacgaagagggcauuugugguaucaggagcgugacacggcucgaaaaccugauguggaagcagauuaccccagaguuaaaucauauccugacugagaacgaaguaaaacuaaccauaaugacaggcgacauuaaggggaucaugcaggcuggaaaacgcacgcucagaccccagccuaccgagcugaaguacuccuggaaagccuggggcaaggcaaagaugcuuucaacugaauugcacaaucauacauuccugauugaugggccagagaccgcggaaugcccgaacacaaauagggcuuggaacagucucgaggucgaggacuauggauuuggcguguucacuaccaauaucuggcugaaauuaaaggaacgucaagauguauuuugugacucuaaacugaugagcgccgcaauaaaggacaaccgggccgugcacgcugauauggguuacuggaucgaguccgcccuuaacgacacguggaaaauugaaaaggcaucauucaucgaggucaagagcugccacuggcccaaaucucauacauugugguccaauggggugcucgagagugaaaugauuaucccuaagaacuucgcuggaccaguuagccagcacaauuaucgacccggcuaccauacccagacugccgguccuuggcaccugggcagacuagagauggauuuugacuucugugaagggaccacagugguagucacugaggauugcggaaacaggggcccaucucugcgcaccacaacggcguccgggaaacucauaaccgaauggugcugucggucaugcacucugcccccgcuuagauacaggggagaggacggcuguugguaugguauggagauucgcccuuugaaggaaaaagaggaaaaucuggugaacaguuuagugacagccgggcauggacagaucgauaauuuuagccucggcguccuggguauggcucuuuuccuggaggaaauguugcgaacccggguuggcacuaagcacgcaauccuccugguggccguaucguuugugacacuaauuaccgggaacauguccuuccgugaccugggaagagucauggugaugguuggcgcuacgaugacugaugacaucgggaugggagugaccuaccucgcccugcuugcagcguuuaagauuaggccaacauucgccgcuggcuugcuguuacgcaaacucaccucuaaggagcugaugaugacuacaauagguaucguccuucugagccaaucaaccauucccgagaguauccuagaacucacagaugcccuggcauuggggaugauggugcugaaaauuguucggaauauggagaaguaucaguuagcugugacuaucauggccauacucugcgucccuaacgcaguaauccugcagaaugccuggaaaguguccuguaccacgcuugcuguugugucugucagcccccuguugcucacauccucacaacagaaggcggacuggauuccacuggcccuaaccaucaagggacugaacccuacugcaauuuuucuuaccacacucagcagaacaaguaaaaagaggucuuggccccugaaugaagcuaucauggccgugggcaugguauccauauuggccagcucgcugcuaaagaaugauauuccaaugaccggcccgcucguggcugggggacugcuuacggucugcuacguucugacaggucgaucagcagacuuggagcucgaacgcgccgcggacgugcggugggaggagcaggcugaaaucucuggcaguuccccuauccugagcauuaccauaucugaggaugggagcauguccaucaagaaugaagaggaggaacagacucuaacaauucugaucagaaccggacuucucgugauuucaggccuguuccccgucaguaucccaauaacugccgcagccugguauuugugggaggugaaaaagcaaagggcugguguuuuaugggacguacccagcccuccacccguggggaaagcagaacuggaggauggagccuaccguaucaagcagaagggcauucucggcuauucucagaucggggcgggagucuacaaagaagguacauuucacaccauguggcaugugacgcgcggcgcuguucugaugcacaaggggaaacggauugagccuuccugggccgacgugaagaaagaucuuaucucauacggaggcgguuggaagcuggagggggaauggaaggagggagaagagguccagguguuggcacuagaaccgggcaaaaacccaagagccguacaaacuaagcccggccuguucaaaaccaacacagggaccauaggagcugucagucucgacuuuagcccugguacauccggcucuccaauuguggauaagaaagggaagguugugggacuguauggcaauggugucgugacuaggucggggaccuacguuagcgccaucgcacagacggagaagucaaucgaggacaaccccgaaauugaggaugacaucuuccggaaaaagagacuuacaauaauggauuuacauccuggagcuggcaaaacuaagcgcuaucugccggccauugugagagaagcgaucaaaaggggccuccggaccuugauucuggcccccacacgagucguggcagcugagauggaagaggcccucagagggcugccaauccgcuaccagaccccugcuauaagggcagagcacacuggacgugaaauuguagaccuuaugugucaugccaccuucacaaugcggcuguugucccccaucagagugccaaauuauaaccuaaucauuauggaugaggcccacuuuacggacccugcuaguaucgcggcaagggguuacauuucuacucgcguugaaaugggcgaggccgcugggauauucaugaccgccacacccccaggaagccgagacccguuuccucaguccaaugcacccaucauggaugaggaaaaggagauuccagaaagaucauggaacucuggccacgagugggucaccgacuucaaggguaaaacugugugguuugugcccagcaucaaggccgggaaugauaucgcugcgugccugcggaaaaacggaaagaaagucauucaacucaguaggaagacauucgacuccgaauauauaaagacccgcacgaaugauugggacuuuguagugacuacagauaucagcgagaugggcgccaacuucaaagcagagcguguuauugacccuagacgguguaugaagccagugaucuuaaccgauggcgaagagagggucauucuggcugggcccaugccugugacccauucuucagccgcacagcgccgaggaagaguuggucggaauccgaaaaacgaaaaugaccaguacaucuacaugggcgagccacuugaaaacgaugaggacugcgcccacuggaaggaggcuaaaaugcugcucgacaauauaaacacucccgaagggaucauuccuuccauguuugagcccgaaagggagaagguggaugccaucgacggagaauaucgcuugagaggcgaggcgaggaaaacauucgucgaucugaugcggcguggugaccucccaguguggcuggcauaccgcguagccgcugaggggauuaacuaugccgaucgaagaugguguuuugacggcgugaagaauaaccaaauccuugaagagaauguugaagucgagauauggaccaaggagggagaaaggaaaaagcuaaaaccucgguggcuggaugcucgcauuuacagugaccccuuggcauuaaaggaguucaaagaguucgccgcuggcagaaagagccugacacucaaccugaucacugagauggggaggcuuccaacguuuaugacccagaaggccaaaaaugcacuggauaaccucgcgguguugcauacagccgaagcuggaggucgggccuauaaucacgcacugucggagcuaccugagacucuggaaacccuccuucuguuaacauugcuggcuaccgugacuggcgggauuuuccucuuucugaugucuggaaagggcaucgguaaaaugacgcuugggaugugcugcauaaucaccgccuccauucugcucugguacgcacagauccagccgcacuggauugccgcuagcaucauauuggaguucuuucugauugucuuacuaauccccgaaccagagaagcaacgaacaccucaggacaaccagcugacuuauguugugaucgcgauucucaccguaguggccgcaacaauggcuaaugaaaugggcuuccuugagaaaaccaagaaggauuuuggacugggcucaaucacuacacagcaacccgagaguaacauauuggacauugaucugagaccagccucugccuggacgcucuacgcagucgcuaccacuuucaucacaccuaugcugcgccauuccauugaaaauagcucagugaacguuagucuuaccgccaucgcgaaucaggcuaccgugcucauggggcugggaaaagguuggcccuugagcaagauggacauaggcgucccgcuguuagccaucggguguuacucccagguaaacccaauuacacuaacugcagcccugcuccuucugguggcucacuaugcaaucauuggaccuggcuugcaggccaaagcgacgagggaggcucaaaagcgggccgcagccgguaucaugaaaaaucccaccguugacgggaugacagugauugaucuggacccaauccccuacgauccuaaguuugaaaagcagcucggccaggucaugcugcuuguguuaugcgucacucaggugcugaugaugcguaccacaugggcucucugugaggccuugacccuggcaacuggaccgauaucuacgcuaugggaaggcaaccccgggagauucuggaauacaaccauugcuguuagcauggccaacaucuuuaggggauccuaucuggcgggcgccggucuccuuuucucaaucaugaaaaacacugcaaauacccgccgggggacaggaaacacuggcgagacccugggugagaaguggaaaaaucgauugaacgcucugggcaagucugaauuucaaauuuacaaaaagagugggauacaggagguggacagaacacucgccaaagaaggaaucaagaggggcgagacggaucaucacgcaguaucgcgcgggagcgcuaagcugcggugguucguggagagaaauuuagucaccccagaaggaaaaguuguggaccuuggcugcggucgugggggaugguccuauuacuguggcggucugaagaacgucaaagaggugaagggccucacuaaagggggaccuggccaugaagaacccauuccuaugucuacauauggguggaaucuaguaaggcugcagucaggaguggauguuuucuuuaccagcccagaaaagugcgacacuuugcugugugauaucggcgaguccagucccaacccuacaguggaggccggucggacccuccgcguccuuaaucugguggaaaacugguugaauaacaauacgcaauucugcauuaagguccugaacccauacaugcccucugugaucgagaaaauggaagcccuccagcgaaaguacgggggagcguuaguuagaaauccgcugagcaggaacucaacccacgagauguauuggguauccaacgcuaguggcaauauagugagcucugucaacaugaucucccggaugcuuauuaaucgcuuuacaaugagacacaaaaaggcaacuuacgaaccugacguggaucugggcucagggaccaggaacaucggaauugagagcgagacaccaaaucuagacaucauagguaaacgaauugaaaagaucaagcaggagcaugaaacuucguggcacuaugaucaggaccaucccuacaaaaccugggccuaucacggcucuuacgagacaaagcaaaccgggagugcuuccagcaugguuaacggagugguccggcuccugacuaaaccuugggacgugaucccaaugguaacgcagauggccaugacagauaccacucccuucggccagcagcguguguuuaaggaaaaaguugacaccagaacacaagagccgaaggaggguacgaagaaauugaugaagauuaccgcagaauggcuguggaaagagcucgggaagaaaaagacuccucgcauguguacaagggaagaguucacccggaaagucagaucaaaugccgcucuuggagcgauauuuacugaugagaacaaguggaaguccgcccgcgaagcaguggaggacucuggcuucugggaacugguggauaaagagaggaauuuacaccuggaaggcaagugcgagacaugugucuauaacaugauggggaaacgagagaagaaauugggagaauuugguaaggcuaagggcagccgggccaucugguacauguggcucggggcaagauuccuggaguuugaagcccuaggauuccuuaaugaggaccauugguuuaguagggaaaacucccugagcggcguugagggugaggggcuccacaaacugggauacauuuugcgcgaugugucuaagaaagaaggcggcgcuauguaugccgacgauaccgcggggugggacacacguaucacucuggaggaucucaagaaugaagagaugguaaccaaccauauggaaggagagcacaagaaacuugcagaggccauuuucaaacugacguaccagaauaaagugguccgggugcagagacccaccccaagggguacaguuauggacaucauaucacgccgagaccagcggggcagugggcaaguggucacuuauggauuaaacaccuucacaaacauggaagcucagcugaucagacagauggagggcgaagguguguuuaaguccauucaacaguugacuguaaaagaggagaucgccguuaagaauuggcucauuaggguggggcgcgaaagacugagccggauggcaaucucuggagaugacugcgucgugaaaccucuagaugacagguucgcuucggcccuuaccgcucugaacgauaugggcaaggugcguaaggacauucagcagugggagcccucacgaggcuggaaugauuggacgcaagucccauuuugcagccaucacuuccacgaacucauaaugaaagacgggcgcguucuggugguacccuguagaaaccaggaugaguugaucggacgggccaggauuucccagggugcaggcuggaguuuacgcgaaacagcgugccuggggaagucuuacgcccagauguggagccucauguauuuucauagacgggaccuuaggcuggcugccaaugcaaucuguuccgcugugccuucacacuggaucccaaccagucgaacuacauggucuauucaugccacccacgaguggaugacuaccgaggauaugcuaacagucuggaaccguguguggauacaagaaaauccguggauggaggacaaaacgcccguugaaagcugggaggaaaucccuuaccugggaaagagagaggaucaguggugcggcucccucauugguuugaccucacgcgcaacuugggccaaaaacauccagacagcgauuaaucaggugcggagccugaucgggaacgaggaauauaccgacuacaugccaucuaugaagagguucagacgcgaggaagaggaagcuggaguccuuugguga

SEQ ID NO: 14314 - RNA, 9876 nt, Artificial Sequence
  derived and/or modified CDS sequence (opt3) from DENV-2__KX380814__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaagauaaggccaacauucgccgcuggcuugcuguuacgcaaacucaccuccaaggagcugaugaugacuacaaucgguauuguccuucugucucaaagcaccauccccgagucaauucuagaacucacagaugcccuggcauuggggaugauggugcugaaaaucguucggaauauggagaaguaucaguuagcugugacuauaauggccauccucugcgucccuaacgcaguaauucugcagaaugccuggaaagugaguuguaccacgcuugcuguuguguccgucucuccccuguugcucacaagcucccaacagaaggcggacuggaucccacuggcccuaaccauuaagggacugaacccuacugcaaucuuucuuaccacacucucaagaacuagcaaaaagaggaguuggccccugaaugaagcuauaauggccgugggcaugguaucuauuuuggccuccagccugcuaaagaacgauaucccaaugaccggcccgcucguggcugggggacugcuuacggucugcuacguucugacaggucgaucggcagacuuggagcucgaacgcgccgcggacgugcggugggaggagcaggcugaaaucucaggcucuaguccuauucuguccauaaccaucagcgaggaugggucuaugagcauuaagaaugaagaggaggaacagacucuaacaauccugauuagaaccggacuucucgugaucuccggccuguuccccgucucaauaccaaucacugccgcagccugguauuugugggaggugaaaaagcaaagggcugguguuuuaugggacguacccaguccuccacccguggggaaagcagaacuggaggauggagccuaccguauuaagcagaagggcauccucggcuauagccagauuggggcgggagucuacaaagaagguacauuucacaccauguggcaugugacgcgcggcgcuguucugaugcacaaggggaaacggaucgagccuucuugggccgacgugaagaaagaucuuauauccuacggaggcgguuggaagcuggagggggaauggaaggagggagaagagguccagguguuggcacuagaaccgggcaaaaacccaagagccguacaaacuaagcccggccuguucaaaaccaacacagggaccauuggagcugucucacucgacuuuaguccugguacaagcggcuccccaaucguggauaagaaagggaagguugugggacuguauggcaauggugucgugacuaggucugggaccuacguuucggccaucgcacagacggaaaagagcauugaggacaaccccgaaaucgaggaugacauauuccggaaaaagagacuuacaauuauggauuuacauccuggagcuggcaaaacuaagcgcuaucugccggccaucgugagagaagcgauuaaaaggggccuccggaccuugauccuggcccccacacgagucguggcagcugagauggaagaggcccucagagggcugccaauacgcuaccagaccccugcuauuagggcagagcacacuggacgugaaaucguagaccuuaugugucaugccaccuucacaaugcggcuguugucacccaucagagugccaaauuauaaccuaauuaucauggaugaggcccacuuuacggacccugcuuccauugcggcaagggguuacauaaguacucgcguugaaaugggcgaggccgcugggaucuucaugaccgccacacccccaggaucucgagacccguuuccucagagcaaugcacccauuauggaugaggaaaaggagaucccagaaagauccuggaacucaggccacgagugggucaccgacuucaaggguaaaacugugugguuugugcccucuaucaaggccgggaaugauauugcugcgugccugcggaaaaacggaaagaaagucauacaacucagcaggaagacauucgacagugaauauaucaagacccgcacgaaugauugggacuuuguagugacuacagauauuuccgagaugggcgccaacuucaaagcagagcguguuaucgacccuagacgguguaugaagccagugauuuuaaccgauggcgaagagagggucauccuggcugggcccaugccugugacccauagcucugccgcacagcgccgaggaagaguuggucggaauccgaaaaacgaaaaugaccaguacauauacaugggcgagccacuugaaaacgaugaggacugcgcccacuggaaggaggcuaaaaugcugcucgacaauaucaacacucccgaagggauuaucccuucaauguuugagcccgaaagggagaagguggaugccauugacggagaauaucgcuugagaggcgaggcgaggaaaacauucgucgaucugaugcggcguggugaccucccaguguggcuggcauaccgcguagccgcugaggggaucaacuaugccgaucgaagaugguguuuugacggcgugaagaauaaccaaauacuugaagagaauguugaagucgagauuuggaccaaggagggagaaaggaaaaagcuaaaaccucgguggcuggaugcucgcaucuacuccgaccccuuggcauuaaaggaguucaaagaguucgccgcuggcagaaagagucugacacucaaccugauuacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgugacuggcgggaucuuccucuuucugaugucgggaaagggcauagguaaaaugacgcuugggaugugcugcaucauuaccgccucuauccugcucugguacgcacagauucagccgcacuggaucgccgcuuccauaauuuuggaguucuuucugaucgucuuacuaauccccgaaccagagaagcaacgaacaccucaggacaaccagcugacuuauguugugauugcgauccucaccguaguggccgcaacaauggcuaaugaaaugggcuuccuugagaaaaccaagaaggauuuuggacugggcagcauaacuacacagcaacccgagucaaacauuuuggacaucgaucugagaccagccagugccuggacgcucuacgcagucgcuaccacuuucauuacaccuaugcugcgccauucuaucgaaaauuccagcgugaacguuucacuuaccgccauagcgaaucaggcuaccgugcucauggggcugggaaaagguuggcccuugaguaagauggacaucggcgucccgcuguuagccauuggguguuacagccagguaaacccaaucacacuaacugcagcccugcuccuucugguggcucacuaugcaauuaucggaccuggcuugcaggccaaagcgacgagggaggcucaaaagcgggccgcagccgguauuaugaaaaaucccaccguugacgggaugacagugaucgaucuggacccaauacccuacgauccuaaguuugaaaagcagcucggccaggucaugcugcuuguguuaugcgucacucaggugcugaugaugcguaccacaugggcucucugugaggccuugacccuggcaacuggaccgauuuccacgcuaugggaaggcaaccccgggagauucuggaauacaaccaucgcuguuucuauggccaacaucuuuaggggaagcuaucuggcgggcgccggucuccuuuucuccauuaugaaaaacacugcaaauacccgccgggggacaggaaacacuggcgagacccugggugagaaguggaaaaaucgauugaacgcucugggcaagucagaauuucaaauauacaaaaagucugggauccaggagguggacagaacacucgccaaagaaggaauuaagaggggcgagacggaucaucacgcaguaagucgcgggucggcuaagcugcggugguucguggagagaaauuuagucaccccagaaggaaaaguuguggaccuuggcugcggucgugggggauggagcuauuacuguggcggucugaagaacgucaaagaggugaagggccucacuaaagggggaccuggccaugaggaacccaucccuauguccacauauggguggaaucuaguaaggcugcagucuggaguggauguuuucuuuaccucaccagaaaagugcgacacuuugcugugugauauuggcgagagcucccccaacccuacaguggaggccggucggacccuccgcguccuuaaucugguggaaaacugguugaauaacaauacgcaauucugcaucaagguccugaacccauacaugcccagugugauagagaaaauggaagcccuccagcgaaaguacgggggagcguuaguuagaaauccgcugucuaggaacagcacccacgagauguauuggguaucaaacgcuuccggcaauaucgugaguagcgucaacaugauuucucggaugcuuaucaaucgcuuuacaaugagacacaaaaaggcaacuuacgaaccugacguggaucugggcuccgggaccaggaacauuggaaucgagucagagacaccaaaucuagacauaauugguaaacgaaucgaaaagaucaagcaggagcaugaaacuagcuggcacuaugaucaggaccaucccuacaaaaccugggccuaucacggcucguacgagacaaagcaaaccgggucugcuaguuccaugguuaacggagugguccggcuccugacuaaaccuugggacgugauuccaaugguaacgcagauggccaugacagauaccacucccuucggccagcagcguguguuuaaggaaaaaguugacaccagaacacaagagccgaaggaggguacgaagaaauugaugaagauaaccgcagaauggcuguggaaagagcucgggaagaaaaagacuccucgcauguguacaagggaagaguucacccggaaagucagaagcaaugccgcucuuggagcgaucuuuacugaugagaacaaguggaagucagcccgcgaagcaguggaggacuccggcuucugggaacugguggauaaagagaggaauuuacaccuggaaggcaagugcgagacaugugucuauaacaugauggggaaacgagagaagaaauugggagaauuugguaaggcuaagggcucucgggccauuugguacauguggcucggggcaagauuccuggaguuugaagcccuaggauuccuuaaugaggaccauugguuuagcagggaaaacagucuguccggcguugagggugaggggcuccacaaacugggauacaucuugcgcgaugugagcaagaaagaaggcggcgcuauguaugccgacgauaccgcggggugggacacacguauuacucuggaggaucucaagaaugaagagaugguaaccaaccauauggaaggagagcacaagaaacuugcagaggccaucuucaaacugacguaccagaauaaagugguccgggugcagagacccaccccaagggguacaguuauggacauaaucucucgccgagaccagcggggcucagggcaaguggucacuuauggauuaaacaccuucacaaacauggaagcucagcugauuagacagauggagggcgaagguguguuuaagaguauccaacaguugacuguaaaagaggagauugccguuaagaauuggcucaucaggguggggcgcgaaagacugucccggauggcaauuagcggagaugacugcgucgugaaaccucuagaugacagguucgcuucugcccuuaccgcucugaacgauaugggcaaggugcguaaggacauacagcagugggagcccucgcgaggcuggaaugauuggacgcaagucccauuuugcucacaucacuuccacgaacucaucaugaaagacgggcgcguucuggugguacccuguagaaaccaggaugaguugauuggacgggccaggaucagccagggugcaggcugguccuuacgcgaaacagcgugccuggggaagaguuacgcccagauguggucucucauguauuuucauagacgggaccuuaggcuggcugccaaugcaaucuguagcgcugugccuucccacuggauuccaaccucacgaacuacauggaguauacaugccacccacgaguggaugacuaccgaggauaugcuaacagucuggaaccguguguggauccaagaaaauccguggauggaggacaaaacgcccguugaaucuugggaggaaauuccuuaccugggaaagagagaggaucaguggugcggcagccucaucgguuugaccucccgcgcaacuugggccaaaaacauucagacagcgaucaaucaggugcggucacugauagggaacgaggaauauaccgacuacaugccaagcaugaagagguucagacgcgaggaagaggaagcuggaguccuuugguga

SEQ ID NO: 14315 - RNA, 9876 nt, Artificial Sequence
  derived and/or modified CDS sequence (opt3) from DENV-2__KX380807__SS-prME
accgcaggaaucauuauaaugaugauccccacugugauggcuuuccaccugacuacgcgaaauggggagccucauaugauugucagcaggcaggaaaagggaaaaucccuccuuuuuaagaccgagaaugguguuaacaugugcacucugauggcaauggacuugggcgaauuaugugaggauacuaucaccuacaauugcccacugcuacggcaaaacgaaccggaggacauugauuguuggugcaauucuaccucaaccugggugacuuaugggaccuguaccgccacgggagagcaccgccgagaaaaacguaguguagcgcucgcuccccaugugggcaugggucuggagacucggaccgaaacauggaugagcuccgagggggccuggaagcacgcacagaggaucgagauauggguccuucggcauccuggauucacuaucauggccgcuauucuggcauacaccaucggcacaaccuauuuucagcgcguguugauuuucauccuccugacggccguugcuccaucuaugacuaugagaugcauaggcauuucgaacagggacuuuguggaaggggucucaggagguagcuggguggauaucguacuggagcacggcaguuguguuacaaccauggccaaaaauaagcccacucucgacuucgaauuaauuaagacagaggcgaaacacccugcaacccugcggaaguacugcaucgaagccaaacuuacgaacaccacaacugcuucccgcuguccaacccagggggagcccucuuugaaugaggaacaagauaagcgauuugugugcaaacauagcauggucgacagaggauggggcaacgguugugggcuguucggaaagggcggcaucgugacaugcgccauguuuacuugcaagaaaaauauggaggggaagauugugcagccugaaaaccuagaguauaccauagucaucacaccacacuccggagaagagaaugcaguugguaacgauaccggcaaacaugggaaggagauuaaagugacuccgcagucaaguaucacggaagcugagcucacaggauacggcaccguaacuauggaauguagccccaggaccggucuggacuucaaugagauggugcuucugcagauggaaaacaaggccugguugguccaccggcaaugguuucucgaucugccuuuaccauggcugcccggggcggacacacagggcucuaacuggauacagaaagagacccucgugacuuucaagaauccucacgccaagaaacaggauguugugguccuuggaucccaagagggcgcaaugcauacagcucugacgggggccaccgaaauucagaugucaagcggaaacuugcuauuuacuggucaccugaagugccgucuccgcauggacaaacugcagcuuaagggcaugaguuauucuauguguacagggaaauucaaggugguaaaggagaucgcugaaacccaacauggaacaaucguuauuagagugcaguacgagggcgacgguuccccaugcaaaauccccuucgagauuauggaucuggaaaagaggcacgucuuggggcggcucauaacugugaauccgaucgucaccgagaaagacagcccugugaacauugaagccgagcccccauuuggcgauucguacaucaucauuggaguugaaccuggccagcugaaguuaucuugguucaaaaagggguccucaauaggacagauguuugagacgaccaugcgaggugcaaagcgcauggccauccugggcgacacagcuugggauuucgggagucuaggaggcguguuuacuagcauugguaaagcgcuccaucaaguauucggggcaaucuauggcgccgcuuuuuccggagucucuuggaccaugaagauucugaucggcgugguuauaacauggaucgggaugaauagcagaucaacaagucuuuccgugagcuugguccuggugggaguagugacccucuaccugggcguuaugguccaggccgacucugguuguguggugucauggaaaaacaaggagcuuaaaugcgggaguggaauuuucaucacggauaauguccacacauggaccgaacaguauaaguuucagcccgagagcccauccaagcuggcaucugccauucaaaaagcucacgaagagggcaucugugguauaaggucgguuacucgguuggaaaaccucauguggaagcagauuacacccgagcugaaucauaucuuaagcgagaacgaagugaaacugaccauuaugacuggcgacaucaaggggauaaugcaggccggaaaacgcucccuaagaccucagccaaccgagcucaaguacucauggaaagcauggggcaaggcgaagaugcugaguacagaacuucacaaucauacguucuugaucgaugggccggagaccgcugaaugccccaacacuaauagggccuggaacucucuggagguggaggacuauggauuuggcguauucacaaccaauauuuggcucaaacugaaggaacgucaagaugucuuuugugacagcaaauuaauguccgcagccaucaaggacaaccgggcugugcacgccgauauggguuacuggauugagucagcacugaacgacacauggaaaaucgaaaaggcuagcuucauagagguuaagucuugccacuggccuaaaucccauacucuuuggaguaaugggguguuggagagcgaaaugauuaucccaaagaacuucgccggacccgucucucagcacaauuaucgaccuggcuaccauacccagacggcggguccauggcaccucggcagacuggagauggauuuugacuucugugaagggacaaccgugguugugacugaggauugcggaaacaggggccccucccuacgcaccacaacugccucagggaaacugaucaccgaauggugcugucggaguugcacacucccgccucugagauacaggggagaggacggcuguugguaugguauggagauucgcccacuuaaggaaaaagaggaaaauuugguaaacagccuggucacggcugggcauggacagaucgauaauuuuucguuaggcgugcucgguauggcacuguuccuugaggaaaugcugcgaacccgggugggcacuaagcacgccauuuugcucgucgcuguuuccuuugugacacugauaaccgggaacaugucuuuccgugaccuaggaagaguaauggugauggucggcgccacuaugacagauaauaucgggaugggagugaccuaccuggcacuccuggcggccuuuaagguuaggcccacguucgcugccggccuuuugcugcgcaaauuaacuagcaaggagcucaugaugaccacaauugguaucgugcugcuuucacaaaguaccauuccugagacuauccuggaacuaacagacgcacucgcucuggggaugauggucuugaaaauagugcggaacauggagaaguaucagcuggccguuaccaucauggcaauuuuaugcgugcccaaugccgucauccuccagaacgcuuggaaaguauccuguacaauucuggcggugguuucugugagcccacuucuguugacuuccucacaacagaaggccgauuggaucccucucgcacugaccauaaagggacuaaaucccacggcuauuuuucugacaacccuuagcagaacaaguaaaaagaggucuuggccacucaacgaagccaucauggccgucggcaugguguccauccuggcuagcucguugcugaaaaaugacauuccgaugaccggcccuuuaguagcagggggacuccugacagugugcuacguccuuacuggucgaucagccgaucuggaguuggaacgcgcggcugacguucggugggaggagcaggccgaaauaucuggcaguucccccauccucagcauuaccaucucugaggacgggagcauguccauuaagaacgaagaggaggaacagacgcugacaauccuaauaagaaccggacugcuugugaucucaggccucuucccagugaguauucccaucacugcagccgcuugguaucugugggaggucaaaaagcaaagggccgguguguugugggauguuccuagcccacccccuguagggaaagccgaauuagaggacggagcguaccguauuaagcagaagggcauccugggcuauucucagauaggggcuggaguguacaaagaagguacauuucacaccauguggcaugucacucgcggcgccgugcucaugcacaaggggaaacggauugagccguccugggcagauguuaagaaagaccugaucucauacggaggcgguuggaaacuugagggggaauggaaggagggagaagaggugcagguccuggccuuggaaccaggcaaaaaccccagagcugugcaaacaaagccuggccuauucaaaaccaauacggggacuaucggagccguaagucuggauuuuagcccagguaccuccggcucucccauugucgacaagaaagggaaggugguuggacucuauggcaacgguguggucacaaggucggggaccuacgugagcgcaaucgcucagacagagaagucaauagaggauaauccugaaauugaggacgauaucuucagaaagaagcggcugacuauuauggaccuucauccgggagccggcaaaaccaagcgcuauuuacccgcgaucguuagagaagccauaaaaaggggccugcggacgcucauuuuggcaccaacacgaguggucgcugccgagauggaagaggcucugagagggcucccuauccgcuaccagacucccgcaaucagggccgagcacaccggacgugaaauuguggaucugaugugucaugccacauucaccaugcggcuucuguccccaaucagaguaccuaacuauaauuugauuauaauggacgaggcucacuuuacugaucccgcgaguaucgcagccagggguuacauuucuacccgcguggaaaugggcgaggcugccgggaucuucaugacagcaacgccaccgggaagccgagacccuuuuccccaguccaacgccccaaucauggacgaggaaagagagauucccgaacggucauggaacucuggccacgaguggguuacugauuucaaggguaagaccgucugguuugugccuagcauaaaagcugggaacgacaucgcggccugccuaaggaagaauggcaagaaggugauucaacugagucgcaaaacauucgauuccgaauauaucaagacccguacuaacgacugggauuuugucguaacaaccgacauuagcgagaugggcgcaaauuucaaggcugagagagugaucgauccacggagguguaugaaacccguuauacucacggacggcgaagaacgcgugaucuuagccgggccuaugccggucacucauucuucagcagcccagcgaagaggacggguggguaggaacccaaagaaugaaaacgaucaguacauuuacaugggcgagccccuggaaaaugacgaggauugcgcucacuggaaagaggccaagaugcuucuggacaacaucaacacaccugaagggauuauccccuccauguuugagccagaacgcgagaaaguugacgcgguggauggagaauauagacucaggggcgaggcacggaagaccuucgucgacuugaugcgucgcggugaucugccuguguggcucgccuacaaaguagcugccgaggggauaaauuaugcugaccgaagaugguguuuugauggcgugaagaacaaucaaauucuggaagagaacguugaagucgagaucuggaccaaggagggagaaaggaagaaacuuaaaccccgguggcuagacgcacgcauuuacagugauccacuggccuugaaagaguucaaagaguucgcugccggcagaaagagcuuaacucugaaucucaucacagagauggggaggcugccuaccuuuaugacacagaaggcacggaacgcgcuugacaaucuggccgugcuccauacugcugaagccggaggucgagcauauaaccacgcuuugucggagcugccggagacgcuagaaacccugcuccuucugacauuauuggccacugugaccggcgggauauuccuguuucucaugucuggaaaaggcaucgguaagaugacacuggggaugugcugcauuaucaccgcauccauucuucugugguacgcccagauccagccccacuggauagcugcgagcauuauccucgaguucuuuuugaucguccuguuaauuccagaaccugagaaacaaagaacuccccaggauaaucagcuaacguauguugugaucgccauacugaccguaguggcagcuacaauggccaacgaaaugggcuuccucgagaagacuaaaaaggacuuuggacuuggcucaauuaccacacagcaaccagagaguaauauccuggauauugacuugcgcccugccucugcauggacccuguacgcugucgccacuacauucaucacgcccaugcucaggcauuccauagaaaacagcucagugaauguuagucugaccgcgaucgcuaaccaggccacugugcuuauggggcucggaaaggguuggccgcugagcaaaauggauauuggcgucccauugcuggcaaucggguguuacucccagguaaauccuauuacauuaaccgccgcucuacugcuccuuguggcacacuaugccaucauuggacccggccugcaggcgaaggcuacccgggaggcccaaaaacguacagcagccgguaucaugaagauaccagcugccuugauuguuacugugaucgaccuggaccccaucccuuacgauccgaaauuugaaaagcagcucgggcaggucaugcugcuuguguuaugcucuacgcagguccugaugaugagaaccacaugggcacucugugaggcuuugacucuggccaccggccccauuagcacacuaugggaaggaaacccaggcagguucuggaauaccacuauagcgguguccauggccaacaucuuucgcgggucauaucuggcaggagcuggccuccuuuucucuauuaugaagaacacggccaauacacggcgagguaccgggaacacuggagagacccugggcgagaaauggaagaauagauugaacgcacuggguaaaagugaauuucaaaucuacaagaaaucgggcauucaggagguugacaggacacucgcuaaggaagggaucaaacgcggagagacugaucaucacgccgugagccggggcuccgccaagcugagaugguucguagagcguaauuuagugaccccugaagggaaggucguugaccuuggaugcggcagggguggguggucuuauuacuguggaggccugaaaaacgugaaggaggucaaaggucucacaaagggcgggcccggacaugaagaaccuauaccaaugucaacguauggcuggaaucuagugcggcugcagagcgggguagauguguucuuuacacccccugaaaaaugcgacacuuugcugugugauaucggagaguccaguccaaaccccacaguugaggcgggccgcacccuccgagugcuuacucuggucgaaaauugguugaacaauaacacacaauucugcauuaaggugcugaauccguacaugccuucugucaucgagaagauggaagcucuccagagaaaauacgguggggcauuagugaggaacccacugagcagaaauucaacccacgagauguauuggguuuccaacgccaguggaaacauuguaagcucugugaauaugaucucccgcaugcuuauaaacagauuuacgaugaggcacaagaaagcuaccuacgaacccgacgucgaucugggcucaggcacacgaaauauugggaucgagagcgagacuccuaaccuagacaucauuggaaagcggauagagaaaaucaagcaggagcaugaaaccucguggcacuaugaucaggaccauccauacaagacaugggccuaucacgguucuuacgagacuaaacaaaccggcagugcauccagcauggugaaugggguugugcgucuccugacaaagcccugggaugucauuccgauggugacccagauggccaugacugacacgacaccuuucggacagcagagaguauuuaaagaaaagguggacacccgcacucaagagcccaaagagggcaccaagaaguugaugaaaaucacagcugaauggcuguggaaggagcucgguaaaaagaaaacgccaaggauguguacccgggaagaguucacuagaaagguucgcucaaacgcggcccuuggggcaauuuuuacagaugagaauaaauggaaguccgcuagggaagccgucgaggacucuggauucugggaacugguggauaaggagcgaaacuuacaccuggaaggcaaaugcgagaccuguguguauaauaugaugggcaagcgggagaaaaaguugggggaauuuggaaaagcaaaggguagcagagccaucugguacauguggcucggcgcuagguuccuggaguuugaagcccuaggguuccuuaacgaggaccauugguuuagucgcgaaaauucccugagcggagucgagggcgagggucuccacaagcugggguacauauugcgugauguuucuaaaaaggaaggaggcgcgauguaugcagacgauacugccggcugggacacacggaucacccuggaggaucucaaaaacgaagagauggugacaaaucauauggaaggggagcacaagaaacuugcugaggccauuuucaagcugacuuaccagaacaagguagugagaguccagaggccuacaccccgcggaacggugauggacaucauuucacgacgggaucagagagguaguggccaaguugugaccuauggguuaaauacauucacuaacauggaagcacagcugaucaggcagauggagggagaaggcgucuuuaaauccauucaacaguugaccgcuacagaggagauagccgugaagaacuggcucguacgcguugguagagaacggcugagcaggauggcuaucucuggggacgacugcguggucaaaccacuagaugaccguuucgccucggcacuuacugcgcugaaugauaugggaaaggugcgaaaagacauucagcagugggagcccucacgcggcuggaacgauuggacccaagugccuuuuugcagccaucacuuccacgaacucaucaugaaggacggcagaguccugguugugccaugucggaaucaggaugaguugaucgggagggcccgcauuucccagggagcugguuggaguuuaagagaaacggccugccugggcaagucuuacgcacagauguggagccucauguauuuucaucggagggaccuucgacuggcugccaacgcaauauguuccgccguaccgucacacugggugcccacaagucguaccacuuggucuauccaugcgacacacgaguggaugaccacugaggauaugcuaaccgucuggaauagaguguggauucaagaaaacccuuggauggaggacaaaacaccaguugaaagcugggaggaaauccccuaccuggggaagcgcgaggaucaguggugcggaucccucauuggcuugacgucacgggcuaccugggccaaaaauauccagacugcaauaaaccaggugaggagccugaucgguaaugaggaauauacagacuacaugccuucuaugaagagauuccgccgggaggaagaggaagccgggguccuuugguga

SEQ ID NO: 14316 - RNA, 9876 nt, Artificial Sequence
  derived and/or modified CDS sequence (opt3) from DENV-2__KX380815__SS-prME
accgcaggaaucauuauaaugaugauccccaccgugauggcuuuccaccugacuacgcgaaauggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaacugagaacgaagugaaacugaccaucaugacaggcgacauuaaggggaucaugcaggcuggaaaacgcagccuaagaccucagccaacggagcucaaguacuccuggaaagccuggggcaaggcaaagaugcugucaaccgaacuucacaaucauacuuucuugauagaugggccggagacagcggaaugccccaacaccaauagggcuuggaacagucuggagguagaggacuauggauuuggcgucuucacaacuaauaucuggcucaaacugaaggaacgucaagaugugucuugugacagcaaauuaauguccgccgcaauuaaggacaaccgggccguucacgcugauauggguuacuggaucgagucagcccugaacgacaccuggaaaauugaaaaggccagcuuuaucgaggugaagucuugccacuggccuaaaucccauacgcuuuggaguaauggggucuuggagagcgaaaugauaauuccaaagaacuucgcuggacccgugucucagcacaauuaucgaccuggcuaccauacacagaccgccgguccauggcaccucggcagacuggagauggauuucgacuuuugugaagggacuaccguugugguaacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuuggucaacagccuggugacugccgggcauggacagauugauaauuucucguuaggcgugcucgguauggcucuguuucuugaggaaaugcugcgaacacgggucggcaccaagcacgcaaucuugcucguugccguguccuucguaacucugauuacagggaacaugucuuuucgugaccuaggaagagugauggucauggugggcgcuaccaugacggaugacauagggaugggaguuacuuaccuggcccuccuggcagcguucaaggugaggcccaccuuugccgcuggccuuuugcugcgcaaauuaacaagcaaggagcucaugaugaccacuaucgguauuguccugcuuucacaaaguacaaucccugagaccauucuggaacuaacagaugcccucgcacuggggaugaugguguugaaaaucguucggaauauggagaaguaucagcuggcugugacuauaauggccaucuuaugcguccccaacgcaguaauucuccagaaugccuggaaaguguccuguaccacgcuggcuguugugucugucagcccacuucuguugacauccucacaacagaagaccgacuggaucccucucgcgcugacuauuaagggacuaaaccccaccgccaucuuccugacaacucuuagcagaaccaguaaaaagaggucuuggccacucaaugaagcaauaauggcugugggcaugguauccauucuggccagcucguuuuugaaaaacgauaucccgaugacgggcccucugguggccgggggauuacucacagucugcuacguucugaccggucgaucagcugaccuugagcuggaacgcgcagccgacauccggugggaggagcaggcggaaauuucuggcaguucccccauauugagcaucacuauuucugaggaugggagcauguccaucaagaaugaagaggaggaacagacacucaccauucugaucagaacuggacuacuggugauaucaggccuuuucccagugaguauccccauuacagcugccgcaugguaucucugggaggucaaaaagcaaagggccggugugcugugggacguuccuagcccacccccuguagggaaagcugaauuggaggauggagcauaccguaucaagcagaagggcauuuuaggcuauucucagaucggggccggaguguacaaagaagguaccuuucacacgauguggcaugucacucgcggcgcggugcugaugcacaaggggaaacggauagagccguccugggcugacguuaagaaagaucucauuucauacggaggcgguuggaagcuggagggggaauggaaggagggagaagaggugcagguccuugcccuggaaccaggcaaaaaccccagagcagugcaaaccaagccuggcuuguucaaaacaaacaccgggacaaucggagccguaagucuagacuuuagcccagguacuuccggcucucccaucgucgauaagaaagggaaggugguuggacuguauggcaaugguguggucaccaggucggggacguacgugagcgcuauugcccagacagagaagaacaucgaggacaauccugaaauagaggaugacauuuuccggaaaaagagacucacuaucauggaucugcauccgggagcaggcaaaaccaagcgcuaucuucccgcuauuguuagagaagccaucaaaaggggcuuacggacacugauacucgcgccaacccgaguggucgccgcagagauggaagaggcuuugagagggcugccuauucgcuaccagacucccgccaucagggcugagcacaccggacgugaaaucguggaccucaugugucaugcaacauucacgaugcggcugcuuucaccaauuagaguaccuaacuauaaucugaucauuauggaugaggcccacuuuacugaccccgccuccauagcugcgagggguuacaucaguacccgcguggaaaugggcgaggcagccgggauuuucaugacagcuaccccaccgggaucucgagacccuuuuccccagagcaacgccccaaucauggaugaggaaagagagauccccgaacgguccuggaacucaggccacgaguggguuacugacuucaaggguaagacagucugguuugugccuucuauuaaagcagggaacgauauagccgcuugcuugaggaagaauggcaaaaaggugauccaacuaagccgcaaaaccuucgacagugaauaugucaagacgcguacuaacgauugggacuuuguagugacaaccgauauuuccgagaugggcgcgaauuucaaggccgagagaguuaucgacccacggagguguaugaaacccgugauucugaccgauggcgaagaacgcgucauccucgcagggccuaugccggugacucauagcucugcugcccagcgaagaggacggguugguaggaacccaaagaaugaaaacgaccaguacauauacaugggcgagcccuuagaaaaugaugaggacugcgcacacuggaaagaggccaagaugcugcuugacaacaucaacacaccugaagggauuauccccucaauguuugagccagaacgcgagaaaguggaugcuauugacggagaauauagacugaggggcgaggcccggaagaccuucgucgaucucaugcgucgcggugacuugccuguguggcuggcguaccgaguagcagccgaggggaucaauuaugcugauagaaggugguguuuugacggcgugaaaaacaaucaaauacucgaagagaacguugaagucgagauuuggacaaaggagggagaacggaagaaacugaagccccgcuggcuugaugccagaaucuacuccgacccacuagcucugaaagaguucaaggaguucgcagccggcaggaaaaguuugacuuuaaaucugauuacggagauggggcggcucccuaccuuuaugacacagaaggcucgaaacgcccuggauaaucuugcagugcugcauacugcggaagccggagguagagcuuauaaccacgcccucagcgaguugccggagacccuggaaacacuacugcuccuuacccuguuagcaacugugacgggcgggaucuucuuguuucugaugucgggaaagggcauagguaaaaugacccucgggaugugcugcaucgucacagcuucuauucugcuuugguacgcccagauccagccccacuggauugcagccuccaucauacuggaguucuuucucauuguuuugcugaucccagaaccugagaagcaacgcacuccccaggacaaucaguuaaccuaugugguaaucgcuauucuaacaguggucgcggccaccauggcaaacgaaaugggcuuccuggagaaaacuaagaaagauuuuggacucggcagcaucacaacgcagcaaccagagucaaauauacuugacauugaucugaggccugcuagugccuggaccuuguacgccguggcaacuacauucaucacccccaugcugcggcauucuauugaaaacuccagcguuaaugugucacucaccgcuaucgccaaccaggcgacaguccugauggggcuuggaaaggguuggccgcucaguaagauggacauaggcguaccacuguuggcuaucggguguuacagccaggugaauccuauuacucugacggccgcauuacuacugcucguugcccacuaugcuaucauuggacccggccuucaggcaaaagccacccgugaggcgcaaaagagagcugccgcagguaucaugaaaauuccagccgcucugaucaugacagugauagacuuggaucccauuccuuacgacccgaaguuugaaaaacagcuggggcaggucaugcuccuggugcuuugcuccacucaggucuuaaugaugaggaccacaugggcccugugugaggcacucaccuuggcuacuggccccaucucuacgcugugggaaggaaacccaggccgcuucuggaauacaaccaucgccgugagcauggcgaacauuuuucggggguccuaucuagccggagcaggccuacucuucucaauaaugaagaacacugcuaauacccgaagagguacagggaacacuggagagacccuuggcgagaaguggaaaaaucaacugaacgccuuggguaagucugaauuucagaucuacaaaaagaguggcauucaggagguugauaggacacuggcaaaagaagggaucaagcgcggagagacggaccaucacgcugugucgcggggcagcgccaaacucagaugguucguagagcguaaucuggugaccccugaagggaaggucguugauuuaggaugcggcaggggugggugguccuauuacuguggaggccuuaagaacgugaaagaggucaagggucugacuaaaggcgggcccggacaugaggaaccuauuccaaugucuacauauggcuggaaucucgugcggcuacaaucagggguagacguguucuuuacacccccugaaaagugcgauacucuguugugugacaucggagagagcuccccaaaccccacaguugaggccggccgcacccugcgagugcucaaucuugucgaaaacuggcugaauaacaauacgcaguucugcauaaaaguguugaacccguacaugccuagugucaucgagaagauggaagcgcugcagagaaaguacgguggggcucucgugaggaauccauuaucucggaacagcacccacgagauguauuggguuucaaacgcauccggaaauauuguaaguagcgugaacaugaucucucgcaugcugauuaauagauuuacaaugaggcacaaaaaggccacuuacgaacccgaugucgaccuuggcuccggcacccgaaacaucgggauagagucagaggugccuaaucuggauauuaucggaaaacggaucgaaaagauuaaacaggagcaugaaacaagcuggcacuaugaccaagaucauccauacaagacuugggcuuaucacgguucguacgagaccaagcagacaggcucugccaguuccaugguuaacggggugguccgucuacucaccaaacccugggacgugauaccgaugguaacucagauggcaaugacggacacaaccccuuucggacagcaaagaguguuuaaggaaaaaguugauacucgcacccaggagcccaaggagggcaccaaaaagcugaugaagaucacggccgaaugguuguggaaagagcuggguaagaaaaagaccccaaggauguguacucgggaagaguucacaagaaaaguccgcagcaaugcugcgcucggggccauuuuuaccgacgagaacaaguggaaaucagcaagggaagcuguggaggauuccggauucugggaacuuguggacaaggagcgaaaucugcacuuagaaggcaagugcgagacuugugucuauaacaugaugggcaaacgggagaagaaacugggggaauuuggaaaggccaaagguucuagagcaaucugguacaugugguugggcgccagguuccucgaguuugaagcucugggguuccuaaaugaggaucauugguuuagccgcgaaaacagucuuuccggaguugagggcgagggucugcacaagcucggguacauucugcgugacgugagcaagaaagaaggaggcgccauguaugcggaugacacagcaggcugggauacccggaucacauuggaggaccugaagaaugaagagaugguaacuaaccauauggaaggggagcacaaaaagcucgccgaggcuauauucagacuuaccuaccagaauaaaguggucagggugcagcgcccuacgccccgaggaaccguuauggauaucauuucucggagagaccaaagggguucaggccagguggucacauaugggcugaacacuuucaccaacauggaagcccaguuaauccgccaaauggagggagaaggcguguuuaagaguauucagcaucugacagcaacugaggagaucgcuguaaagaauugguugguuagagugggucgggaaaggcucucccguauggccauuagcggggacgauugcgucgugaaaccacuggacgaucgauucgcuaacgcccuaaccgcacuuaaugacaugggaaaggugcgcaaagauauacagcagugggagcccucuagaggcuggaacgacuggacgcaagucccuuuuugcucgcaccacuuccaugaacugaucaugaaggauggccggguucucgugguaccauguaggaaucaggacgagcugauugggcgcgcgagaaucucacagggagccgguuggagcuugcgggaaacagcuugcuuaggcaaauccuacgcccagauguggagucugauguauuuucacaggcgagaucuccgucuugcagcuaacgccaucuguucugcagugccgagccauuggguccccaccuccagaacuacauggucaauucacgccacccacgaguggaugacuaccgaggacaugcugacaguguggaaucgcguuuggauacaagaaaacccuuggauggaggauaagacgccaguggaaaguugggaggaaauccccuaccuagggaagcgggaggaccaguggugcggaucucugauuggccucaccagcagggcgacuugggcuaaaaauauccagacagccauuaaccaggucagauccuugaucgguaaugaggaauauaccgauuacaugccuucaaugaagcgcuuccggagggaggaagaggaagcaggggugcugugguga

SEQ ID NO: 14317 - RNA, 9876 nt, Artificial Sequence
  derived and/or modified CDS sequence (opt3) from DENV-2__KX380816__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaagauaaggccaacauucgccgcuggcuugcuguuacgcaaacucaccuccaaggagcugaugaugacuacaaucgguauuguccuucugucucaaagcaccauccccgagucaauucuagaacucacagaugcccuggcauuggggaugauggugcugaaaaucguucggaauauggagaaguaucaguuagcugugacuauaauggccauccucugcgucccuaacgcaguaauucugcagaaugccuggaaagugaguuguaccacgcuugcuguuguguccgucucuccccuguugcucacaagcucccaacagaaggcggacuggaucccacuggcccuaaccauuaagggacugaacccuacugcaaucuuucuuaccacacucucaagaacuagcaaaaagaggaguuggccccugaaugaagcuauaauggccgugggcaugguaucuauuuuggccuccagccugcuaaagaacgauaucccaaugaccggcccgcucguggcugggggacugcuuacggucugcuacguucugacaggucgaucggcagacuuggagcucgaacgcgccgcggacgugcggugggaggagcaggcugaaaucucaggcucuaguccuauucuguccauaaccaucagcgaggaugggucuaugagcauuaagaaugaagaggaggaacagacucuaacaauccugauuagaaccggacuucucgugaucuccggccuguuccccgucucaauaccaaucacugccgcagccugguauuugugggaggugaaaaagcaaagggcugguguuuuaugggacguacccaguccuccacccguggggaaagcagaacuggaggauggagccuaccguauuaagcagaagggcauccucggcuauagccagauuggggcgggagucuacaaagaagguacauuucacaccauguggcaugugacgcgcggcgcuguucugaugcacaaggggaaacggaucgagccuucuugggccgacgugaagaaagaucuuauauccuacggaggcgguuggaagcuggagggggaauggaaggagggagaagagguccagguguuggcacuagaaccgggcaaaaacccaagagccguacaaacuaagcccggccuguucaaaaccaacacagggaccauuggagcugucucacucgacuuuaguccugguacaagcggcuccccaaucguggauaagaaagggaagguugugggacuguauggcaauggugucgugacuaggucugggaccuacguuucggccaucgcacagacggaaaagagcauugaggacaaccccgaaaucgaggaugacauauuccggaaaaagagacuuacaauuauggauuuacauccuggagcuggcaaaacuaagcgcuaucugccggccaucgugagagaagcgauuaaaaggggccuccggaccuugauccuggcccccacacgagucguggcagcugagauggaagaggcccucagagggcugccaauacgcuaccagaccccugcuauuagggcagagcacacuggacgugaaaucguagaccuuaugugucaugccaccuucacaaugcggcuguugucacccaucagagugccaaauuauaaccuaauuaucauggaugaggcccacuuuacggacccugcuuccauugcggcaagggguuacauaaguacucgcguugaaaugggcgaggccgcugggaucuucaugaccgccacacccccaggaucucgagacccguuuccucagagcaaugcacccauuauggaugaggaaaaggagaucccagaaagauccuggaacucaggccacgagugggucaccgacuucaaggguaaaacugugugguuugugcccucuaucaaggccgggaaugauauugcugcgugccugcggaaaaacggaaagaaagucauacaacucagcaggaagacauucgacagugaauauaucaagacccgcacgaaugauugggacuuuguagugacuacagauauuuccgagaugggcgccaacuucaaagcagagcguguuaucgacccuagacgguguaugaagccagugauuuuaaccgauggcgaagagagggucauccuggcugggcccaugccugugacccauagcucugccgcacagcgccgaggaagaguuggucggaauccgaaaaacgaaaaugaccaguacauauacaugggcgagccacuugaaaacgaugaggacugcgcccacuggaaggaggcuaaaaugcugcucgacaauaucaacacucccgaagggauuaucccuucaauguuugagcccgaaagggagaagguggaugccauugacggagaauaucgcuugagaggcgaggcgaggaaaacauucgucgaucugaugcggcguggugaccucccaguguggcuggcauaccgcguagccgcugaggggaucaacuaugccgaucgaagaugguguuuugacggcgugaagaauaaccaaauacuugaagagaauguugaagucgagauuuggaccaaggagggagaaaggaaaaagcuaaaaccucgguggcuggaugcucgcaucuacuccgaccccuuggcauuaaaggaguucaaagaguucgccgcuggcagaaagagucugacacucaaccugauuacugagauggggaggcuuccaacguuuaugacccagaaggccaaaaaugcacuggauaaccucgcgguguugcauacagccgaagcuggaggucgggccuauaaucacgcacugagcgagcuaccugagacucuggaaacccuccuucuguuaacauugcuggcuaccgugacuggcgggaucuuccucuuucugaugucgggaaagggcauagguaaaaugacgcuugggaugugcugcaucauuaccgccucuauccugcucuggcacgcacagauucagccgcauuggaucgccgcuuccauaauuuuggaguucuuucugaucgucuuacuaauccccgaaccagagaagcaacgaacaccucaggacaaccagcugacuuacguugugauugcgauccucaccguaguggccgcaacaauggcuaaugaaaugggcuuccuugagaaaaccaagaaggauuuuggacugggcagcauaacuacacagcaacccgagucaaacauuuuggacaucgaucugagaccagccagugccuggacgcucuaugcagucgcuaccacuuucauuacaccuaugcugcgccacucuaucgaaaauuccagcgugaacguuucacuuaccgccauagcgaaucaggcuaccgugcucauggggcugggaaaagguuggcccuugaguaagauggacaucggcgucccgcuguuagccauuggguguuacagccagguaaacccaaucacacuaacugcagcccugcuccuucugguggcucauuacgcaauuaucggaccuggcuugcaggccaaagcgacgagggaggcucaaaagcgggccgcagccgguauuaugaaaaaucccaccguugacgggaugacagugaucgaucuggacccaauacccuaugauccuaaguuugaaaagcagcucggccaggucaugcugcuuguguuaugcgucacucaggugcugaugaugcguaccacaugggcucucugugaggccuugacccuggcaacuggaccgauuuccacgcuaugggaaggcaaccccgggagauucuggaauacaaccaucgcuguuucuauggccaacaucuuuaggggaagcuaccuggcgggcgccggucuccuuuucuccauuaugaaaaacacugcaaauacccgccgggggacaggaaacacuggcgagacccugggugagaaguggaaaaaucgauugaacgcucugggcaagucagaauuucaaauauauaaaaagucugggauccaggagguggacagaacacucgccaaagaaggaauuaagaggggcgagacggaucaccaugcaguaagucgcgggucggcuaagcugcggugguucguggagagaaauuuagucaccccagaaggaaaaguuguggaccuuggcugcggucgugggggauggagcuacuauuguggcggucugaagaacgucaaagaggugaagggccucacuaaagggggaccuggccacgaggaacccaucccuauguccacauacggguggaaucuaguaaggcugcagucuggaguggauguuuucuuuaccucaccagaaaagugcgacacuuugcugugugauauuggcgagagcucccccaacccuacaguggaggccggucggacccuccgcguccuuaaucugguggaaaacugguugaauaacaauacgcaauucugcaucaagguccugaacccauauaugcccagugugauagagaaaauggaagcccuccagcgaaaguacgggggagcguuaguuagaaauccgcugucuaggaacagcacccacgagauguacuggguaucaaacgcuuccggcaauaucgugaguagcgucaacaugauuucucggaugcuuaucaaucgcuuuacaaugagacauaaaaaggcaacuuaugaaccugacguggaucugggcuccgggaccaggaacauuggaaucgagucagagacaccaaaucuagacauaauugguaaacgaaucgaaaagaucaagcaggagcacgaaacuagcuggcauuacgaucaggaccaccccuauaaaaccugggccuaccacggcucguaugagacaaagcaaaccgggucugcuaguuccaugguuaacggagugguccggcuccugacuaaaccuugggacgugauuccaaugguaacgcagauggccaugacagauaccacucccuucggccagcagcguguguuuaaggaaaaaguugacaccagaacacaagagccgaaggaggguacgaagaaauugaugaagauaaccgcagaauggcuguggaaagagcucgggaagaaaaagacuccucgcauguguacaagggaagaguucacccggaaagucagaagcaaugccgcucuuggagcgaucuuuacugaugagaacaaguggaagucagcccgcgaagcaguggaggacuccggcuucugggaacugguggauaaagagaggaauuuacaucuggaaggcaagugcgagacaugugucuacaacaugauggggaaacgagagaagaaauugggagaauuugguaaggcuaagggcucucgggccauuugguauauguggcucggggcaagauuccuggaguuugaagcccuaggauuccuuaaugaggaccacugguuuagcagggaaaacagucuguccggcguugagggugaggggcuccauaaacugggauacaucuugcgcgaugugagcaagaaagaaggcggcgcuauguacgccgacgauaccgcggggugggacacacguauuacucuggaggaucucaagaaugaagagaugguaaccaaccacauggaaggagagcauaagaaacuugcagaggccaucuucaaacugacguaucagaauaaagugguccgggugcagagacccaccccaagggguacaguuauggacauaaucucucgccgagaccagcggggcucagggcaaguggucacuuacggauuaaacaccuucacaaacauggaagcucagcugauuagacagauggagggcgaagguguguuuaagaguauccaacaguugacuguaaaagaggagauugccguuaagaauuggcucaucaggguggggcgcgaaagacugucccggauggcaauuagcggagaugacugcgucgugaaaccucuagaugacagguucgcuucugcccuuaccgcucugaacgauaugggcaaggugcguaaggacauacagcagugggagcccucgcgaggcuggaaugauuggacgcaagucccauuuugcucacaccacuuccaugaacucaucaugaaagacgggcgcguucuggugguacccuguagaaaccaggaugaguugauuggacgggccaggaucagccagggugcaggcugguccuuacgcgaaacagcgugccuggggaagaguuaugcccagauguggucucucauguacuuucacagacgggaccuuaggcuggcugccaaugcaaucuguagcgcugugccuucccauuggauuccaaccucacgaacuacauggaguauacacgccacccacgaguggaugacuaccgaggauaugcuaacagucuggaaccguguguggauccaagaaaauccguggauggaggacaaaacgcccguugaaucuugggaggaaauuccuuaucugggaaagagagaggaucaguggugcggcagccucaucgguuugaccucccgcgcaacuugggccaaaaacauucagacagcgaucaaucaggugcggucacugauagggaacgaggaauacaccgacuauaugccaagcaugaagagguucagacgcgaggaagaggaagcuggaguccuuugguga

SEQ ID NO: 14318 - RNA, 9876 nt, Artificial Sequence
  derived and/or modified CDS sequence (opt3) from DENV-2__KX380817__SS-prME
accgccggaaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuaggaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaaaucacgccacagucaaguauuacagaagcagagcugaccggauacggcacugugaccauggaauguagcccgaggacaggucuugacuucaaugagaugguccuguugcagauggaaaacaaggcuuggcucgugcaccggcaaugguuucuggauuuaccccugccuuggcucccaggggccgacacccagggcucuaacuggauccagaaagagacucuuguuacauucaagaauccccacgcgaagaaacaggauguggucgugcugggaucccaagagggcgccaugcauacggcauugaccggggcuacugaaauacagaugucaagcggaaaccuacuguuuacaggucaccucaagugccgucugcgcauggacaaacuucagcugaagggcaugaguuauucuauguguaccgggaaauucaagguaguuaaggagauugccgaaacacaacauggaacuaucgugaucagaguccaguacgagggcgacgguuccccuugcaaaauuccauucgagaucauggauuuggaaaagaggcacgugcucgggcggcugauuaccgucaaucccauagugacggagaaagacagcccgguuaacaucgaagcugagccucccuuuggcgauucguacauuaucaucggaguggaaccaggccaguuaaagcugucuugguucaaaaagggguccucaauuggacagauguuugagaccacaaugcgaggugccaagcgcauggcaauacuaggcgacacugccugggauuucgggagucucggaggcguauuuaccagcaucgguaaagcucugcaucaagucuucggggcgauuuauggcgcagccuuuuccggagugucuuggacaaugaagauccuuauuggcguugugaucacuuggauagggaugaauagcagaucaaccaguuuguccgucagccuggugcucguaggagugguuacgcuguaccuuggcgucauggugcaggcugacucugguuguguggucucauggaaaaacaaggagcugaaaugcgggaguggaaucuucauuacagauaauguucacaccuggacugaacaguauaaguuucagccugagagccccuccaaguuggccucugcaauccaaaaagcccacgaagagggcauuugugguaucaggucggugacacggcucgaaaaccugauguggaagcagauaaccccagaguuaaaucauauucugacugagaacgaagugaaacuaaccaucaugacaggcgacauuaaggggaucaugcaggcuggaaaacgcagccucagaccccagccuacggagcugaaguacuccuggaaagccuggggcaaggcaaagaugcuuucaaccgaauugcacaaucauacuuuccugauagaugggccagagacagcggaaugcccgaacaccaauagggcuuggaacagucucgagguagaggacuauggauuuggcgucuucacaacuaauaucuggcugaaauuaaaggaacgucaagauguguuuugugacucuaaacugaugagcgccgcaauuaaggacaaccgggccguucacgcugauauggguuacuggaucgaguccgcccuuaacgacaccuggaaaauugaaaaggcaucauucaucgaggugaaguccugccacuggcccaaaucucauacguugugguccaaugggguccucgagagugaaaugauaauuccuaagaacuucgcuggaccagugagccagcacaauuaucgacccggcuaccauacacagaccgccgguccuuggcaccugggcagacuagagauggauuuugacuucugugaagggacuaccguugugguaacagaggauugcggaaacaggggcccaucucugcgcacuaccacagcguccgggaaacucaucacggaauggugcugucggucaugcacccugcccccgcuuagauacaggggagaggacggcuguugguaugguauggagauccgcccuuugaaggaaaaagaggaaaaucuggucaacaguuuagugacugccgggcauggacagauugauaauuuuagccucggcgugcuggguauggcucuuuuccuggaggaaauguugcgaacacgggucggcaccaagcacgcaauccuccugguugccgugucguuuguaacucuaauuacagggaacauguccuuccgugaccugggaagagugauggucauggugggcgcuaccaugacggaugacauagggaugggaguuacuuaccucgcccugcuugcagcguuuaaggugaggccaaccuucgccgcuggcuugcuguuacgcaaacucacaucuaaggagcugaugaugaccacuaucgguauuguccuucugagccaaucaacaauccccgagaguauucuagaacucaccgaugcccuggcauuggggaugauggugcugaaaaucguucggaauauggagaaguaucaguuagcugugacaauaauggccaucuccugcgucccuaacgcaguaauucuccagaaugccuggaaagugucuuguacuacccuggcuguugugagcgucagcccccuucuguugacgucaagccaacagaaggcggacuggaucccacucgcccugacaauuaagggacuaaacccuaccgcaaucuuucugacuacccuuaguagaacaucuaaaaagagguccuggccccucaaugaagcuauaauggccgugggcaugguaagcauucuggccucgucauugcugaaaaacgauaucccaaugacuggcccguuaguggcugggggacuccugaccgucugcuacguucuuacgggucgaucugcagaccuggaguuggaacgcgccgcggacgugcggugggaggagcaggcugaaaucaguggcuccagcccuauucucucuauaacaaucagcgaggauggguccaugucaauuaagaaugaagaggaggaacagacccugacuauccuaauuagaacaggacugcuugugaucaguggccucuuccccgucagcauaccaaucaccgccgcagccugguaucugugggaggugaaaaagcaaagggcugguguuuugugggacguacccucuccuccacccguggggaaagcagaauuagaggauggagccuaccguauuaagcagaagggcauccugggcuauucccagauuggggcgggagucuacaaagaagguacuuuucacacaauguggcaugugacccgcggcgcuguucucaugcacaaggggaaacggaucgagccuucaugggccgacgugaagaaagaucugauaaguuacggaggcgguuggaaacuugagggggaauggaaggagggagaagagguccaggugcuggcauuggaaccgggcaaaaacccaagagccguacaaacgaagcccggccuauucaaaacuaacaccgggacaauuggagcugucagccuggacuuuuccccugguaccucuggcucgccaaucguggauaagaaagggaagguugugggacucuauggcaauggugucgugacaaggagcgggacuuacguuucagccaucgcacagaccgagaaguccauugaggacaaccccgaaaucgaggaugacauauucagaaagaagcggcugacgauuauggaucuucauccuggagcuggcaaaacaaagcgcuauuuaccggccaucgugagagaagcgauuaaaaggggccugcggacucucaucuuggcccccacccgagucguggcagcugagauggaagaggcccugagagggcucccaauacgcuaccagaccccugcuauuagggcagagcacaccggacgugaaaucguagaccugaugugucaugccacuuucaccaugcggcuucugagucccaucagagugccaaauuauaacuugauuaucauggaugaggcccacuuuacagacccugcuucuauugcggcaagggguuacauaagcacgcgcguugaaaugggcgaggccgcugggaucuucaugacugccacacccccaggaucccgagacccguuuccucagucaaaugcacccauuauggaugaggaaagagagaucccagaacggucuuggaacagcggccacgagugggucacagacuucaaggguaagaccgugugguuugugcccaguaucaaagccgggaaugauauugcugcgugccuaaggaagaacggcaagaaggucauacaacugucccgcaaaacuuucgacagcgaauauaucaagacacguaccaaugauugggacuuuguagugacgacugauauuucugagaugggcgccaacuucaaggcagagagaguuaucgacccucggagguguaugaaaccagugauucucacagauggcgaagaacgcgucaucuuagcugggcccaugccugugacccauucauccgccgcacagcgaagaggacggguugguaggaauccgaagaacgaaaaugaccaguacauauacaugggcgagccacuggaaaacgaugaggacugcgcccacuggaaagaggcuaagaugcuucuggacaauaucaacacccccgaagggauuaucccuaguauguuugagcccgaacgcgagaaaguggaugccauugacggagaauauagacucaggggcgaggcgcggaagacuuucgucgauuugaugcgucgcggugaccugccaguguggcucgcauaccgaguagccgcugaggggaucaacuaugccgauagaaggugguguuuugacggcgugaaaaauaaccaaauacuggaagagaauguugaagucgagauuuggacaaaggagggagaacggaagaaacuuaagccucgcuggcuagaugcuagaaucuacagcgacccccuggcauugaaagaguucaaggaguucgccgcuggcaggaaaucguuaacccugaaccucauuacagagauggggcggcugccaacuuuuaugacgcagaaggccaagaaugcacuugauaaccuggcggugcuccauaccgccgaagcuggaggucgagccuauaaucacgcauugucugagcugccugagacacuagaaacucugcuccuucugaccuuauuggcuacagugaccggcgggaucuuccuguuucucauguccggaaaaggcauagguaagaugacucuggggaugugcugcaucauuacggccagcauccuucugugguacgcacagauucagccgcacuggaucgccgcuucaauaauucucgaguucuuuuugaucguccuguuaauccccgaaccagagaaacaaagaaccccucaggacaaccagcuaacauauguugugauugcgauccugacuguaguggccgcaaccauggcuaaugaaaugggcuuccucgagaagaccaaaaaggauuuuggacuuggcaguauaaccacucagcaacccgagucuaacauucuggacaucgauuugcgcccagccuccgccuggacacuguacgcagucgcuacgaccuucauuacuccuaugcucaggcauagcaucgaaaauucaagugugaacguuagccugacagccauagcgaaucaggcuaccgugcuuauggggcucggaaaggguuggccccuguccaaaauggacaucggcgucccguugcuggccauuggguguuacucucagguaaacccaaucaccuuaacagcagcccuacugcuccuuguggcucacuaugcaauuaucggaccuggccugcaggccaaggcgacucgggaggcucaaaaacgugccgcagccgguauuaugaagaaucccacgguugacgggaugaccgugaucgauuuggacccaauacccuacgauccuaaauuugaaaagcagcugggccaggucaugcuccuggugcuuugcgucacacagguguuaaugaugagaacuaccugggcucugugugaggcccucacauuggcaaccggaccgauuagcacucugugggaaggcaaccccgggagguucuggaauacgacaaucgcuguuuccauggccaacaucuuucgcggaucauaucuagcgggcgccggucuacucuucucuauuaugaagaacaccgcaaauacucggcgagggaccggaaacacaggcgagacucuuggugagaaauggaagaauagacugaacgcuuugggcaaaagugaauuucaaauauacaagaaaucggggauccaggagguggacaggacccuggccaaggaaggaauuaaacgcggcgagacagaucaucacgcaguaagccggggguccgcuaagcucagaugguucguggagcguaaucuggucacgccagaaggaaagguuguggacuuaggcugcgguagagggggauggucuuauuacuguggcggucuuaaaaacgucaaggaggugaaaggccugaccaaagggggaccuggccaugaagaacccaucccuaugucaacuuauggguggaaucucguacggcuacagagcggaguggauguuuucuuuacaccacccgaaaaaugcgacacccuguugugugauauuggcgaguccaguccuaacccaacuguggaggccggucgcacacugcgaguccucaaucuuguggaaaacuggcugaauaacaauacccaauucugcaucaaggucuugaaccccuacaugccgucugugauagagaagauggaagcccugcagagaaaauacgggggagcgcucguuaggaauccuuuaagccggaacucaacgcacgagauguauuggguauccaacgcuaguggcaauaucgugagcucugucaacaugauuucccgcaugcugaucaauagauuuaccaugaggcacaagaaagcaacauacgaaccagacguggaucuuggcucagggacucgaaacauuggaaucgagagcgagacccccaaucuggacauaauugguaagcggaucgagaaaaucaagcaggagcaugaaacaucguggcacuaugaucaggaccauccuuacaagacuugggccuaucacggcucuuacgagaccaaacaaacagggagugcuuccagcaugguuaacggagugguccgucuacucaccaagccaugggacgugauucccaugguaacucagauggccaugacggauacaaccccguucggccagcagagaguguuuaaagaaaagguugacacucgcacccaagagccuaaagaggguacaaagaagcugaugaaaauaacggcagaaugguuguggaaggagcuggggaaaaagaaaacccccaggauguguacucgggaagaguucacaagaaagguccgcucaaaugccgcucucggagcgaucuuuaccgaugagaacaaauggaaguccgccagggaagcaguggaggacucuggcuucugggaacuuguggaucgagagcggaaucugcacuuagaaggcaagugcgagacuugugucuauaacaugauggggaaaagagagaagaaacugggagaauuugguaaggcuaaaggcagcagggccauuugguacaugugguugggggcacgcuuccucgaguuugaagcccugggauuccuaaaugaggaccauugguuuagucgugaaaacucccuuagcggcguugagggugaggggcugcacaagcucggauacauccugcgggaugugucuaagaaagaaggcggcgcuauguaugccgacgauacagcggggugggacaccagaauuacauuggaggaucugaagaaugaagagaugguaacuaaccauauggaaggagagcacaaaaagcucgcagaggccaucuucaaacuuaccuaccagaauaagguggucagggugcagcgcccaacgccucgagguaccguuauggacauaaucucacggagagaccagaggggcagugggcaaguggucacauauggacugaacacuuucaccaacauggaagcucaguuaauucgccagauggagggcgaagguguguuuaaguccauccaacagcugacaguaaaagaggagauugccguuaagaauugguugaucagaguggggcgggaaaggcucagccguauggcaauuucuggagaugacugcgucgugaaaccccuggaugaccgauucgcuucggcccuaacugcucuuaacgauaugggcaaggugcgcaaagacauacagcagugggagccaucaagaggcuggaaugauuggacccaaguccccuuuugcagccaucacuuccacgaacugaucaugaaggacgggcggguucucgugguaccuuguaggaaccaggaugagcugauuggacgcgccagaaucucccagggugcaggcuggaguuugcgggaaacggcgugcuuagggaagucuuacgcccagauguggagccugauguauuuucauaggcgagaccuccgucuugcugccaaugcaaucuguuccgcugugccaucacacuggauuccgacaaguagaaccacuuggucuauacaugccacacacgaguggaugaccacugaggauaugcugaccgucuggaaccgcguguggauccaagaaaaucccuggauggaggacaaaacaccuguugaaagcugggaggaaauuccauaccuaggaaagcgggaggaucaguggugcggcucccugaucggucucacgucaagggcaaccugggccaaaaacauucagacugcgaucaaucaggugcgcagcuugauagggaacgaggaauauacagacuacaugcccucuaugaagcgauuccggagggaggaagaggaagcuggaguccugugguga

SEQ ID NO: 14319 - RNA, 9876 nt, Artificial Sequence
  derived and/or modified CDS sequence (opt3) from DENV-2__KX380818__SS-prME
accgcaggaaucauuauaaugaugauccccaccgugauggcuuuccaccugacuacgagaaauggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaacugagaacgaagugaaacugaccaucaugacaggcgacauuaaggggaucaugcaggcuggaaaacgcagccuaagaccucagccaacggagcucaaguacuccuggaaagccuggggcaaggcaaagaugcugucaaccgaacuucacaaucauacuuucuugauagaugggccggagacagcggaaugccccaacaccaauagggcuuggaacagucuggagguagaggacuauggauuuggcgucuucacaacuaauaucuggcucaaacugaaggaacgucaagaugugucuugugacagcaaauuaauguccgccgcaauuaaggacaaccgggccguucacgcugauauggguuacuggaucgagucagcccugaacgacaccuggaaaauugaaaaggccagcuuuaucgaggugaagucuugccacuggccuaaaucccauacgcuuuggaguaauggggucuuggagagcgaaaugauaauuccaaagaacuucgcuggacccgugucucagcacaauuaucgaccuggcuaccauacacagaccgccgguccauggcaccucggcagacuggagauggauuucgacuuuugugaagggacuaccguugugguaacagaggauugcggaaacaggggccccucccuacgcacuaccacagcgucagggaaacugaucacggaauggugcugucggaguugcacccucccgccucugagauacaggggagaggacggcuguugguaugguauggagauccgcccacuuaaggaaaaagaggaaaauuuggucaacagccuggugacugccgggcauggacagauugauaauuucucguuaggcgugcucgguauggcucuguuucuugaggaaaugcugcgaacacgggucggcaccaagcacgcaaucuugcucguugccguguccuucguaacucugauuacagggaacaugucuuuucgugaccuaggaagagugauggucauggugggcgcuaccaugacggaugacauagggaugggaguuacuuaccuggcccuccuggcagcguucaaggugaggcccaccuuugccgcuggccuuuugcugcgcaaauuaacaagcaaggagcucaugaugaccacuaucgguauuguccugcuuucacaaaguacaaucccugagaccauucuggaacuaacagaugcccucgcacuggggaugaugguguugaaaaucguucggaauauggagaaguaucagcuggcugugacuauaauggccaucuuaugcguccccaacgcaguaauucuccagaaugccuggaaaguguccuguaccacgcuggcuguugugucugucagcccacuucuguugacauccucacaacagaagaccgacuggaucccucucgcgcugacuauuaagggacuaaaccccaccgccaucuuccugacaacucuuagcagaaccaguaaaaagaggucuuggccacucaaugaagcaauaauggcugugggcaugguauccauucuggccagcucguuuuugaaaaacgauaucccgaugacgggcccucugguggccgggggauuacucacagucugcuacguucugaccggucgaucagcugaccuugagcuggaacgcgcagccgacauccggugggaggagcaggcggaaauuucuggcaguucccccauauugagcaucacuauuucugaggaugggagcauguccaucaagaaugaagaggaggaacagacacucaccauucugaucagaacuggacuacuggugauaucaggccuuuucccagugaguauccccauuacagcugccgcaugguaucucugggaggucaaaaagcaaagggccggugugcugugggacguuccuagcccacccccuguagggaaagcugaauuggaggauggagcauaccguaucaagcagaagggcauuuuaggcuauucucagaucggggccggaguguacaaagaagguaccuuucacacgauguggcaugucacucgcggcgcggugcugaugcacaaggggaaacggauagagccguccugggcugacguuaagaaagaucucauuucauacggaggcgguuggaagcuggagggggaauggaaggagggagaagaggugcagguccuugcccuggaaccaggcaaaaaccccagagcagugcaaaccaagccuggcuuguucaaaacaaacaccgggacaaucggagccguaagucuagacuuuagcccagguacuuccggcucucccaucgucgauaagaaagggaaggugguuggacuguauggcaaugguguggucaccaggucggggacguacgugagcgcuauugcccagacagagaagaacaucgaggacaauccugaaauagaggaugacauuuuccggaaaaagagacucacuaucauggaucugcauccgggagcaggcaaaaccaagcgcuaucuucccgcuauuguuagagaagccaucaaaaggggcuuacggacacugauacucgcgccaacccgaguggucgccgcagagauggaagaggcuuugagagggcugccuauucgcuaccagacucccgccaucagggcugagcacaccggacgugaaaucguggaccucaugugucaugcaacauucacgaugcggcugcuuucaccaauuagaguaccuaacuauaaucugaucauuauggaugaggcccacuuuacugaccccgccuccauagcugcgagggguuacaucaguacccgcguggaaaugggcgaggcagccgggauuuucaugacagcuaccccaccgggaucucgagacccuuuuccccagagcaacgccccaaucauggaugaggaaagagagauccccgaacgguccuggaacucaggccacgaguggguuacugacuucaaggguaagacagucugguuugugccuucuauuaaagcagggaacgauauagccgcuugcuugaggaagaauggcaaaaaggugauccaacuaagccgcaaaaccuucgacagugaauaugucaagacgcguacuaacgauugggacuuuguagugacaaccgauauuuccgagaugggcgcgaauuucaaggccgagagaguuaucgacccacggagguguaugaaacccgugauucugaccgauggcgaagaacgcgucauccucgcagggccuaugccggugacucauagcucugcugcccagcgaagaggacggguugguaggaacccaaagaaugaaaacgaccaguacauauacaugggcgagcccuuagaaaaugaugaggacugcgcacacuggaaagaggccaagaugcugcuugacaacaucaacacaccugaagggauuauccccucaauguuugagccagaacgcgagaaaguggaugcuauugacggagaauauagacugaggggcgaggcccggaagaccuucgucgaucucaugcgucgcggugacuugccuguguggcuggcguaccgaguagcagccgaggggaucaauuaugcugauagaaggugguguuuugacggcgugaaaaacaaucaaauacucgaagagaacguugaagucgagauuuggacaaaggagggagaacggaagaaacugaagccccgcuggcuugaugccagaaucuacuccgacccacuagcucugaaagaguucaaggaguucgcagccggcaggaaaaguuugacuuuaaaucugauuacggagauggggcggcucccuaccuuuaugacacagaaggcucgaaacgcccuggauaaucuugcagugcugcauacugcggaagccggagguagagcuuauaaccacgcccucagcgaguugccggagacccuggaaacacuacugcuccuuacccuguuagcaacugugacgggcgggaucuucuuguuucugaugucgggaaagggcauagguaaaaugacccucgggaugugcugcaucgucacagcuucuauucugcuuugguacgcccagauccagccccacuggauugcagccuccaucauacuggaguucuuucucauuguuuugcugaucccagaaccugagaagcaacgcacuccccaggacaaucaguuaaccuaugugguaaucgcuauucuaacaguggucgcggccaccauggcaaacgaaaugggcuuccuggagaaaacuaagaaagauuuuggacucggcagcaucacaacgcagcaaccagagucaaauauacuugacauugaucugaggccugcuagugccuggaccuuguacgccguggcaacuacauucaucacccccaugcugcggcauucuauugaaaacuccagcguuaaugugucacucaccgcuaucgccaaccaggcgacaguccugauggggcuuggaaaggguuggccgcucaguaagauggacauaggcguaccacuguuggcuaucggguguuacagccaggugaauccuauuacucugacggccgcauuacuacugcucguugcccacuaugcuaucauuggacccggccuucaggcaaaagccacccgugaggcgcaaaagagagcugccgcagguaucaugaaaauuccagccgcugacaucgggagggugauagaucuggaccccauuccuuacgauccgaaguuugaaaaacaguugggccaggucaugcugcucgugcugugcgucacacaggugcuuaugaugcgcacuaccugggccuuaugugaggcacugacacucgcuaccggacccaucuccacuuugugggaaggcaacccagggcgguucuggaauacgacaaucgccguuucuauggcgaacauuuuucgaggaagcuaucuggccggcgcaggucuacuguucuccauaaugaagaacaccgcuaauacuagaagggggaccggaaacacaggcgagacucucggugagaaguggaaaaaucaacuuaacgcccugggcaagucagaauuucagaucuacaaaaagucugggauucaggagguggaccgcaccuuggcaaaagaaggaaucaagcggggcgagacagaucaucacgcuguaaguagagggucggccaaacugcguugguucguggagaggaaucucgucacgccugaaggaaagguuguggaccugggcugcgguagagggggauggagcuauuacuguggcgguuuaaagaacgucaaagaggugaagggccuuaccaaagggggacccggccaugaggaaccuauuccaauguccacuuauggguggaaucugguacgccuccaaucuggaguggauguuuucuuuacacccccugaaaagugcgacacccuacugugugauaucggcgagucaagcccaaaccccacuguggaggccggucgaacauugagaguccugaaucucguggaaaacuggcuuaauaacaauacccaguucugcauaaaaguccugaacccguacaugccuuccgugaucgagaagauggaagcguugcagaggaaguacgggggagcucugguucggaauccacucagucgcaacucuacgcacgagauguauuggguaagcaacgcaucaggcaauauuguguccagugucaacaugaucagcagaauguuaauuaauagguuuaccaugcgacacaaaaaggccacauacgaacccgacguggaucugggcucugggacucggaacaucggaauagaguccgagguuccuaaucuugacauuaucgguaaacguaucgaaaagauuaaacaggagcaugaaaccucauggcacuaugaucaagaccauccauacaagacaugggcuuaucacggcagcuacgagacuaagcagaccgggucggccucuaguauggugaacggagucgugagacugcuaacaaaacccugggacguaauaccgauggugacccagauggcaaugacugauacgacaccuuucggccagcaacgcguuuuuaaggaaaaagucgacaccaggacucaggagcccaaggaggguaccaaaaagcucaugaagaucacagccgaauggcuguggaaagaguuggggaagaaaaagacgccacggauguguaccagagaagaguucacucgcaaagugagguccaaugcugcgcugggagccauuuuuacagaugagaacaaguggaaaagcgcacgagaagcuguggaggacucaggcuucugggaacucgucgauaaggagcggaaucuucaccuggaaggcaagugcgagaccuguguuuauaacaugauggggaaaagagagaagaaauuaggagaauuugguaaggccaaaggcuccagggcaaucugguacauguggcugggggcccgcuucuuggaguuugaagcucucggauuccugaaugaggaccauugguuuucucgugaaaacagccuaaguggcguggagggugaggggcuucacaagcugggauacauucuccgggauguauccaagaaagaaggcggcgccauguaugcggacgauacugcagggugggacacaagaaucacccuggaggauuugaagaaugaagagauggugacaaaccauauggaaggagagcacaaaaagcuggccgaggcuauauucaggcucacuuaccagaauaaagucgugcgcguucagcgaccuacaccccgggguacggugauggacaucauuagcagaagggaccaacgcggcucugggcaggucgugaccuauggacuuaacacauucacuaacauggaagcccagcugaucagacaaauggagggcgaagguguauuuaagucaauucagcauuuaaccgcaacagaggagaucgcuguuaagaauuggcuggugcgggucgggagggaacguuugagucgaauggccauuuccggagaugacugcguggugaaaccacucgaugaccgcuucgcuaacgcccugacugcacuaaaugauaugggcaaggucagaaaagacauacagcagugggagcccagccggggcuggaacgauuggacccaaguuccuuuuugcucucaccacuuccaugaacuuaucaugaaggacgggagggugcugguagugccaugucgcaaucaggaugagcucauuggacgagcgcggaucucgcagggugccggcuggucacugagggaaacggcuugcuuggggaaaagcuacgcccagaugugguccuuaauguauuuucaccgacgugaccugagacucgcagcuaacgccaucuguagugcagucccgucucauugggugcccacaagccgcaccacuugguccauucacgccacacacgaguggaugaccacugaggauaugcuuaccguuuggaaucggguguggauacaagaaaacccuuggauggaggacaagacaccagucgaaucaugggaggaaauccccuaccugggaaagagggaggaucaguggugcggcagucuaauuggucugacgucuagagcgaccugggcuaaaaauauccagacugccauuaaccaggugcgcagccucaucgggaaugaggaauauacagacuacaugccuuccaugaagcgguucaggcgagaggaagaggaagcaggaguauugugguga

SEQ ID NO: 14320 - RNA, 9876 nt, Artificial Sequence
  derived and/or modified CDS sequence (opt3) from DENV-2__KX380819__SS-prME
accgcaggaaucauuauaaugaugauccccacagugauggcuuuccaccugacuacgcgaaacggggaaccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgcaacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggauaucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugcuaccauggaauguagccccaggacaggucuggacuucaaugagauggugcuucugcagauggaaaacaaggccugguugguccaccggcaaugguuucucgaucugccuuuaccauggcugcccggggcggacacccagggcucuaacuggauccagaaagagacucucgugacauucaagaauccucacgccaagaaacaggauguugugguccuuggaucccaagagggcgcaaugcauacggcucugaccggggccacugaaauacagaugucaagcggaaacuugcuauuuacaggucaccugaagugccgucuccgcauggacaaacugcagcuuaagggcaugaguuauucuauguguaccgggaaauucaaggugguaaaggagauugcugaaacacaacauggaacuaucguuaucagagugcaguacgagggcgacgguuccccaugcaaaauucccuucgagaucauggaucuggaaaagaggcacgucuuggggcggcucauuaccgugaauccgauagucacggagaaagacagcccugugaacaucgaagccgagcccccauuuggcgauucguacauuaucaucggaguugaaccuggccagcugaaguuaucuugguucaaaaagggguccucaauuggacagauguuugagaccacaaugcgaggugcaaagcgcauggccauacugggcgacacugcuugggauuucgggagucuaggaggcguguuuaccagcaucgguaaagcgcuccaucaaguauucggggcaauuuauggcgccgcuuuuuccggagucucuuggacaaugaagauccugauuggcgugguuaucacuuggauagggaugaauagcagaucaaccagucuuuccgugagcuugguccuggugggaaucguaacgcucuaccugggcgugaugguucaggccgacucugguugugucgugucauggaaaaacaaggagcuuaaaugcgggaguggaauuuucaucacagauaaugugcacaccuggacugaacaguauaaguuucagcccgagagcccauccaagcuggcaucugccauucaaaaagcucacgaagagggcaucugugguauaaggucggucacacgguuggaaaaccucauguggaagcagauuacccccgagcugaaucauaucuuaagcgagaacgaaguuaaacugacuauuaugaccggcgacaucaaggggauaaugcaggccggaaaacgcucccuaagaccucagccaacagagcucaaguacucauggaaagcauggggcaaggcgaagaugcugaguacggaacuucacaaucauaccuucuugaucgaugggccggagacugcugaaugccccaacacaaauagggccuggaacucucuggagguggaggacuauggauuuggcguguucaccacaaauauuuggcucaaacugaaggaacgucaagauguauuuugugacagcaaauuaauguccgcagccaucaaggacaaccgggcuguccacgccgauauggguuacuggauugagucagcacugaacgacacuuggaaaaucgaaaaggcuagcuucauagaggugaagucuugccacuggccuaaaucccauacccuuuggaguaaugggguuuuggagagcgaaaugauuaucccaaagaacuucgccggacccgugucucagcacaauuaucgaccuggcuaccauacgcagacagcggguccauggcaccucggcagacuggagauggauuuugacuucugugaagggaccacugucgugguuaccgaggauugcggaaacaggggccccucccuacgcacaacuaccgccucagggaaacugaucacagaauggugcugucggaguugcacgcucccgccucugagauacaggggagaggacggcuguugguaugguauggagauucgcccacuuaaggaaaaagaggaaaauuuggugaacagccugguaaccgcugggcauggacagaucgauaauuuuucguuaggcguccucgguauggcacuguuccuugaggaaaugcugcgaacucgggugggcacaaagcacgccauuuugcucguggcugucuccuuuguuacccugauaacugggaacaugucuuuccgugaccuaggaagagugaugguaauggugggcgccacaaugaccgaugacaucgggaugggagucacguaccuggcacuccuggcggccuuuaaggugaggcccacuuucgcugccggccuuuugcugcgcaaauuaaccagcaaggagcucaugaugacaaccauugguaucguucugcuuucacaaaguacuauuccugagacaauccuggaacuaaccgaugcacucgcucuggggaugaugguguugaaaauaguccggaauauggagaaguaucagcuggccgugacaaucauggcaauuuuaugcguucccaacgccgugauccuccagaaugcuuggaaagucuccuguacuauucuggcgguagugucuguuagcccacuucuguugaccuccucacaacagaaggccgacuggaucccucucgcacugacgauaaagggacuaaaccccacagcuauuuuucugaccacucuuagcagaaccaguaaaaagaggucuuggccacucaaugaagccaucauggccgugggcauggucuccauccuggcuagcucguugcugaaaaacgauauuccgaugacaggcccuuuaguggcagggggacuccugacuguaugcuacgugcuuaccggucgaucagccgaccuggaguuggaacgcgcggcugacguccggugggaggagcaggccgaaauaucuggcaguucccccauccucagcauuacgaucucugaggaugggagcauguccauuaagaaugaagaggaggaacagacacugaccauccuaauaagaacuggacugcuuguuaucucaggccucuucccagugaguauucccaucacagcagccgcuugguaucugugggaggugaaaaagcaaagggccggugucuugugggacgugccuagcccacccccuguugggaaagccgaauuagaggauggagcguaccguauuaagcagaagggcauccugggcuauucucagauaggggcuggaguauacaaagaagguaccuuucacacuauguggcaugugacacgcggcgccguccucaugcacaaggggaaacggauugagccguccugggcagacgugaagaaagaucugaucucauacggaggcgguuggaaacuugagggggaauggaaggagggagaagagguucaggugcuggccuuggaaccaggcaaaaaccccagagcuguccaaaccaagccuggccuauucaaaacgaacacugggaccaucggagccgugagucuggacuuuagcccagguacauccggcucucccauuguagauaagaaagggaaggucgugggacucuauggcaaugguguugugaccaggucggggacauacgucagcgcaaucgcucagacugagaagucaauagaggacaacccugaaauugaggaugacaucuucagaaagaaacggcugaccauuauggaucuucauccgggagccggcaaaacgaagcgcuauuuacccgcgaucgugagagaagccauaaaaaggggccugcggacacucauuuuggcaccaacucgaguuguggcugccgagauggaagaggcucugagagggcucccuauccgcuaccagacccccgcaaucagggccgagcacacaggacgugaaauugucgaccugaugugucaugccaccuucacuaugcggcuucuguccccaaucagagugccuaauuauaacuugauuauaauggaugaggcucacuuuaccgaccccgcgaguaucgcagccagggguuacauuucuacacgcguagaaaugggcgaggcugccgggaucuucaugacggcaacuccaccgggaagccgagacccuuuuccccaguccaaugccccaaucauggaugaggaaagagagauucccgaacggucauggaacucuggccacgagugggugaccgacuucaaggguaagacaguuugguuugucccuagcauaaaagcugggaaugauaucgcggccugccuaaggaagaacggcaagaaggugauucaacugagucgcaaaaccuucgacuccgaauauaucaagacucguacaaaugauugggacuuuguggucaccacggauauuagcgagaugggcgcaaacuucaaggcugagagaguaaucgacccacggagguguaugaaacccgugauacucacugauggcgaagaacgcguuaucuuagccgggccuaugccggugacacauucuucagcagcccagcgaagaggacgggucgguaggaauccaaagaacgaaaaugaccaguacauuuacaugggcgagccccuggaaaacgaugaggacugcgcucacuggaaagaggccaagaugcuucuggacaauaucaacaccccugaagggauuauccccuccauguuugagccagaacgcgagaaaguggaugcgauagacggagaauauagacucaggggcgaggcacggaagaccuucguugauuugaugcgucgcggugaccugccuguguggcucgccuaccgagucgcugccgaggggauuaacuaugcugauagaaggugguguuuugacggcgugaaaaauaaccaaauccuggaagagaauguagaaguggagauuuggacuaaggagggagaacggaagaaacuuaagccccgcuggcuagaugcaagaaucuacagugacccacuggccuugaaagaguucaaggaguucgcugccggcaggaagucguuaacacugaaccucauaaccgagauggggcggcugccuacauuuaugacucagaaggcacgaaaugcgcuugauaaccuggccguucuccauacggcugaagccggagguagagcauauaaucacgcuuugagcgagcugccggagacccuagaaacacugcuccuucugacuuuauuggccaccgucacaggcgggaucuuccuguuucucaugucuggaaagggcauugguaaaaugacccuggggaugugcugcaucauuacugcauccauccuucugugguacgcccagauacagccccacuggauugcugcgagcaucauccucgaguucuuuuugauugugcuguuaaucccagaaccugagaagcaacgcacgccccaggacaaccagcuaaccuauguggucauagccauucugacaguuguggcagcuacuauggccaaugaaaugggcuuccucgagaaaaccaagaaagauuuuggacuuggcucaaucacaacccagcaaccagacaguaacauucuggauaucgacuugaggccugccucugcauggacucuguacgcuguagccacaacguucauaacccccaugcuccggcauuccaucgagaauagcucagugaacgucagucugacugcgauugcuaaucaggccacagugcuuauggggcucggaaaggguuggccgcugagcaagauggacaucggcguuccauugcuggcaauuggguguuacucccaggugaacccuaucaccuuaaccgccgcucuacugcuccuugucgcacacuaugccauuaucggacccggccugcaggcgaaagcuacacgugaagcccaaaagagagcagccgcugguauaaugaaaauuccagccgcauugaucgggaggguaaucgaucuggaccccauuccuuacgauccgaaguuugagaaacagcucggccaggugaugcugcuuguuuuaugcgugacucagguccugaugaugcgcacgaccugggcucucugugaagccuugacacuggcgacuggacccauaucuacccuaugggagggcaauccagggcgguucuggaacacaaccaucgccgugagcauggcaaauauuuuucgaggauccuaucuggcuggcgccggucuccuuuucucaaucaugaagaacacugcaaacacgagaagggggacaggaaauaccggcgaaacucugggugagaaguggaaaaaccgcuugaaugcucugggcaagucugaguuucaaauuuacaaaaagagugggauccaggaagucgaccggacccucgccaaagagggaauaaagagaggcgaaacagaucaucacgccgugucgcgugggagcgcgaaacugaggugguucguugagcggaacuuagugacuccugagggaaagguaguggaccuuggcugcggucgcgggggaugguccuauuacuguggcggucugaagaaugucaaagaaguuaagggccucaccaaagggggacccggccaugaggaaccuaucccaaugucuacauauggguggaaccuagugcgacugcagucaggagucgauguguucuuuacgcccccugagaagugcgacaccuugcugugugauauuggcgaaagcuccccaaaucccacuguagaggcugguagaacacucagggugcuuaaccugguugagaauugguugaacaauaacacccaauucugcaucaaagugcugaauccguacaugccuagugucauugaaaagauggaggcacuccagcggaaguacgggggagccuuagugcgcaacccacugucuagaaauagcacucacgaaauguauugggucucaaacgcuuccggcaacaucgugaguagcguuaauaugauaucuaggaugcuuauuaaccgauuuacaaugaaacacaagaaagccaccuacgagcccgacguagaucugggcuccgggacgcggaauaucggaaucgaaucagagaccccuaaccuagacauuauagguaagcguaucgagaaaauuaagcaggaacaugagacaagcuggcacuaugaucaggaccauccauacaagacuugggcauaucacggcucguacgaaaccaaacaaacagggucugccaguuccauggugaauggagucgugagacuccugacuaagcccugggacguuaucccgauggugacccagauggcuaugacagauaccacuccuuucggccagcagcgcgucuuuaaagagaagguggacacgaggacacaagaacccaaagaggguaccaagaaguugaugaaaauuacugcggaguggcuguggaaggaacucgggaaaaagaaaaccccacggauguguacaagagaggaguucacgcgcaagguaaggagcaacgccgcacuuggagcuaucuuuaccgaugagaauaaauggaagucagcccgagaggcaguggaagacuccggcuucugggagcugguugauaaggaacggaacuuacaccuggagggcaaaugcgaaacuugugucuauaauaugauggggaagagagagaaaaaguugggagaguuugguaaagccaagggcucuagggcuauaugguacauguggcucggggcccgcuuccuggaauuugaggcgcuaggauuccuuaacgaagaccauugguuuagccgugagaauagucuguccggcguggaaggugaggggcuccacaagcugggauacaucuugcgggaugugagcaaaaaggagggcggcgcaauguaugccgacgauacagcugggugggacaccagaauuacucuggaagaucucaaaaacgaggaaauggucacaaaucauauggagggagaacacaggaaacuugccgaggcaaucuuccgccugaccuaccagaacaaaguugugcgaguacagcggccuacacccagagguacugugauggacauuaucucuaggcgcgaccagagaggcucagggcaagucgugaccuauggauuaaauacguucaccaacauggaggcucagcugauucggcagauggaaggcgaggguguuuuuaagaguauacaacauuugacagugacugaagagaucgccgucaagaacuggcucgagaggguggggcgugaacgacugucccgcauggcuauuagcggagaugacugcguaguuaaaccacuagaugacagauucgccucugcacuuaccgcgcugaaugauaugggcaaggugcggaaagacauccagcagugggagcccucgaggggcuggaacgauuggacacaggucccuuuuugcucacaccacuuccaugaacucaucaugaaggacgggcgcgugcugguggucccauguagaaaucaagaugaguugauuggacgggccaggauaagccagggugcuggcugguccuuacgagaaacugccugccuggggaaaaguuacgcacagauguggucucucauguauuuucaccguagagaccuucgccuggcugccaacgcaaucuguagcgccguuccgucccauugggugcccauuucacggaccacguggaguauccacgcgacacacgaguggaugaccacugaggauaugcuaacagcuuggaauaggguauggauucaggaaaacccuuggauggaggacaagaccccaguggaaucuugggaggaaauccccuaccugggaaagagagaggaucaauggugcggcagccucauagguuugacuucccgcgccaccugggccaaaaauauccagacagccauuaaccagguccggucacugaucgggaaugaggaauauacggacuacaugccuagcaugaagagguuccgaagagaggaagaggaagcuggagugcuuugguga

SEQ ID NO: 14321 - RNA, 9876 nt, Artificial Sequence
  derived and/or modified CDS sequence (opt3) from DENV-2__KX380821__SS-prME
accgcaggcaucauuauaaugaugauccccaccgugauggcuuuccaccugacuacgcgaaacggggagccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgcaacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggagugguuacgcucuaccugggcgucauggugcaggccgacucugguuguguggucucauggaaaaacaaggagcuuaaaugcgggaguggaauauucaucacagauaauguucacaccuggacugaacaguauaaguuucagcccgagagcccauccaagcuggcaucugccauucaaaaagcucacgaagagggcaucugugguauuaggucggugacacgguuggaaaaccucauguggaagcagaucacccccgagcugaaucauauauuaacugagaacgaagugaaacugaccauuaugacaggcgacaucaaggggauuaugcaggccggaaaacgcacgcuaagaccucagccaaccgagcucaaguacagcuggaaagcauggggcaaggcgaagaugcuguccacugaacuucacaaucauacauucuugaucgaugggccggagaccgcugaaugccccaacacaaauagggccuggaacucacuggagguagaggacuauggauuuggcgucuucacuaccaauauauggcucaaacugaaggaacgucaagauguguuuugugacaguaaauuaaugucugcagccaucaaggacaaccgggcuguucacgccgauauggguuacuggauugagagcgcacugaacgacacguggaaaaucgaaaaggcuuccuucauugaggugaagucaugccacuggccuaaaagccauacacuuuggucuaauggggucuuggaguccgaaaugaucauaccaaagaacuucgccggacccgugagucagcacaauuaucgaccuggcuaccauacccagacugcggguccauggcaccucggcagacuggagauggauuuugacuucugugaagggaccacaguugugguaacugaggauugcggaaacaggggccccagccuacgcaccacaacggccucugggaaacugauuaccgaauggugcugucgguccugcacucucccgccucugagauacaggggagaggacggcuguugguaugguauggagauccgcccacuuaaggaaaaagaggaaaauuuggucaacucacuggugacagcugggcauggacagaucgauaauuuuaguuuaggcgugcucgguauggcacuguuccuugaggaaaugcugcgaacccgggucggcacuaagcacgccauuuugcucguugcugugagcuuuguaacacugaucaccgggaacaugucguuccgugaccuaggaagagugauggucauggugggcgccacgaugacugaugacauugggaugggaguuaccuaccuggcacuccuggcggccuuuaagauaaggcccacauucgcugccggccuuuugcugcgcaaauuaaccuccaaggagcucaugaugacuacaaucgguauugugcugcuuucucaaagcaccaucccugagucaauucuggaacuaacagaugcacucgcucuggggaugauggucuugaaaaucgugcggaauauggagaaguaucagcuggccguuacuauaauggcaaucuuaugcgugcccaacgccgucauucuccagaaugcuuggaaaguaaguuguaccacgcuggcggugguuuccgugucuccacuucuguugacaagcucccaacagaaggccgacuggaucccucucgcacugaccauuaagggacuaaaccccacugcuaucuuucugaccacacuuucaagaacuagcaaaaagaggaguuggccacucaaugaagccauaauggccgucggcauggugucuauucuggcuuccagcuugcugaaaaacgauaucccgaugaccggcccuuuaguagcagggggacuccugacggugugcuacguccuuacaggucgaucggccgaccuggaguuggaacgcgcggcugacguucggugggaggagcaggccgaaaucucaggcucuagucccauucucuccauaaccaucagcgaggaugggucuaugagcauuaagaaugaagaggaggaacagacucugacaauccuaauuagaaccggacugcuugugaucuccggccucuucccagugucaauacccaucacugcagccgcuugguaucugugggaggucaaaaagcaaagggccgguguguugugggacguuccuaguccacccccuguagggaaagccgaauuagaggauggagcguaccguauuaagcagaagggcauccugggcuauagccagauuggggcuggaguguacaaagaagguacauuucacaccauguggcaugucacgcgcggcgccgugcucaugcacaaggggaaacggaucgagccgucuugggcagacguuaagaaagaucugauauccuacggaggcgguuggaaacuugagggggaauggaaggagggagaagaggugcagguccuggccuuggaaccaggcaaaaaccccagagcugugcaaacuaagccuggccuauucaaaaccaacacagggaccauuggagccguaucacuggacuuuaguccagguacaagcggcucccccaucgucgauaagaaagggaaggugguuggacucuauggcaaugguguggucacuaggucugggaccuacgugucggcaaucgcucagacggaaaagagcauugaggacaacccugaaaucgaggaugacauauucagaaagaagcggcugacaauuauggaucuucauccgggagccggcaaaacuaagcgcuauuuacccgcgaucguuagagaagccauuaaaaggggccugcggacccucaucuuggcaccaacacgaguggucgcugccgagauggaagaggcucugagagggcucccuauacgcuaccagacccccgcaauuagggccgagcacacuggacgugaaaucguggaccugaugugucaugccaccuucacaaugcggcuucugucaccaaucagaguaccuaauuauaacuugauuaucauggaugaggcucacuuuacggaccccgcguccauugcagccagggguuacauaaguacucgcguggaaaugggcgaggcugccgggaucuucaugaccgcaacaccaccgggaucucgagacccuuuuccccagagcaaugccccaauuauggaugaggaaaaggagauccccgaaagauccuggaacucaggccacgaguggguuaccgacuucaaggguaaaacugucugguuugugccuucuaucaaggcugggaaugauauugcggccugccuacggaaaaacggaaagaaagugauacaacugagcaggaagacauucgacagugaauauaucaagacccgcacgaaugauugggacuuugucguaacuacagauauuuccgagaugggcgcaaacuucaaagcugagcgugugaucgacccaagacgguguaugaagcccguuauucucaccgauggcgaagagagggugaucuuagccgggccuaugccggucacccauagcucugcagcccagcgccgaggaagagugggucggaaucccaagaacgaaaaugaccaguacauauacaugggcgagccccuggaaaacgaugaggacugcgcucacuggaaggaggccaaaaugcuucuggacaauaucaacacuccugaagggauuauccccucaauguuugagccagaaagggagaagguugaugcgauugacggagaauaucgccucagaggcgaggcaaggaaaacauucguggauuugaugcggcguggugaccugccugucuggcucgccuaccgcguggcugccgaggggaucaacuaugcugaucgaagaugguguuuugacggcguaaagaauaaccaaauacuggaagagaauguggaaguugagauuuggaccaaggagggagaaaggaagaaacuuaaaccccgguggcuagaugcacgcaucuacuccgacccacuggccuugaaagaguucaaagaguucgcugccggcagaaagaguuuaacacugaaccucauuacugagauggggaggcugccuacguuuaugacccagaaggccaagaaugcgcuugauaaccuggccguccuccauacagcugaagccggaggucgggcauauaaucacgcuuugagcgagcugccggagacucuagaaacccugcuccuucugacauuauuggccaccgugacuggcgggaucuuccuguuucucaugucgggaaagggcauagguaaaaugacgcuggggaugugcugcaucauuaccgcaucuauccuucugugguacgcccagauucagccccacuggaucgcugcguccauaauucucgaguucuuuuugaucgugcuguuaaucccagaaccugagaagcaacgaacaccccaggacaaccagcuaacuuaugucguuauugccauccugaccgugguagcagcuacaauggccaaugaaaugggcuuccucgagaaaaccaagaaggauuuuggacuuggcagcauaacuacacagcaaccagagucaaacauucuggacaucgauuugagaccugccagugcauggacgcuguacgcuguggccaccacuuucauuacacccaugcuccgccauucuaucgaaaauuccagcgucaacgugucacugaccgcgauagcuaaucaggccaccguucuuauggggcucggaaaagguuggccgcugaguaagauggacaucggcgugccauugcuggcaauuggguguuacagccaggucaacccuaucacauuaacugccgcucuacugcuccuuguagcacacuaugccauuaucggacccggccugcaggcgaaagcuacgagggaggcccaaaagcgggcagccgcugguauuaugaaaaauccaaccguggacgggaugacaguuaucgauuuggaccccauaccuuacgauccgaaguuugaaaagcagcugggccaggugaugcuccugguccuuugcgugacucaggucuuaaugaugcguaccacaugggcccugugugaggcacucaccuuggcuacuggacccauuuccacgcugugggaaggcaacccagggagauucuggaauacaaccaucgccgugucuauggcgaacaucuuuaggggaagcuaucuagccggcgcaggucuacucuucuccauuaugaaaaacacugcuaauacccgccgggggacaggaaacacuggcgagacccuuggugagaaguggaaaaaucgacugaacgccuugggcaagucagaauuucaaauauacaaaaagucugggauccaggagguugacagaacacuggcaaaagaaggaauuaagaggggcgagacggaucaucacgcugugagucgcgggucggccaagcuccggugguucguagagagaaaucuggugaccccugaaggaaaagucguugacuuaggcugcggucgugggggauggagcuauuacuguggcggucuuaagaacgugaaagaggucaagggccugacuaaagggggacccggccaugaggaaccuaucccaauguccacauauggguggaaucucgugaggcuacagucuggaguagauguguucuuuacaccaccugaaaagugcgacacucuguugugugauauuggcgagucaagcccaaaccccacaguugaggccggucggacccugcgcgugcucaaucuugucgaaaacuggcugaauaacaauacgcaauucugcaucaagguguugaacccguacaugccuuccgucauagagaaaauggaagcgcugcagcgaaaguacgggggagcucucgugagaaauccauuaaguaggaacucuacccacgagauguauuggguuagcaacgcaucaggcaauaucguauccagugugaacaugauuagccggaugcugaucaaucgcuuuacaaugagacacaaaaaggccacuuacgaacccgacgucgaucuuggcucugggaccaggaacauuggaaucgaguccgagacaccuaaucuggacauaauugguaaacgaaucgaaaagaucaagcaggagcaugaaacuucauggcacuaugaucaggaccauccauacaaaaccugggcuuaucacggcagcuacgagacaaagcaaaccgggucggccucuaguauggugaacggaguugugcggcuacucacuaaacccugggacgucauuccgauggugacgcagauggcaaugacagauaccacuccuuucggccagcagcguguauuuaaggaaaaaguggacaccagaacacaagagcccaaggaggguacgaagaaacugaugaagauaaccgccgaaugguuguggaaagagcuggggaagaaaaagacuccacgcauguguacaagggaagaguucacccggaaaguuagauccaaugcugcgcucggagccaucuuuacugaugagaacaaguggaaaagcgcacgcgaagcugucgaggacucaggcuucugggaacuuguggauaaagagaggaaucugcacuuagaaggcaagugcgagacauguguguauaacaugauggggaaacgagagaagaaacugggagaauuugguaaggccaagggcucccgggcaauuugguacaugugguugggggccagauuccucgaguuugaagcucugggauuccuaaaugaggaccauugguuuucuagggaaaacagccuuaguggcgucgagggugaggggcugcacaaacucggauacauccugcgcgauguuuccaagaaagaaggcggcgccauguaugcggacgauaccgcagggugggacacacguauuacuuuggaggaucugaagaaugaagagauggugaccaaccauauggaaggagagcacaaaaagcucgccgaggcuaucuucaaacuuacguaccagaauaaaguagugcggguccagagaccuacccccagggguacagugauggacauaaucagccgccgagaccagcggggcucugggcaaguugugacuuauggacugaacaccuucacaaacauggaagcccaguuaauuagacagauggagggcgaaggugucuuuaagucaauccaacagcugacugugaaagaggagauugcaguaaagaauugguugaucaggguugggcgcgaaagacucagucggauggcuauuuccggagaugacugcguggucaaaccacuggaugacagguucgccagcgcucuaaccgcccuuaacgauaugggcaaggugcguaaggacauacagcagugggagcccucucgaggcuggaaugauuggacgcaagugccuuuuugcucgcaucacuuccacgaacugaucaugaaagacgggcgcguccucguugugccauguagaaaccaggaugagcugauuggacgggcaaggaucucacagggugcgggcuggagcuugcgcgaaacagccugcuuagggaaguccuacgcucagauguggagucugauguauuuucauagacgggaccucaggcuugccgcaaaugcuaucuguucugccguaccgagccacuggauucccaccucccgaacuacauggucaauacaugcaacccacgaguggaugacuaccgaggauaugcugacaguguggaaccgugucuggauccaagaaaauccuuggauggaggacaaaacgccaguggaaaguugggaggaaauucccuaccuaggaaagagagaggaucaguggugcggcucucugaucggucucaccagccgcgccacuugggcgaaaaacauucagacagcuaucaaucagguucgguccuugauagggaacgaggaauauaccgacuacaugccuucaaugaagagguucagacgcgaggaagaggaagccggagugcugugguga

SEQ ID NO: 14322 - RNA, 9876 nt, Artificial Sequence
  derived and/or modified CDS sequence (opt3) from DENV-2__KX380822__SS-prME
accgccggaaucauuauaaugaugauccccacggugauggcuuuccaccugacuacgagaaacggggaaccucauaugauuguaagcaggcaggaaaagggaaaaucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccguuauggcagccauacuggcuuacacaaucggcaccacguauuuucagcgcguguugauuuucauccuccugacugcagucgccccaucuaugacaaugagaugcauuggcaucucgaacagggacuuuguggaagggguaucaggagguagcuggguugauauagugcuggagcacggcaguugugucaccacuauggcuaaaaauaagcccacacucgacuucgaauuaauuaagaccgaggccaaacacccugcgacgcugcggaaguacugcaucgaagcaaaacuuaccaacacaacuaccgccucccgcuguccaacacagggggagcccucuuugaaugaggaacaagauaagcgauuugugugcaaacauagcaugguggacagaggauggggcaacgguugugggcuguucggaaagggcggcauugucacuugcgcuauguuuaccugcaagaaaaauauggaggggaagaucguucagccugaaaaccuagaguauacaaucgugauuaccccacacuccggagaagagaaugccguagguaacgauacuggcaaacaugggaaggagauaaaagugacgccgcagucaaguaucacagaagcagagcucaccggauacggcacugcuaccauggaauguagccccaggacaggucuggacuucaaugagaugguccuucugcagauggaaaacaaggccugguuggugcaccggcaaugguuucucgaucugccuuuaccauggcugcccggggcggacacccagggcucuaacuggauucagaaagagacucucguuacauucaagaauccucacgccaagaaacaggauguggucgugcuuggaucccaagagggcgcaaugcauacggcucugaccggggccacugaaauccagaugucaagcggaaacuugcuauuuacaggucaccugaagugccgucuccgcauggacaaacugcagcuuaagggcaugaguuauucuauguguaccgggaaauucaagguaguuaaggagauagcugaaacacaacauggaacuauugugaucagaguccaguacgagggcgacgguuccccaugcaaaauccccuucgagauuauggaucuggaaaagaggcacguguuggggcggcucaucaccgucaauccgauugugacggagaaagacagcccuguuaacauagaagccgagcccccauuuggcgauucguacaucauuaucggaguggaaccuggccagcugaaguuaucuugguucaaaaagggguccucaaucggacagauguuugagaccacaaugcgaggugcaaagcgcauggccauucugggcgacacugcuugggauuucgggagucuaggaggcguauuuaccagcauagguaaagcgcuccaucaagucuucggggcaaucuauggcgccgcuuuuuccggagugucuuggacaaugaagauucugaucggcguugugauuacuuggaucgggaugaauagcagaucaaccagucuuuccgucagcuuggugcugguaggaauagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaacugaaggaacgucaagaugucuuuugugacagcaaauuaauguccgcagccauuaaggacaaccgggcugugcacgccgauauggguuacuggaucgagucagcacugaacgacacuuggaaaauugaaaaggcuagcuucaucgagguuaagucuugccacuggccuaaaucccauacccuuuggaguaaugggguguuggagagcgaaaugauaauuccaaagaacuucgccggacccgucucucagcacaauuaucgaccuggcuaccauacgcagacagcggguccauggcaccucggcagacuggagauggauuuugacuucugugaagggaccacugugguugugaccgaggauugcggaaacaggggccccucccuacgcacaacuaccgccucagggaaacugaucacagaauggugcugucggaguugcacgcucccgccucugagauacaggggagaggacggcuguugguaugguauggagauccgcccacuuaaggaaaaagaggaaaauuugguaaacagccuggucaccgcugggcauggacagauugauaauuuuucguuaggcgugcucgguauggcacuguuccuugaggaaaugcugcgaacucgggugggcacaaagcacgccaucuugcucgucgcuguuuccuuugugacccugauuacugggaacaugucuuuccgugaccuaggaagaguaauggugauggucggcgccacaaugaccgaugacauagggaugggagugacguaccuggcacuccuggcggccuuuaagguuaggcccacuuucgcugccggccuuuugcugcgcaaauuaaccagcaaggagcucaugaugacaaccaucgguauugugcugcuuucacaaaguacuaucccugagacaauucuggaacuaaccgaugcacucgcucuggggaugauggucuugaaaaucgugcggaauauggagaaguaucagcuggccguuacaauaaugacuaucuuaugcgugcccaacgcagucauucuccagaaugccuggaaaguauccuguaccauccuggcugugguuucugugagcccacuucuguugacguccucacaacagaaggcggacuggauuccucucgcccugacaaucaagggacuaaaccccaccgcaauauuucugacuacccuuagcagaacaaguaaaaagaggucuuggccacucaaugaagcuauuauggccgucggcaugguguccauccuggccagcucguugcugaaaaacgauaucccgaugacuggcccuuuaguagcugggggacuccugaccgugugcuacguccuuacgggucgaucagcagaccuggaguuggaacgcgccgcggacguucggugggaggagcaggcugaaauuucuggcaguucccccauacucagcaucacaauuucugaggaugggagcauguccaucaagaaugaagaggaggaacagacccugacuauucuaaucagaacaggacugcuugugauaucaggccucuucccagugaguauccccauuaccgccgcagccugguaucugugggaggucaaaaagcaaagggcugguguguugugggacguuccuagcccacccccuguagggaaagcagaauuagaggauggagccuaccguaucaagcagaagggcauucugggcuauucucagaucggggcgggaguguacaaagaagguacuuuucacacaauguggcaugucacccgcggcgcugugcucaugcacaaggggaaacggauagagccguccugggccgacguuaagaaagaucugauuucauacggaggcgguuggaaacuugagggggaauggaaggagggagaagaggugcagguccuggcauuggaaccaggcaaaaaccccagagccgugcaaacgaagccuggccuauucaaaacuaacaccgggacaaucggagcuguaagucuggacuuuagcccagguaccuccggcucucccaucgucgauaagaaagggaaggugguuggacucuauggcaaugguguggucacaaggucggggacuuacgugagcgccauugcacagaccgagaagucaaucgaggacaacccugaaauagaggaugacauuuucagaaagaaacggcugacgaucauggaucuucauccgggagcuggcaaaacaaagcgcuauuuacccgccauuguuagagaagcgaucaaaaggggccugcggacucucauauuggccccaacccgaguggucgcagcugagauggaagaggcccugagagggcucccuauucgcuaccagacacccgcuaucagggcagagcacaccggacgugaaaucguggaccugaugugucaugccacuuucaccaugcggcuucuguccccaauuagaguaccuaauuauaacuugaucauuauggaugaggcccacuuuacagaccccgcuaguauagcggcaagggguuacaucucuacgcgcguggaaaugggcgaggccgcugggauuuucaugacugccaccccaccgggaagccgagacccuuuuccccaguccaaugcaccaaucauggaugaggaaagagagauccccgaacggucauggaacucuggccacgaguggguuacagacuucaaggguaagaccgucugguuugugccuagcauuaaagccgggaaugauauaacugcuugccuaaggaagaacggcaaaaaggugauccaacugagucgcaaaacauucgacuccgaauauauuaagacccguacgaaugauugggacuuugucguaacuacagauaucagcgagaugggcgcgaacuucaaggccgagagagugauugacccacggagguguaugaaacccguuauccucaccgauggcgaagaacgcgugauauuagcagggccuaugccggucacccauucuucagcugcccagcgaagaggacggguggguaggaauccaaagaacgaaaaugaccaguacaucuacaugggcgagccccuggaaaacgaugaggacugcgcacacuggaaagaggccaagaugcuucuggacaauauuaacacuccugaagggaucauucccuccauguuugagccagaacgcgagaaaguugaugcuaucgacggagaauauagacucaggggcgaggcccggaagacauucguggauuugaugcgucgcggugaccugccugucuggcucgcguaccgaguggcagccgaggggauaaacuaugcugauagaaggugguguuuugacggcgucaaaaauaaccaaauucuggaagagaauguggaaguugagaucuggaccaaggagggagaacggaagaaacuuaagccccgcuggcuagaugccagaauuuacagugacccacuggcuuugaaagaguucaaggaguucgcagccggcaggaagucguuaacacugaaccucaucacugagauggggcggcugccuacguuuaugacccagaaggcucgaaaugcccuugauaaccuggcaguccuccauacagcggaagccggagguagagcuuauaaucacgccuugagcgagcugccggagacucuagaaacccugcuccuucugacauuauuggcaaccgugacuggcgggauauuccuguuucucaugucuggaaagggcaucgguaaaaugacgcuggggaugugcugcauuaucaccgcuuccauucuucugugguacgcccagauccagccccacuggauagcagccagcauuauccucgaguucuuuuugaucgugcuguuaauuccagaaccugagaagcaacgcacaccccaggacaaccagcuaacuuaugucguuaucgcuauacugaccgugguagcggccacaauggcaaaugaaaugggcuuccucgagaaaaccaagaaagauuuuggacuuggcucaauuacuacacagcaaccagacaguaacauccuggauauugacuugaggccugcuucugccuggacgcuguacgccguggcaaccacuuucaucacacccaugcuccggcauuccauagagaauagcucagucaacgugagucugaccgcuaucgccaaucaggcgaccguucuuauggggcucggaaaggguuggccgcugagcaagauggacauuggcgugccauugcuggcuaucggguguuacucccaggucaacccuauuacauuaacugccgcacuacugcuccuuguagcccacuaugcuaucauuggacccggccugcaggcaaaagccacgcgugaagcgcaaaagagagcugccgcagguaucaugaaaauaccagccgcugaugggaugaccgugauugacuuggaucccaucccuuacgacccgaaguuugagaaacagcugggccagguuaugcuccuggugcuuugcgucacacagguguuaaugaugaggacuaccugggcccugugugaagcacucacauuggcuaccggacccaucucuacucugugggagggcaauccagggcgcuucuggaacacgacaauugccgucagcauggcgaauauauuucggggauccuaucuagccggcgcaggucuacucuucucaaucaugaagaacaccgcuaacacucgaagagggaccggaaauacaggcgaaacucuuggugagaaguggaaaaacaggcugaaugccuugggcaagucugaguuucaaauuuacaaaaagagugggauccaggaaguggaucgcacccuggcaaaagagggaauuaagcggggcgaaacagaccaucacgcuguuucgagagggagcgccaaacuccguugguucguggagaggaaccugguaacgccugagggaaagguggucgauuuaggcugcgguagagggggaugguccuauuacuguggcggucuuaagaauguuaaagaagugaagggccugaccaaagggggacccggccaugaggaaccuaucccaaugucuacuuauggguggaaccucguccgccuacagucaggaguggacguauucuuuacacccccugagaagugcgauacccuguugugugacauaggcgaaagcuccccaaaucccacuguggaggccggucgaacacugagaguucucaaccuuguggagaauuggcugaacaauaacacccaauucugcaucaaagucuugaauccguacaugccuagugugauugaaaagauggaggcgcugcagaggaaguacgggggagcucucguccggaacccauuaucucgcaauagcacgcacgaaauguauugggugucaaacgcauccggcaacaucguuaguagcguaaauaugauuucuagaaugcugaucaacagguuuaccaugaaacacaagaaagccacauacgagcccgauguggaccuuggcuccgggacucgaaauauaggaauugaaucagagaccccuaaccuggauaucaucgguaagcggauugagaaaauaaagcaggaacaugagacaagcuggcacuaugaccaggaccauccauacaagacuugggcuuaucacggcucguacgaaaccaaacaaacagggucugccaguuccauggucaauggagugguucgucuacucaccaagcccugggaugugaucccgauggucacucagauggcaaugacggacacaaccccuuucggccagcagagaguguuuaaagagaagguagauacucgcacccaagaacccaaagaggguacaaagaagcugaugaaaauuacggccgagugguuguggaaggaacuggggaaaaagaaaaccccaaggauguguacucgggaggaguucacaagaaaggugcgcagcaacgcugcgcucggagccaucuuuaccgacgagaauaaauggaagucagcaagggaggcuguugaagauuccggcuucugggagcuugucgacaaggaacgaaaccugcacuuagagggcaaaugcgaaacuuguguguauaauaugauggggaagcgggagaaaaagcugggagaguuugguaaagccaagggcucuagagcaauuugguacaugugguugggggccagguuccucgaauuugaggcucugggauuccuaaacgaagaucauugguuuagccgcgagaauagucuuuccggcguggaaggugaggggcugcacaagcucggauacauccugcgugacgucagcaaaaaggagggcggcgccauguaugcggaugacacagcagggugggauacccggauaacauuggaagaccugaaaaacgaggaaaugguuacuaaucauauggagggagaacacagaaagcucgccgaggcuaucuucaggcuuaccuaccagaacaaagugguacgcgugcagcgaccuacgccccgggguaccgucauggacauuaucucuagaagggaucagcgcggcucagggcaagugguuacauauggacugaauacuuucaccaacauggaggcccaguuaauuagacagauggaaggcgaggguguguuuaagaguauccaacaucugacagucacugaagagauugcagugaagaacugguuggagcggguagggagggaacgucucucccgaauggcuauaagcggagacgauugcguugugaaaccacuggacgaucgcuucgccucugcucuaaccgcccuuaaugacaugggcaaggucagaaaagauauccagcagugggagcccucgcggggcuggaacgacuggacacaggugccuuuuugcucacaccacuuccaugaacugauuaugaaggaugggagggugcucgucguuccaugucgcaaucaagacgagcugaucggacgagcacggaucagccagggugcgggcugguccuugagggaaacagccugcuuagggaaaaguuacgcucagauguggucucugauguauuuucaccgacgugaucucagacuugccgcaaacgcuauuuguagcgccgugccgucccauuggguacccaccucacgcacuacauggaguauacacgcaacccacgaguggaugacuaccgaggacaugcugacaguguggaaucgggucuggauccaggaaaacccuuggauggaggauaagacgccaguggaaucuugggaggaaauucccuaccuaggaaagagggaggaccaauggugcggcagccugaucggucucaccuccagagccacuugggcgaaaaauauucagacagcuaucaaccagguucgcucauugauagggaaugaggaauauaccgacuacaugccuagcaugaagcgguucaggcgagaggaagaggaagccggagugcugugguga

SEQ ID NO: 14323 - RNA, 9876 nt, Artificial Sequence
  derived and/or modified CDS sequence (opt3) from DENV-2__KX380828__SS-prME
accgcaggcgugaucauuaugcugauacccacugcuauggcauuccaccucacuacgagaaauggggaaccucauaugaucgucagcaggcaggaaaagggaaaaucccuucuguuuaagaccgaggacgguguuaauaugugcacauugauggccauggauuuaggcgaacugugugaggacacuauuaccuacaacugcccacuacuccggcaaaaugaaccggaggauaucgacuguuggugcaacucuacaucaaccugggugacuuaugggacauguaccgcgacgggagagcaccgccgagaaaaacguaguguugcucuggugccccaugucggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcgugcucaucuucauucugcugacugccguugcuccaucuaugacaaugagaugcaucggcauaucgaauagggauuuuguggaaggggucucaggagguagcuggguggacauuguacucgagcacggcaguuguguuaccacuauggccaaaaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuugugugcaaacacagcauggucgauagaggauggggcaaugguugugggcuauucggaaagggcggcaucgugacuugcgccauguuuaccugcaagaaaaacauggaggggaagaucgugcagccugaaaaucucgaguauacaauugucguuaccccacauuccggagaagagaacgcaguggguaaugacacuggcaaacacgggaaggagauaaaaguaacgccgcagucaaguaucacagaagcugagcugaccggauacggcacugugaccauggaauguagccccaggacaggucuugauuucaacgagaugguccuguugcaaauggaaaauaaggccuggcucgugcaucggcagugguuucuggacuuaccucugccauggcuccccggggcggauacccagggcucuaacuggauucagaaagagaugcuuguuacuuucaagaacccucacgccaagaaacaagacguggucgugcugggaucccaggagggcgcaaugcacacagcuuugacgggggccaccgaaauccagaugucaagcggaaaucuacuguuuacuggucaucucaagugccgucugcgcauggacaaacuucaacugaagggcaugaguuauucuauguguacagggaaauucaagguaguuaaggagauagcugaaacccagcacggaacaauuguggucagagugcaguacgagggcgaugguuccccaugcaaaauccccuucgagaucauggacuuggaaaagaggcauguccucgggcggcugauuacugugaacccgaucguuaccgagaaagauagcccugugaauauugaagccgagcccccauuuggcgacucguacauaaucauuggaguagaaccuggccaguuaaagcugucuugguucaaaaagggguccucaaucggacaaauguuugagacgaccaugcgaggugcaaagcgcauggccauccuaggcgauacagcuugggacuucgggagucucggaggcgucuuuacuagcauugguaaagcgcugcaccagguguucggggcaauauauggcgccgcuuuuuccggaguuucuuggaccaugaagauccuuauuggcguggucaucacauggauugggaugaacagcagaucaacaaguuuguccgugagccugguacucgugggaguugucacccuguaccuuggcgugauggugcaggccgauucugguugugucguuucauggaaaaauaaggagcugaaaugcgggaguggaaucuucauaacggacaacgugcauacauggaccgaacaguauaaguuucaacccgagagcccauccaaguuggcaucugccauccagaaagcucacgaagagggcauuugugguaucaggucggugacucggcucgaaaaucugauguggaagcagauuacacccgaguuaaaccacauccugagcgagaaugaaguaaaacuaaccauaaugacuggcgauauuaaggggaucaugcaggccggaaaacgcucccucagaccucaaccaaccgagcugaaguacucauggaaaacauggggcaaggcaaagaugcuuaguacggaaccgcauaaccagaccuucuugauugacgggcccgagacugcggaaugcccuaauacaaacagggcuuggaacucucuggaggucgaggauuauggauuuggcguguucaccacaaacaucuggcucaaacugaaggaacgucaggacguauuuugugacagcaaauuaauguccgccgcaauaaaggauaaucgggccgugcacgcugacauggguuacuggaucgagucagcccugaacgauacuuggaaaauugaaaaggccagcuucaucgaggucaagucuugccauuggccaaaaucccacacccuuuggaguaacgggguguuggagagcgaaaugauuauccccaagaauuucgcuggaccuguuucucagcacaacuaucgaccaggcuaccauacgcaaacagccggucccuggcaccucggcaaacuggagauggacuuugauuucugugaagggaccacugugguagucaccgaggacugcggaaauagaggcccgucccuaaggacaacuaccgcgucagggaagcugauaacagaauggugcugucgcaguugcacgcucccuccacugcgguacaaaggagaggauggcuguugguaugguauggagauuagaccccuuaaggaaaaggaggaaaacuuggugaauagccuggugaccgccgggcauggacagaucgacaacuuuucguuaggcguccucgguauggcucuguuccuugaggaaaugcugaggacucgcguuggcacaaaacacgcaguguugcucguagccguguccuuuaugacccugaucacugggaauaugucuuuccgagaucuaggacgggucauggugaugguuggcgcugccaugacagacgauauugggaugggagugaccuaccuggcacuccuggcggccuuuaagguccguccuacguucgcugccggccuuuugcugagaaaauuaacuagcaaggagcucaugaugaccacaaucgguauugugcugcuuucacagaguaccauacccgagacuauccuggaacuaacagacgcacucgcucuggggaugaugauuuugaaaaucguuaggaacauggagaaguaucaacuggccgugaccauuauggcaaucuuaugcgccccaaaugcugucauacuccagaacgcguggaagguauccuguacaauccuggccgugguuucugugagcccucuucuguugacuuccucacagcagaaagcagauuggauuccccucgcucugaccaucaagggacuaaauccaacggccauuuuucugacaacccuuagccgcacuaacaaaaagcggaguuggccgcucaaugaagccaucauggcugucggcauggugucuauacuggcauccagcuugcugaaaaacgacauuccuaugaccggccccuuaguagccgggggacuccugacagugugcuacguccuuacugguagaucggcggaccuggaguuggaaagggcugccgauguucgaugggaggaccaagcagagaucucaggcucuaguccaauccucuccauuaccauaagcgaagaugggucuaugagcaucaagaaugaggaagaggagcagacgcugacaauucuaauccgcaccggacugcuugugauuuccggccucuuccccgugucaaucccuauaacugccgcugcaugguaucugugggaagucaaaaagcagcgggccgguguguugugggacguuccaagucccccuccgguagggaaggcggaguuagaagauggagcuuacagaaucaaacagaagggcauucugggcuauagccaaaucggggccggaguguacaaagaggguacauuucauaccauguggcacgucacuaggggcgcagugcucaugcacaaggggaaacguauugaaccaucuugggccgacguucgcaaggaucugaucuccuacggaggcgguuggaaacuugagggggaguggaaagaaggagaggaagugcagguccuggcuuuggagcccggcaagaacccucgggccgugcagacaaaaccaggccuauucaagaccaacacggggacuauaggagcaguaucacuggacuuuagucccgguaccagcggcuccccuauugucgauaaaaaggggaaggugguuggacucuauggcaaugguguggucacaagaucugggaccuacgugucggcuaucgcccagacagaaaagagcaucgaggacaacccggagauugaagaugacaucuucaggaagaaacgacugacuauaauggaucuucaucccggagcgggcaagaccaaacgguauuuaccagccauuguucgcgaggcaaucaagagaggccugaggacgcucauuuuggcuccuacacggguggucgccgcugaaauggaggaagcacugcgagggcuccccaucagauaccaaacuccagccauacgcgccgagcacaccggaagggagauuguggaccugaugugucaugcuacauucaccaugcgucuucugucaccuguacgggugcccaauuauaacuugaucaucauggacgaagcgcacuuuacugauccagcauccauugccgcuagagguuacaucaguaccaggguugagaugggcgaagccgcagggauuuucaugacagccacgccgccuggaucucgcgaccccuuuccacagagcaaugcucccauaauggaugaggagcgagaaaucccugagagauccuggaacucaggccaugaaugggucacugacuucaaggguaaaaccgugugguuugugccaucuauuaaggcggggaaugauaucgccgcaugccuacggaaaaacggaaagaaagucauccagcugagcaggaagacauucgacagugaguauauuaagacccgcacuaaugauugggacuuuguagugacaaccgauauauccgaaaugggcgcuaacuucaaagccgagcguguuaucgaccccagacgguguaugaagccugugauucucacggauggcgaggaaagggucaucuuagcagggccgaugccagugacucacagcucugccgcucaacgccgaggaagaauuggucggaaucccaaaaacgagaaugaccaguacaucuacaugggcgaaccucuggagaacgacgaagauugcgcccacuggaaggaggcgaaaaugcuucuggacaauauaaacacacccgaggggaucauuccaucaauguuugaaccugagagggaaaagguugaugcaaucgacggagaguaucgccucagaggcgaagccaggaaaaccuucguggaguugaugcggcguggugaucugcccgucuggcucgcuuaccgcguggccgcugaggggauuaacuaugcagaccgaagaugguguuuugauggcaucaagaauaaccagauacuggaagagaauguagaaguggagauuuggaccaaggagggagagaaaaagaaacuuaaaccaagguggcuagacgcccggaucuacuccgauccucuggcuuugaaagaguucaaggaguucgccgcaggccgcaagaguuuaacuaugaaccugauuacagagauggggagacucccgaccuuuaugacacagaaagcgaggaaugcccuggacaaccuugcuguucugcauacugccgaagcaggaggucgggcuuauaaucacgcccucagcgaguugcccgagacgcuggaaacccuacugcuccuuacacuguuagcaacugucaccggcgggaucuucuuguuucugaugucgggaaagggcauagguaaaaugacacucgggaugugcugcaucauuaccgccucuauccugcuuugguacgcucaaauucagccacauuggaucgcggccuccauaauucuggaguucuuucucaucguguugcugaucccugaacccgagaagcagcgaacuccacaggauaaccaauuaacguauguggucauugcaauccuaaccguuguggcugccacaauggccaaugaaaugggcuuccuggagaaaacuaagaaggacuuuggacucggcagcauaguagcacagcagccugagucaaacauucuugauaucgaccugagacccgcuagugccuggaccuuguacgcgguggcuacaaccuucauuacuccgaugcugcgccacucuaucgaaaauuccagcgucaacgugucacucacagccauagcaaaucaggccacgguucugauggggcuuggaaaagguuggccacucaguaagauggacaucggcgugccucuguuggcuauuggguguuacagccaagucaaccccaucacccugacugcagccuuacuacugcucguagcgcacuaugcuauuaucggaccaggccuucaggccaaagcaacaagggaggcccagaagcgggcugccgcagguauuaugaaaauccccaccguggaugggauaaccguuauugaccuggauccuaucccguacgaccccaaguuugaaaagcaguugggccaagugaugcugcucguccugugcgugacacagguccuuaugaugcguacuacgugggcuuuaugugaggcccugacccucgcgacaggaccaaucuccacuuugugggaaggcaauccugggagauucuggaacaccacaauugccgugucuauggcaaauauauuuaggggaagcuaucuggcuggcgccggucuacuguucuccaucaugaaaaacaccacuaacacgcgccgggggacaggaaauaccggcgagacucucggugagaaguggaaaaaccgacuuaauucacugggcaagucugaauuucagauuuacaaaagaagugggauccaagagguugauaggaccuuggcaaaggaaggaauuaaacgcggcgagacagaccaucacgcugugucgcgggggagcgccaagcugagaugguucguagagcguaaccucgugacucccgaaggaaaggucauggaucugggcugcgguaggggagggugguccuauuacuguggcgguuuaaagaauguucgggaggugaagggccuuaccaaagggggaccuggccaugaagaaccaauccccaugucuacauauggguggaaccugguccgccuccagucaggaguggacguauucuuuacgccuccagaaaagugcgauacccuacugugugacauaggcgagagcucccccaauccgacuguggaggccggucgaacauugagaguucugaaccucguggaaaauuggcuuaacaauaacacccaguucugcaucaaaguccugaauccuuacaugccaagugugauugagaagauggaaacuuugcagaggaaguacgggggagcgcugguccggaacccccucucucgcaauagcacacacgagauguauugggugucaaacgcuuccggcaacaucguuaguagcguaaauaugauuucuagaauguuaaucaacagguuuaccaugcgacauaaaaaggcaacguacgaaccugauguggaccugggcuccgggacccggaauauaggaauugagucagagacaccaaaccuugauaucaucgguaaacguauugaaaagauaaaacaagagcacgaaacuagcuggcacuaugaccaggaccaucccuacaagaccugggccuaucacggcucguacgagacaaagcagacugggucugcuaguuccauggucaauggagugguuagacugcuaaccaaaccgugggaugugaucccuauggucacacagauggccaugaccgacacuacgcccuucggccaacagcgcguguuuaaggaaaaaguagauacaaggacccaggagccaaaggaggguacuaaaaagcucaugaagauuaccgcagaauggcuguggaaagaguuggggaagaaaaagacaccucggauguguacgagagaagaguucacccgcaaagugaggagcaacgccgcucugggagcgaucuuuacugacgagaauaaguggaaaucagcccgagaagcaguugaggauucccgguucugggaacucgucgacaaggagagaaaccuucaucuggaaggcaagugcgagacauguguguauaauaugaugggcaaaagggagaagaaaauuggggaauuuggacgcgcuaaggguucucgugccaucugguacaugugguuaggcgcacgguuccuggaguuugaagccuugggguuccucaacgaggaucacugguuuagcagagaaaauagucuguccggaguggagggcgagggucuacacaaacuuggguacauacugagggaagucagcaagaaggagggaggcgcuauguaugccgacgauaccgcgggcugggacacucgcaucacacucgaagaucugaaaaacgaggaaaugguuaccaaucauauggagggggagcacaagaaauuggcagaagccauuuucaagcugacauaccagaacaaagugguacgagugcaacggcccacuccaagaggaaccgucauggacaucauuucuaggcgcgaccagagagguucaggccagguggggacguauggacucaauaccuucacaaacaugggcgcucaacuuauccggcagauggagggugaagggguuuuuaagaguauucagcaucugacuaccacagaggagguggccguccaggauugguuagcaagggugggacgugaacgacugucccgcauggcuauaagcggcgacgauugcguaguuaagcccuuggacgauagauucgccucugcucucacugcccugaacgacaugggcaaagugcggaaggauauccaacagugggagccuucgaaaggguggaaugacuggacccaggucccauuuugcucacaccauuuccacgaacuaauuaugaaggauggaagggugcuuguggucccgugucgcaaccaggacgagcugaucgguagagcacggaucagccaaggcgcgggguggucccucagggaaacggccugccugggaaaaaguuacgcucagauguggucuuugauguauuuucaccgacgugauuuaagacuggccgcaaaugcuauuuguagcgccguucccucccauugggugccuacaucacgcaccacuuggaguauacacgcacggcaugaguggaugacaaccgaggacaugcucacuguauggaacaggguguggauccaggaaaauccauggauggaggauaagacccccgucgaaucuugggaggaaauuccuuaccuuggcaagagagaggaccaguggugcgguagccugaucgggcuaacaucccgcgccacgugggcgaaaaacauucaaaccgcuaucaaucaggugcggucacugauaggaagcgaggaauauacugacuacaugccaucuaugaagagguuccgaagagaggaagaggaagccggcguucucugguga
